US012577609B2

(12) United States Patent
Heintz et al.

(10) Patent No.: US 12,577,609 B2
(45) Date of Patent: Mar. 17, 2026

(54) METHODS FOR CELL-TYPE SPECIFIC PROFILING TO IDENTIFY DRUG TARGETS

(71) Applicant: The Rockefeller University, New York, NY (US)

(72) Inventors: Nathaniel Heintz, New York, NY (US); Xiao Xu, New York, NY (US)

(73) Assignee: The Rockefeller University, New York, NY (US)

(*) Notice: Subject to any disclaimer, the term of this patent is extended or adjusted under 35 U.S.C. 154(b) by 765 days.

(21) Appl. No.: 16/485,043

(22) PCT Filed: Feb. 9, 2018

(86) PCT No.: PCT/US2018/017556

§ 371 (c)(1),
(2) Date: Aug. 9, 2019

(87) PCT Pub. No.: WO2018/148501

PCT Pub. Date: Aug. 16, 2018

(65) Prior Publication Data

US 2021/0095334 A1 Apr. 1, 2021

Related U.S. Application Data

(60) Provisional application No. 62/558,396, filed on Sep. 14, 2017, provisional application No. 62/457,420, filed on Feb. 10, 2017.

(51) Int. Cl.

| | |
|---|---|
| *C12Q 1/68* | (2018.01) |
| *C07K 14/705* | (2006.01) |
| *C12N 5/0793* | (2010.01) |
| *C12Q 1/6806* | (2018.01) |
| *C12Q 1/6841* | (2018.01) |
| *G01N 33/58* | (2006.01) |
| *G16B 25/00* | (2019.01) |
| *G16B 25/10* | (2019.01) |
| *G16B 40/00* | (2019.01) |
| *G16B 40/20* | (2019.01) |

(52) U.S. Cl.
CPC .......... *C12Q 1/6841* (2013.01); *C07K 14/705* (2013.01); *C07K 14/70571* (2013.01); *C12N 5/0619* (2013.01); *C12Q 1/6806* (2013.01); *G01N 33/58* (2013.01); *G16B 25/00* (2019.02); *G16B 25/10* (2019.02); *G16B 40/00* (2019.02); *G16B 40/20* (2019.02); *C12N 2503/02* (2013.01)

(58) Field of Classification Search
USPC .......... 435/6.1, 6.11, 7.1, 91.1; 436/94, 501; 536/23.1, 24.3, 24.33; 530/300, 350
See application file for complete search history.

(56) References Cited

U.S. PATENT DOCUMENTS

| | | | |
|---|---|---|---|
| 8,299,233 B2 | 10/2012 | Andre et al. | |
| 2005/0164938 A1* | 7/2005 | Charette | A61K 38/185 |
| | | | 514/8.4 |
| 2009/0131339 A1* | 5/2009 | Matute Almau | A61K 31/352 |
| | | | 514/23 |
| 2011/0071049 A1 | 3/2011 | Heintz et al. | |
| 2014/0255927 A1* | 9/2014 | Levey | G01N 33/6896 |
| | | | 435/6.12 |

FOREIGN PATENT DOCUMENTS

| | | |
|---|---|---|
| WO | 2009/114185 A2 | 9/2009 |
| WO | 2012/105854 A2 | 8/2012 |
| WO | 2016/092070 A1 | 6/2016 |

OTHER PUBLICATIONS

"NeuN" from Wikipedia. Printed on Jul. 21, 2022.*
"Cell nucleus" from Wikipedia. Printed on Feb. 29, 2024.*
Ashkenazy-Titelman et al., Into the basket and beyond: the journey of mRNA through the nuclear pore complex. Biochemical Journal, 477, 23-44, 2020.*
Zack et al., Cell and Nuclear Penetration by Autoantibodies. pp. 305-319 of Autoimmune Reactions which is a book edited by Sudhir Paul, Springer Science+Business Media New York, Originally published by Humana Press Inc. in 1999.*
Hotaling et al., Toward a genome sequence for every animal: Where are we now? PNAS, 118, e2109019118, 2021.*
Tissue expression of GALNT5—Summary—The Human protein Atlas. Printed on May 3, 2025.*
Bai et al., Epigenetic dysregulation of hairy and enhancer of split 4 (HES4) is associated with striatal degeneration in postmortem Huntington brains. Hum Mol Genet. Dec. 5, 2014;24(5):1441-56.
Cahoy et al., A transcriptome database for astrocytes, neurons, and oligodendrocytes: a new resource for understanding brain development and function. J Neurosci. Jan. 2, 2008;28(1):264-78.
Dammer et al., Neuron enriched nuclear proteome isolated from human brain. J Proteome Res. Jul. 5, 2013;12(7):3193-206.
Espada et al., Epigenetic control of nuclear architecture. Cell Mol Life Sci. Jan. 12, 2007;64(4):449-57.
Handley et al., Designing Cell-Type-Specific Genome-wide Experiments. Mol Cell. May 21, 2015;58(4):621-31.
Jiang et al., Isolation of neuronal chromatin from brain tissue. BMC Neurosci. Apr. 28, 2008;9:42, 9 pages.
Krishnaswami et al., Using single nuclei for RNA-seq to capture the transcriptome of postmortem neurons. Nat Protoc. Feb. 18, 2016;11(3):499-524.
Matevossian et al., Neuronal Nuclei Isolation from Human Postmortem Brain Tissue. JOVE, Journal of Visualized Experiments. Oct. 1, 2008:20, 2 pages.
Xu et al., Species and cell-type properties of classically defined human and rodent neurons and glia. Elife. Oct. 15, 2018;7:e37551, 47 pages.

(Continued)

*Primary Examiner* — Frank W Lu

(74) *Attorney, Agent, or Firm* — McCarter & English, LLP; Marcie B. Clarke

(57) ABSTRACT

The present invention provides methods of profiling gene and protein expression of a plurality of nuclei from a single cell type and comparing the profiles to determine variability among cell populations, samples from different subjects, and cells expressing a disease phenotype.

10 Claims, 24 Drawing Sheets

Specification includes a Sequence Listing.

(56)         References Cited

OTHER PUBLICATIONS

Preissl et al., Deciphering the Epigenetic Code of Cardiac Myocyte Transcription. Circ Res. Aug. 14, 2015;117(5):413-23. Contains Supplemental Material.

Risca et al., Unraveling the 3D genome: genomics tools for multiscale exploration. Trends Genet. Jul. 2015;31(7):357-72.

International Search Report and Written Opinion for Application No. PCT/US2018/017556, dated Jul. 2, 2018, 16 pages.

* cited by examiner

FIG. 13A

METHODS FOR CELL-TYPE SPECIFIC PROFILING TO IDENTIFY DRUG TARGETS

CROSS REFERENCE TO RELATED APPLICATIONS

This application is a 35 U.S.C. § 371 national stage filing of International Application No. PCT/US2018/017556, filed Feb. 9, 2018, which claims priority to U.S. provisional patent application 62/457,420, filed Feb. 10, 2017 and U.S. provisional patent application 62/558,396, filed Sep. 14, 2017. Each of the aforementioned applications are hereby incorporated by reference in its entirety.

SEQUENCE LISTING

The instant application contains a "lengthy" Sequence Listing which has been submitted via CD-R in lieu of a printed paper copy and is hereby incorporated by reference in its entirety. This contains a sequence listing text file as part of the originally filed subject matter as follows: File name: 2111_1000PCT_SL.txt; File size: 123,473,920 Bytes; Date created: Feb. 9, 2018. These CD-Rs are labeled "CRF," "Copy 1," and "Copy 2," respectively, and each contain only one identical file, as identified immediately above. The machine-readable format of each CD-R is IBM-PC and the operating system of each compact disc is MS-Windows.

FIELD OF THE INVENTION

The invention relates to profiling gene and protein expression of a plurality of nuclei from a single cell type to identify a drug target.

BACKGROUND OF THE INVENTION

The mammalian central nervous system (CNS) is a complex organ that comprises hundreds of different, intermingled cell types. The ability to genetically target (Gong, et al. (2003) Nature 425, 917-925) and molecularly profile specific cell types (Heiman, et al. (2008) Cell 135, 738-748) has begun to provide insight into essential features of the mammalian brain that were discovered in the founding studies of Ramon y Cajal over a century ago (Ramon y Cajal, S., et al. (1899). Texture of the Nervous System of Man and the Vertebrates (Wein New York: Springer). Each anatomically distinct, classically defined cell type expresses a set of genes that is characteristic (Dougherty, et al. (2010) Nucleic Acids Res 38, 4218-4230 and Doyle, et al. (2008) Cell 135, 749-762), and these genes confer properties that are essential for specialized cellular functions (Kim, I.-J., et al. (2008) Nature 452, 478-482; Nakajima, M., et al. (2014) Cell 159, 295-305). Expression of these genes is dependent on maintenance of cell specific epigenetic states that organize nuclear function (Kriaucionis, et al. (2009) Science 324, 929-930; Mellen, et al. (2012) Cell 151, 1417-1430). Application of present profiling technologies in mouse models has led also to the realization that environmental influences (Heiman, et al. (2008) Cell 135, 738-748; Shrestha, et al. (2015) eLife 4, 289), internal physiological cues (Schmidt, et al. (2012) Cell 149, 1152-1163), and disease causing genetic lesions (Fyffe, et al. (2008) Neuron 59, 947-958; Ingram, et al. (2016) Neuron 89, 1194-1207) alter gene expression in affected cell types. Despite the pace of advances in experimental systems, fundamental issues of human brain complexity remain unsolved. It is not known, for instance, how many distinct cell types exist in the human brain, how these cell types vary between individuals or across species, whether the process of brain aging is equivalent between cell types, and why mutations in broadly expressed genes can have devastating consequences in one or a few select cell types.

Although there is abundant information on the circuits affected in psychiatric and neurodegenerative diseases, the ability to specifically modulate these circuits requires knowledge of targets that are found exclusively in the neurons in the circuit.

A method called Translating Ribosomal Affinity Purification (TRAP) was previously developed to enable the identification of all genes expressed in a cell type of interest. TRAP profiling studies have led to development of several drugs that have entered clinical studies. Although TRAP technology has enabled some drug development, a main limitation of TRAP is that target identification is initially done using transgenic mice. While mice and humans are similar, there are known differences in the CNS circuitry of the two species, and there may also be differences in gene expression across orthologous cell types. Furthermore, it is unknown how much gene expression in specific cells varies across individual subjects and whether these differences affect pathogenesis or response to treatment. In TRAP, BAC vectors are used to create transgenic mice lines. See, Doyle et al., Cell, 135:749-762 (2008) and Heiman et al., Cell, 135:738-748 (2008), which are hereby incorporated by reference in their entireties. The method is then called bacTRAP.

In this method, the EGFP-L10a ribosomal fusion protein is targeted to the desired cell type, e.g., Purkinje cells. Affinity purification is performed for cell-specific polysomal RNAs using anti-EGFP coated magnetic beads as shown in Heiman et al. Microarrays may be used to analyze the purified samples. BACs are frequently selected from the gene expression nervous system atlas (GENSAT) project (www.gensat.org) developed by Dr. Nathaniel Heintz at The Rockefeller University. In some cases, the transgene may be expressed in more than one cell type. For example, immunofluorescence in Doyle et al. showed EGFP-L10a expressed in both Pvalb-positive and NeuN-negative interneurons of the cerebellar molecular layer, which is evidence that both stellate and basket cells were targeted. mRNA is immunoprecipitated, and genome-wide transcriptional profiling is performed on the mRNA sample. These results were compared to profiling of non-immunoprecipitated samples to identify markers specific for the cell type.

To develop more effective and specific drugs, candidate targets need to be identified directly from humans and human tissues instead of transgenic mice, and the extent that these targets vary across individuals needs to be determined. Therefore, there is a long-felt need to develop a generalizable method that enables molecular studies of defined cell types in wild-type animals and humans. In addition, nongenetic technologies are needed to complement the discovery of specific characteristics of neural cell types and circuits in model systems and provide insight into potentially unique properties of the human nervous system.

SUMMARY OF THE INVENTION

Various embodiments of the invention herein provide method profiling the gene expression of a nucleus, the method comprising: processing a tissue sample containing a plurality of cell types to expose nuclei; labeling at least one nucleus from the processed tissue sample by contacting the processed tissue sample with an affinity label that binds a nucleic acid transcript or protein unique to the nucleus of at least one cell type contained in the tissue sample, wherein the nucleic acid transcript or protein is encoded by a gene selected from Tables 19-24; purifying at least one labeled nucleus; and collecting nucleic acid transcript and/or protein expression data for the labeled nucleus, thereby profiling the gene expression of the nucleus.

In some embodiments, the cell type originates in cerebellar tissue, and is selected from the group consisting of: granule cells, Purkinje cells, glia, Bergmann glia, dopaminergic neurons, basket/stellate cells, astrocytes, brainstem motor neurons, oligodendrocytes, upper motor neurons, lower motor neurons, and cerebellar deep nuclei. In some embodiments, the protein is a transcription factor localized within the nuclei. In some embodiments, the cell type originates in basal ganglia tissue, and is selected from the group consisting of: striatonigral medium-sized spiny neurons (MSNs), striatopallidal MSNs, striatal cholinergic interneurons, subthalamic nucleus, dopaminergic neurons, and bed nucleus of the stria terminalis (BNST) neurons. In some embodiments, the cell type originates in thalamus tissue, and is selected from the group consisting of: thalamocortical neurons, thalamostriatal neurons, and thalamic reticular nucleus neurons. In some embodiments, the cell type originates in cortex tissue, and is selected from the group consisting of corticostriatal neurons, entorhinal cortex layer 2/3 neurons, fast-spiking cortical interneurons, and layer 2/3 pyramidal cells from pre-frontal cortex tissue. the cell type is cholinergic projection neurons from medial habenula tissue of a pineal gland. In some embodiments, the cell type originates in hippocampus tissue, and is selected from the group consisting of: cornu ammonis region 1 (CA1), cornu ammonis region 2 (CA2), cornu ammonis region 3 (CA3), and dentate gyms cells. In some embodiments, the cell type originates in at least one tissue selected form the group consisting of: grain tissue, brain stem tissue, and spinal cord tissue.

Various embodiments of the invention herein provide a method of isolating granule cells, the method comprising: processing a tissue sample containing a plurality of cell types to expose nuclei; isolating nuclei from the processed tissue sample by contacting the processed tissue sample with at least one affinity label that binds a nucleic acid transcript or protein encoded by one of genes Itpr, NeuN, Cdh15, Calb2, Rbfox3, Neurod1, and Reln, wherein the nucleic acid transcript or protein is unique to the nuclei of granule cells; and purifying at least one labeled nucleus. In some embodiments, the at least one labeled nucleus does not include a nucleic acid transcript encoded by Olig2.

Various embodiments of the invention herein provide a method of isolating Purkinje cells, the method comprising: processing a tissue sample containing a plurality of cell types to expose nuclei; isolating nuclei from the processed tissue sample by contacting the processed tissue sample with an affinity label that binds a nucleic acid transcript or protein encoded by one of genes Pcp2, Pvalb, Cabl1, and Itpr1; and purifying at least one labeled nucleus.

Various embodiments of the invention herein provide a method of isolating Purkinje cells, the method comprising: processing a tissue sample containing a plurality of cell types to expose nuclei; isolating nuclei from the processed tissue sample by contacting the processed tissue sample with an affinity label that binds a nucleic acid transcript or protein encoded by one of genes Lypd6, Pvalb, Kit, NeuN, Itpr, and Sorcs3; and purifying at least one labeled nucleus.

Various embodiments of the invention herein provide a method of isolating astrocytes and oligodendrocytes, the method comprising: processing a tissue sample containing a plurality of cell types to expose nuclei; isolating nuclei from the processed tissue sample by contacting the processed tissue sample with an affinity label that binds a nucleic acid transcript or protein encoded by one of genes Olig2, Pdga, Cspg4, Mag, Mbp, and Mog; and purifying at least one labeled nucleus.

Various embodiments of the invention herein provide a method of isolating astrocytes, the method comprising: processing a tissue sample containing a plurality of cell types to expose nuclei; isolating nuclei from the processed tissue sample by contacting the processed tissue sample with an affinity label that binds a nucleic acid transcript or protein encoded by one of genes Aldh1a1, Gfap, S110b, and Slc1a3; and purifying at least one labeled nucleus.

Various embodiments of the invention herein provide a method of isolating basket cells, the method comprising: processing a tissue sample containing a plurality of cell types to expose nuclei; isolating nuclei from the processed tissue sample by contacting the processed tissue sample with at least one affinity label that binds a nucleic acid transcript or protein encoded by Sorcs3 and NeuN, wherein the combination of the nucleic acid transcript or protein encoded by Sorcs3 and is unique to the nuclei of basket cells; and purifying at least one labeled nucleus.

Various embodiments of the invention herein provide a method of isolating dopaminergic neurons, the method comprising: processing a tissue sample containing a plurality of cell types to expose nuclei; isolating nuclei from the processed tissue sample by contacting the processed tissue sample with at least one affinity label that binds a nucleic acid transcript or protein encoded by FoxA1, Slc6a3, TH, FoxA2, or Drd2, wherein nucleic acid transcript or protein is unique to the nuclei of dopaminergic neurons; and purifying at least one labeled nucleus.

Various embodiments of the invention herein provide a method of isolating brainstem motor neurons, the method comprising: processing a tissue sample containing a plurality of cell types to expose nuclei; isolating nuclei from the processed tissue sample by contacting the processed tissue sample with at least one affinity label that binds a nucleic acid transcript or protein encoded by VaChT or ErrB, wherein nucleic acid transcript or protein is unique to the nuclei of brainstem motor neurons; and purifying at least one labeled nucleus.

In some embodiments, the affinity label is selected from the group consisting of an antibody, a RNA probe, and a DNA probe. In some embodiments, the method further comprises collecting nucleic acid transcript and/or protein transcript data for the labeled nucleus, thereby profiling the gene expression of the nucleus. In some embodiments, the method further comprises: comparing gene expression of the nucleus to gene expression in at least one nucleus of the cell type from a different tissue sample to identify variability in gene expression, thereby obtaining a drug target. Alternatively, in some embodiments, the method further comprises comparing gene expression of the nucleus to gene expression in at least one nucleus of a different cell type to identify variability in gene expression, thereby obtaining a drug target.

In some embodiments, the affinity label further comprising a fluorescent tag. In some embodiments, purifying of the nucleus is performed by fluorescence-activated cell sorting (FACS). In some embodiments, the tissue sample is derived from a mammal. In some embodiments, the mammal is selected from the group consisting of: a mouse, a human, a rat, and another non-human primate. In some embodiments, the tissue sample or the different tissue sample was frozen prior to isolation of the nucleus. In some embodiments, the tissue sample or the different tissue sample was fresh prior to isolation of the nuclei. In some embodiments, the tissue sample or the different tissue sample is derived from a female. In some embodiments, the tissue sample or the different tissue sample is derived from a male. In some embodiments, the nuclei are contiguous to an endoplasmic reticulum. In some embodiments, the protein is a membrane protein. In some embodiments, the membrane protein is synthesized in the endoplasmic reticulum. In some embodiments, the protein is localized in the endoplasmic reticulum. In some embodiments, the nucleic acid transcript is localized in the nuclei. In some embodiments, the RNA probe specifically binds a chromosomal associated transcript (CAT) or a polyA transcript. In some embodiments, the DNA probe specifically binds a transporter gene. In some embodiments, the affinity label is more than one antibody, RNA probe, or DNA probe. In some embodiments, each affinity label binds a different factor. In some embodiments, the more than one antibody, RNA probe, or DNA probe bind to the same factor.

In some embodiments, the tissue sample is post-mortem. In some embodiments, the tissue sample or the different tissue sample originates from a diseased subject. In some embodiments, the tissue sample or the different tissue sample originates in a healthy subject. In some embodiments, the diseased subject is affected by at least one condition selected from the group consisting of: ataxia, Parkinson's disease, Alzheimer's disease, and amyotrophic lateral sclerosis (ALS), and Huntington's disease. In some embodiments, the cell type is associated with ataxia, and is selected from the group consisting of: Purkinje cells, granule cells, Bergmann glia, basket/stellate cells, astrocytes, oligodendrocytes, and cerebellar deep nuclei. In some embodiments, the cell type is associated with Parkinson's Disease, and is selected from the group consisting of: substantia nigra and VTA dopaminergic neurons. In some embodiments, the cell type is associated with Alzheimer's Disease, and is selected from: layer 2/3 entorhincortex, CA1 hippocampus, and CA2/3 hippocampus. In some embodiments, the cell type is associated with ALS, and is selected from the group consisting of: brain stem, cortical motor neurons, and spinal cord motor neurons. In some embodiments, the diseased subject is expressing a disease phenotype. In some embodiments, the diseased subject is not expressing a disease phenotype. In some embodiments, the method further comprises comparing profiling for a tissue sample originating from a diseased subject and a tissue sample from a healthy subject. In some embodiments, the method further comprises comparing profiling for a tissue sample originating from at least two different healthy subjects. In some embodiments, the method further comprises identifying variability between disease stages by comparing profiling for a tissue sample from a diseased subject expressing a disease phenotype with profiling for a tissue sample from a diseased subject not expressing a disease phenotype.

In some embodiments, the method further comprises profiling the gene expression is performed for a plurality of nuclei from a single cell type. In some embodiments, the method further comprises profiling the gene expression is performed for a plurality of nuclei from different cell types. In some embodiments, the method further comprises identifying variability among different subjects by comparing profiling for more than one tissue sample, wherein each tissue sample is from a different subject. In some embodiments, the drug target is encoded by a gene selected from Tables 19-24.

Various embodiments of the invention herein provide a method of profiling epigenetic expression of a nucleus, the method comprising: processing a tissue sample containing a plurality of cell types to expose nuclei; isolating nuclei from the processed tissue sample by contacting the processed tissue with an affinity label that binds a factor unique to at least one cell type, wherein the affinity label is selected from the group consisting of an antibody, a RNA probe, and a DNA probe; purifying at least one labeled nucleus; and collecting information regarding histone modifications, binding of transcription factors, and DNA modifications for the nucleus, thereby profiling the epigenetic expression.

Various embodiments of the invention herein provide a method of profiling nuclear architecture of a nucleus, the method comprising: processing a tissue sample containing a plurality of cell types to expose nuclei; isolating nuclei from the processed tissue sample by contacting the processed tissue with an affinity label that binds a factor unique to at least one cell type, wherein the affinity label is selected from the group consisting of an antibody, a RNA probe, and a DNA probe; purifying at least one labeled nucleus; and collecting information regarding chromosome conformation for the labeled nucleus, thereby profiling the nuclear architecture.

Various embodiments of the invention herein provide a method of profiling nuclear architecture of a nucleus, the method comprising: processing a tissue sample containing a plurality of cell types to expose nuclei; isolating nuclei from the processed tissue sample by contacting the processed tissue with an affinity label that binds a factor unique to at least one cell type, wherein the affinity label is an antibody; isolating gDNA from the nuclei; performing oxidative bisulfate sequencing; and collecting chromosome conformation for the labeled nucleus, thereby profiling the nuclear architecture.

Various embodiments of the invention herein provide a method of isolating a nucleus from a single cell type, the method comprising: processing a tissue sample containing a plurality of cell types to expose nuclei; isolating nuclei from the processed tissue sample by contacting the processed tissue sample with more than two affinity labels specific to a unique combination of nucleic acid transcripts and/or proteins for the cell type, wherein each affinity label specifically binds a nucleic acid transcript comprising a sequence selected from SEQ ID NO: 1-28,815 or the affinity label specifically binds a protein comprising an amino acid sequence selected from 28,816-38,643; and purifying at least one labeled nucleus, thereby isolating the nucleus from the cell type.

BRIEF DESCRIPTION OF THE DRAWINGS

FIG. 11A shows results for Aqp7. FIG. 11B shows results for Asic1, and FIG. 11C shows results for Robo2.

FIG. 13A shows gene expression of fos genes and immediate early genes in granule cells, stellate cells, and glia.

DETAILED DESCRIPTION OF THE INVENTION

I. Introduction

Figure 1:
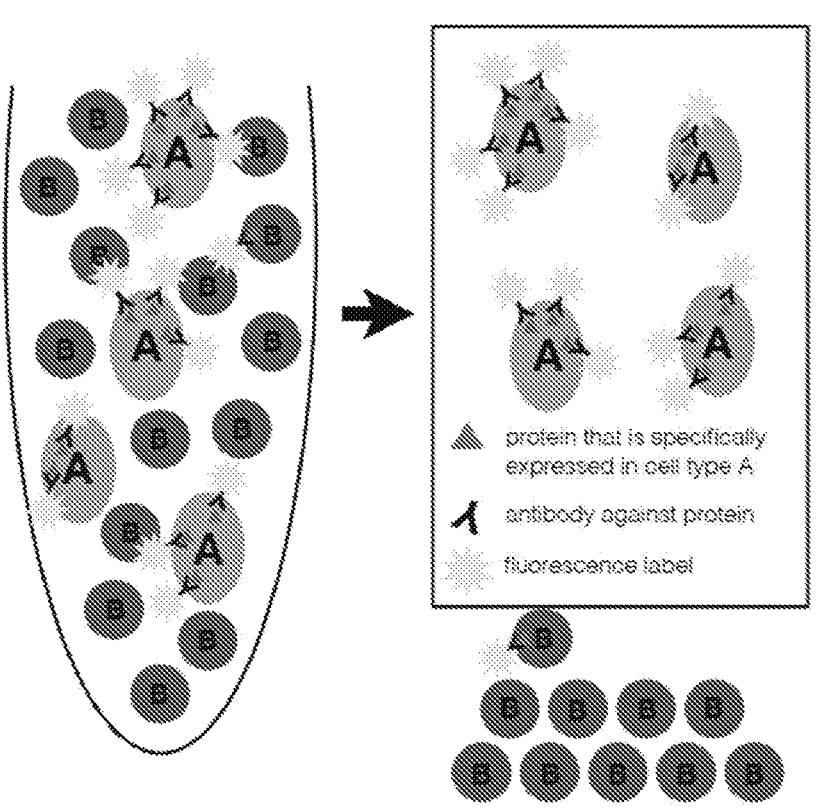
FIG. 1 shows an embodiment of a sorting method that may be used in the cellular profiling technique described herein. "A" represents nuclei of the cell type of interest, and "B" represents nuclei of another cell type.

Complex tissue is made of many cell types. The translating ribosomal affinity purification (TRAP) method has been used previously to define the molecular signature of diverse cell types in a single tissue. The TRAP method requires the use of transgenic animals, which creates numerous challenges. For example, some disease models are difficult to breed in animals, and animal models do not necessarily recapitulate all aspects of human disease, such as effects on human neurons. Further, a study of aging would require maintaining a specific transgenic strain for years. Additionally, the TRAP method requires fresh samples containing high quality RNA for accurate analysis.

Determination of the molecular properties of genetically targeted cell types has led to fundamental insights into mouse brain function and dysfunction. Embodiments of the cellular profiling technique described herein provide a strategy for exploration of gene expression events in specific cell types in a broad range of species for in-depth and reproducible studies of gene expression to identify markers for each cell type or condition. Results are shown herein for mouse, rat, and human neurons and glia, and features of homologous human cell types have been revealed. Classically defined, homologous neuronal and glial cell types are shown to differ between rodents and humans by the expression of hundreds of orthologous, cell specific genes. Evidence that these genes are differentially active was obtained using the combination of epigenetic mapping, RNAseq, quantitative PCR, and immunofluorescence localization. Studies of sixteen human postmortem brains showed cell-specific molecular responses to aging. The responses of human neurons and glia to aging were observed to be cell-type specific, and that analysis of postmortem human brain tissue also revealed the induction of a shared, robust response to an unknown external event experienced by three of sixteen donors. The compositions and methods herein establish a comprehensive approach for analysis of unique molecular events associated with specific pathways and cell types in a wide variety of human conditions.

Recent advances in technologies for human genome sequencing and analysis have led to an increase in knowledge of the complex genetic causes of human psychiatric and neurological disease (Burguiere, et al. (2015) Curr Opin Neurobiol 30, 59-65; Hinz, F. I., et al. (2017). Molecular Genetics of Neurodegenerative Dementias. PubMed-NCBI. Cold Spring Harb Perspect Biol 9, a023705; Vorstman, et al. (2017) Nat Rev Genet 18, 362-376, each of which are hereby incorporated by reference herein in its entirety). In some cases, recreation of the causative mutations in the mouse genome has resulted in experimental models that are sufficiently accurate for investigation of the molecular basis of the disorder (Lombardi, et al. (2015) J. Clin. Invest. 125, 2914-2923; Lyst, et al. (2015). Nat Rev Genet 16, 261-275; Orr, H. T. (2012) J. Cell Biol. 197, 167-177, each of which is hereby incorporated by reference herein in its entirety), and they have led to the discovery of unexpected features of the disease (Guy, al. (2007) Science 315, 1143-1147, which is hereby incorporated by reference herein in its entirety). In other cases, informative animal models remain elusive (Lavin, M. F. (2013). DNA Repair 12, 612-619, which is hereby incorporated by reference herein in its entirety), and investigation of molecular mechanisms of disease remains difficult (Biton, et al. (2008) DNA Repair 7, 1028-1038; Medina, M., et al. (2014) Front. Pharmacol. 5, 270, which is hereby incorporated by reference herein in its entirety).

Technologies used previous to the development of the cellular profiling technique described herein to attempt genome wide profiling of specific cell types in human tissues include laser capture microdissection and single cell sequencing technologies. Neither technology can produce reliable deep profiles of identified cell types. Laser capture microdissection requires specialized equipment and training, and results are heavily dependent on the precise dissection methodology and tissue anatomy; therefore, there is tremendous variability in results across samples.

The data from single cell RNAseq is also highly variable between individual cells. Single cell RNAseq is also problematic in the nervous system because it is difficult to dissociate neurons away from each other. In studies that dissociate neurons, only the cell body is captured, and the neuronal processes (axons and dendrites) are lost. It is well known in the art that the processes in neurons are very large compared to the size of the cell body and also have their own local translation machinery. Therefore, gene expression analysis of only cell bodies is depleted for genes that are expressed in neuronal processes, which some of the most important genes for determining neuronal identity. By profiling gene expression in the nucleus, which synthesizes all RNA for the cell, this bias can be avoided. The depth of data from any individual cell is not sufficient to establish a comprehensive profile, thus this method is not accepted by many in the art of cellular profiling.

Human disease is a problem that is experienced across an entire population of cells. Cell types from single-cell analysis must be defined post-hoc, and this analysis may be obscured by disease state. Additionally, sequencing results from single cell RNAseq are not deep enough to detect subtle changes that may occur with disease. For these reasons, the cell type should be considered as a population. To do so using single cell methods would require sequencing thousands of individual cells, and some cell types are so rare that enrichment is required to study a disease that only affects these rare cell types. Distinguishing technical and biological variability would be nearly impossible without enrichment.

To enable the identification of human specific targets, the cellular profiling technique described herein has been developed for molecular profiling of specific cell types post-mortem human tissue. The cellular profiling technique described herein has a broad range of applications including studying gene expression and epigenetic changes to identify targets drugs or other therapeutic modalities.

Because cells in the CNS have complex morphologies and cannot be effectively dissociated from each other, the cellular profiling technique described herein sorts for nuclei rather than whole cells. In some embodiments of the method, after isolating nuclei from a brain region of interest, the nuclei may be immunostained with antibodies specific to transcription factors or transcripts that specifically label the cell type of interest. Immunofluorescence establishes whether nuclei can be labeled using an antibody against a membrane protein. Staining was observed in the endoplasmic reticulum (ER) around the nucleus. Alternatively, RNA probes or DNA probes may be used to label the cell type of interest.

In some embodiments, after purifying the labeled population using fluorescent activated cell sorting (FACS), the isolated nuclei may be used for gene expression profiling. FIG. 1 provides an embodiment of a sorting method that may be used with the cellular profiling technique described herein. "A" represents nuclei of the cell type of interest, and "B" represents nuclei from another cell type.

In certain embodiments, an algorithm may be used to identify cell-specific and enriched gene expression for a single cell type. For example, one analytical method for identifying and quantifying cell-specific and enriched mRNAs across multiple cell populations is referred to as specificity index (SI), as described in Dougherty et al., Nucleic Acids Research, 38(13):4218-4230, which is hereby incorporated by reference in its entirety. Gene expression was measured in multiple cell types. These values were first normalized within replicates and then globally normalized across cell types. Non-specific background was filtered out using negative controls. The filtered values were iteratively compared to other unfiltered samples in the dataset and a ratio was calculated for each set of samples. The sets were ranked from highest to lowest to prevent extreme outliers from skewing the subsequent analysis and to make analysis more robust for difficult to normalize data sets. These ranks are averaged to provide the SI. Permutation testing was used to assign a p-value to each SI value to provide a list of genes significantly enriched in the cell type of interest. The lower the SI value the more specific that the gene is to the cell type.

The cellular profiling technique described herein has a range of applications including: identifying human targets for therapeutics, understanding how variability between people leads to the variable penetrance of therapeutics, investigating the early changes that occur in human degenerative disorders, identifying drug targets, and developing therapies based on comparative analysis of vulnerable and spared cell populations. The cellular profiling technique described herein can be used to profile any cell type of interest. For example, gene expression may be compared for different cell types to identify genes that are uniquely expressed in the cell type of interest to identify putative drug targets. By comparing heterogeneity among different patients may also reveal biomarkers of disease that could be used to identify patients before symptoms appear or to select subsets of patients in whom a therapeutic intervention would be more effective.

In other embodiments, gene expression between species (e.g. mouse and human) is compared using the cellular profiling technique described herein to identify shared and species-specific genes. This information also informs drug discovery because mouse specific targets are less commercially valuable. Additionally, species-shared targets allow for basic studies in mice that are more likely to translate to humans. Finally, the human-specific targets may be the reason humans develop some diseases but it's difficult to make a mouse to develop the same disease. Following up on shared targets may offer novel drug targets that could not be identified in mice only.

Another application of the cellular profiling technique described herein is comparing gene expression between the same cell type in the same tissue across different individuals to identify variability across individuals. Presently, genome-wide association studies (GWAS) are used to look at variability between individuals at the DNA level, but these techniques do not show whether variability in DNA impacts gene expression and function. Data generated by the cellular profiling technique described herein can be used for patient stratification and combined with GWAS data to determine why there is variability in response to treatments across individuals.

In contrast to the TRAP method, the cellular profiling technique described herein does not require use of transgenic animals. The cellular profiling technique described herein can be used with postmortem tissue from any species including non-model organisms such as humans and other primates.

In certain embodiments of the invention, a tissue sample was processed, and an antibody specific to a protein that is expressed in a cell type of interest was added to the sample. A fluorescent label for the antibody was then added to the sample. Nuclei from the cell type of interest were isolated from the tissue sample by fluorescence. For example, FACS was used to isolate the nuclei based on fluorescence intensity. Sorting may be performed using antibodies specific to transcription factors that are localized in the nucleus (e.g., Matevossian et al., J. Vis. Exp. (13), e717, doi:10.3791/717, (2008), which is hereby incorporated by reference in its entirety) or using antibodies specific to proteins that that are localized in the endoplasmic reticulum (ER). Since many neurons have been identified based on membrane markers, antibodies specific to membrane proteins that are synthesized in the ER may be used to study the nervous system. Additionally, a portion of the endoplasmic reticulum was observed to remain attached to the isolated nuclei.

The antibodies used for labeling and sorting nuclei from specific cell types may be selected from previous TRAP method studies to identify factors that are specifically expressed in our cell types of interest. Alternative to antibodies, RNA or DNA probes that are specific to nucleic acid transcripts localized in the nucleus or the ER of the cell type(s) of interest are used. For example, Mo et al., *Neuron*, 86:1364-1384 (2015), which is hereby incorporated by reference in its entirety, analyzed excitatory neuron, PV interneurons, and VIP neurons in transgenic mice using Camk2a, PV, and VIP as targets, respectively. In Mo, about 50% of the cortical nuclei were Camk2a positive, about 3% were PV positive, and about 2% were VIP positive.

The methods herein provide studies of cellular vulnerability in human neurodegenerative disease, and circuit based molecular characterization of cell types involved in obsessive compulsive disorder, drug addiction, autism spectrum disorder, and age dependent cognitive loss. In some embodiments, the goal of the cellular profiling technique described herein is to obtain human CNS cell type data to establish a characterization of brain circuits or pathways implicated in important human neurological disorders and neurodegenerative diseases. For example, cell specific data from mice were obtained using antibodies specific to proteins identified from nuclear enriched, fully processed, polyA+ RNA and chromosomal associated transcripts (CATs). RNA/DNA probes against these may be designed for additional labeling and sorting. Specifically, purified GFP+ nuclei from transgenic animals developed for the TRAP method and isolated RNA was analyzed using PolyDT beads to capture the PolyA+ RNA, which are mature RNAs. An enrichment was observed for RNAs in the ER, which is contiguous with the nuclear membrane. These data provide details about transcripts that are enriched in the ER close to the nucleus and that are putative targets for antibodies and RNA/DNA probes that may be used to perform the sorting step in the cellular profiling technique described herein. The methods herein result in production of highly reproducible cell type specific data, and confirmation of cell specific expression profiles by in situ hybridization or immunofluorescence of newly discovered cell specific markers in human tissue samples. This data provides confirmation that transcript profiles from bulk tissue, such as from the brain, can be used to identify new cell specific probes.

II. Gene Nomenclature

Gene symbols are used herein, along with ENSEMBL Gene IDs, to refer to genes from mice, rats, and humans. Unless otherwise noted, the gene names corresponding to each gene symbol are shown in Table 1.

TABLE 1

| Gene symbols and names | |
| --- | --- |
| Symbol | Name |
| 1700025G04Rik | RIKEN cDNA 1700025G04 gene |
| 1700047M11Rik | RIKEN cDNA 1700047M11 gene |
| 1810041L15Rik | RIKEN cDNA 1810041L15 gene |
| 2410124H12Rik | RIKEN cDNA 2410124H12 gene |
| 2410131K14Rik | RIKEN cDNA 2410131K14 gene |
| 2810459M11Rik | RIKEN cDNA 2810459M11 gene |
| 3110035E14Rik | RIKEN cDNA 3110035E14 gene |
| 3110039M20Rik | RIKEN cDNA 3110039M20 gene |
| 3110043O21Rik | RIKEN cDNA 3110043O21 gene |
| 3632451O06Rik | RIKEN cDNA 3632451O06 gene |
| 4930578C19Rik | RIKEN cDNA 4930578C19 gene |
| 5730559C18Rik | RIKEN cDNA 5730559C18 gene |
| 8030451O07Rik | N/A |
| 9530059O14Rik | RIKEN cDNA 9530059O14 gene |
| 9530077C05Rik | RIKEN cDNA 9530077C05 gene |
| A230077H06Rik | RIKEN cDNA A230077H06 gene |
| A2M | alpha-2-macroglobulin |
| A730036I17Rik | RIKEN cDNA A730036I17 gene |
| A830018L16Rik | RIKEN cDNA A830018L16 gene |
| AASS | aminoadipate-semialdehyde synthase |
| AATK | apoptosis associated tyrosine kinase |
| ABAT | 4-aminobutyrate aminotransferase |
| ABCA1 | ATP binding cassette subfamily A member 1 |
| ABCA17P | ATP binding cassette subfamily A member 17, pseudogene |
| ABCA8 | ATP binding cassette subfamily A member 8 |
| ABCC10 | ATP binding cassette subfamily C member 10 |
| ABCC8 | ATP binding cassette subfamily C member 8 |
| ABCG2 | ATP binding cassette subfamily G member 2 (Junior blood group) |
| ABHD2 | abhydrolase domain containing 2 |
| ABHD3 | abhydrolase domain containing 3 |
| ABHD5 | abhydrolase domain containing 5 |
| ABI3 | ABI family member 3 |
| ABI3BP | ABI family member 3 binding protein |
| ABL1 | ABL proto-oncogene 1, non-receptor tyrosine kinase |
| ABLIM1 | actin binding LIM protein 1 |
| ABLIM2 | actin binding LIM protein family member 2 |
| ABLIM3 | actin binding LIM protein family member 3 |
| ABRA | actin binding Rho activating protein |
| ABTB2 | ankyrin repeat and BTB domain containing 2 |
| ACAD8 | acyl-CoA dehydrogenase family member 8 |
| ACAP3 | ArfGAP with coiled-coil, ankyrin repeat and PH domains 3 |
| ACE | angiotensin I converting enzyme |
| ACER3 | alkaline ceramidase 3 |
| ACHE | acetylcholinesterase (Cartwright blood group) |
| ACO2 | aconitase 2 |
| ACOT11 | acyl-CoA thioesterase 11 |
| ACOT7 | acyl-CoA thioesterase 7 |
| ACSBG1 | acyl-CoA synthetase bubblegum family member 1 |
| ACSM5 | acyl-CoA synthetase medium chain family member 5 |
| ACSS1 | acyl-CoA synthetase short chain family member 1 |
| ACSS3 | acyl-CoA synthetase short chain family member 3 |
| ACTB | actin beta |
| ACTBL2 | actin, beta like 2 |
| ACTC1 | actin, alpha, cardiac muscle 1 |
| ACTL6B | actin like 6B |
| ACTN2 | actinin alpha 2 |
| ACTR3B | ARP3 actin related protein 3 homolog B |
| ADAM11 | ADAM metallopeptidase domain 11 |
| ADAM12 | ADAM metallopeptidase domain 12 |
| ADAM19 | ADAM metallopeptidase domain 19 |
| ADAMTS10 | ADAM metallopeptidase with thrombospondin type 1 motif 10 |
| ADAMTS15 | ADAM metallopeptidase with thrombospondin type 1 motif 15 |
| ADAMTS16 | ADAM metallopeptidase with thrombospondin type 1 motif 16 |
| ADAMTS17 | ADAM metallopeptidase with thrombospondin type 1 motif 17 |
| ADAMTS18 | ADAM metallopeptidase with thrombospondin type 1 motif 18 |
| ADAMTS2 | ADAM metallopeptidase with thrombospondin type 1 motif 2 |

TABLE 1-continued

Gene symbols and names

| Symbol | Name |
| --- | --- |
| ADAMTS6 | ADAM metallopeptidase with thrombospondin type 1 motif 6 |
| ADAMTS7 | ADAM metallopeptidase with thrombospondin type 1 motif 7 |
| ADAMTS9 | ADAM metallopeptidase with thrombospondin type 1 motif 9 |
| ADAMTSL3 | ADAMTS like 3 |
| ADAMTSL4 | ADAMTS like 4 |
| ADARB1 | adenosine deaminase, RNA specific B1 |
| ADARB2 | adenosine deaminase, RNA specific B2 (inactive) |
| ADCY1 | adenylate cyclase 1 |
| ADCYAP1R1 | ADCYAP receptor type I |
| ADD2 | adducin 2 |
| ADGRA1 | adhesion G protein-coupled receptor A1 |
| ADGRA3 | adhesion G protein-coupled receptor A3 |
| ADGRG1 | adhesion G protein-coupled receptor G1 |
| ADGRL3 | adhesion G protein-coupled receptor L3 |
| ADGRV1 | adhesion G protein-coupled receptor V1 |
| ADM | adrenomedullin |
| ADORA1 | adenosine A1 receptor |
| ADORA2B | adenosine A2b receptor |
| ADRA1A | adrenoceptor alpha 1A |
| ADRA1B | adrenoceptor alpha 1B |
| ADRA1D | adrenoceptor alpha 1D |
| ADRA2B | adrenoceptor alpha 2B |
| ADRB2 | adrenoceptor beta 2 |
| AF529169 | cDNA sequence AF529169 |
| AFAP1 | actin filament associated protein 1 |
| AFAP1L1 | actin filament associated protein 1 like 1 |
| AFAP1L2 | actin filament associated protein 1 like 2 |
| AFF2 | AF4/FMR2 family member 2 |
| AFP | alpha fetoprotein |
| AGAP1 | ArfGAP with GTPase domain, ankyrin repeat and PH domain 1 |
| AGBL2 | ATP/GTP binding protein like 2 |
| AGPAT3 | 1-acylglycerol-3-phosphate O-acyltransferase 3 |
| AGPAT4 | 1-acylglycerol-3-phosphate O-acyltransferase 4 |
| AGRN | agrin |
| AGT | angiotensinogen |
| AHNAK | AHNAK nucleoprotein |
| AHRR | aryl-hydrocarbon receptor repressor |
| AHSA1 | activator of HSP90 ATPase activity 1 |
| AI464131 | expressed sequence AI464131 |
| AI593442 | expressed sequence AI593442 |
| AK4 | adenylate kinase 4 |
| AKAIN1 | A-kinase anchor inhibitor 1 |
| AKAP13 | A-kinase anchoring protein 13 |
| AKNA | AT-hook transcription factor |
| AKR1C1 | aldo-keto reductase family 1 member C1 |
| AKR1C2 | aldo-keto reductase family 1 member C2 |
| AKR1C3 | aldo-keto reductase family 1 member C3 |
| AKR1C4 | aldo-keto reductase family 1 member C4 |
| ALAS2 | 5'-aminolevulinate synthase 2 |
| ALCAM | activated leukocyte cell adhesion molecule |
| ALDH1A1 | aldehyde dehydrogenase 1 family member A1 |
| ALDH1A3 | aldehyde dehydrogenase 1 family member A3 |
| ALDH1L1 | aldehyde dehydrogenase 1 family member L1 |
| ALDH1L2 | aldehyde dehydrogenase 1 family member L2 |
| ALDH6A1 | aldehyde dehydrogenase 6 family member A1 |
| ALDOC | aldolase, fructose-bisphosphate C |
| ALK | ALK receptor tyrosine kinase |
| ALOX5 | arachidonate 5-lipoxygenase |
| ALS2 | ALS2, alsin Rho guanine nucleotide exchange factor |
| ALS2CR12 | amyotrophic lateral sclerosis 2 chromosome region 12 |
| AMPD3 | adenosine monophosphate deaminase 3 |
| AMZ1 | archaelysin family metallopeptidase 1 |
| ANGPT1 | angiopoietin 1 |
| ANGPTL3 | angiopoietin like 3 |
| ANKRD33B | ankyrin repeat domain 33B |
| ANKRD37 | ankyrin repeat domain 37 |
| ANKRD42 | ankyrin repeat domain 42 |
| ANLN | anillin actin binding protein |
| ANO4 | anoctamin 4 |
| ANO6 | anoctamin 6 |
| ANXA3 | annexin A3 |

TABLE 1-continued

Gene symbols and names

| Symbol | Name |
| --- | --- |
| AOX1 | aldehyde oxidase 1 |
| AP1S3 | adaptor related protein complex 1 sigma 3 subunit |
| APBA2 | amyloid beta precursor protein binding family A member 2 |
| APBB2 | amyloid beta precursor protein binding family B member 2 |
| APCDD1 | APC down-regulated 1 |
| APEX2 | apurinic/apyrimidinic endodeoxyribonuclease 2 |
| APH1B | aph-1 homolog B, gamma-secretase subunit |
| APLNR | apelin receptor |
| APLP1 | amyloid beta precursor like protein 1 |
| APOD | apolipoprotein D |
| APPL2 | adaptor protein, phosphotyrosine interacting with PH domain and leucine zipper 2 |
| AQP4 | aquaporin 4 |
| AQP7 | aquaporin 7 |
| AQP9 | aquaporin 9 |
| AR | androgen receptor |
| ARAP3 | ArfGAP with RhoGAP domain, ankyrin repeat and PH domain 3 |
| ARC | activity regulated cytoskeleton associated protein |
| ARF4 | ADP ribosylation factor 4 |
| ARG2 | arginase 2 |
| ARHGAP10 | Rho GTPase activating protein 10 |
| ARHGAP15 | Rho GTPase activating protein 15 |
| ARHGAP20 | Rho GTPase activating protein 20 |
| ARHGAP22 | Rho GTPase activating protein 22 |
| ARHGAP23 | Rho GTPase activating protein 23 |
| ARHGAP24 | Rho GTPase activating protein 24 |
| ARHGAP25 | Rho GTPase activating protein 25 |
| ARHGAP26 | Rho GTPase activating protein 26 |
| ARHGAP29 | Rho GTPase activating protein 29 |
| ARHGAP32 | Rho GTPase activating protein 32 |
| ARHGEF10L | Rho guanine nucleotide exchange factor 10 like |
| ARHGEF2 | Rho/Rac guanine nucleotide exchange factor 2 |
| ARHGEF26 | Rho guanine nucleotide exchange factor 26 |
| ARHGEF28 | Rho guanine nucleotide exchange factor 28 |
| ARHGEF3 | Rho guanine nucleotide exchange factor 3 |
| ARHGEF33 | Rho guanine nucleotide exchange factor 33 |
| ARHGEF37 | Rho guanine nucleotide exchange factor 37 |
| ARHGEF4 | Rho guanine nucleotide exchange factor 4 |
| ARHGEF6 | Rac/Cdc42 guanine nucleotide exchange factor 6 |
| ARIH1 | ariadne RBR E3 ubiquitin protein ligase 1 |
| ARL4A | ADP ribosylation factor like GTPase 4A |
| ARL5B | ADP ribosylation factor like GTPase 5B |
| ARMCX1 | armadillo repeat containing, X-linked 1 |
| ARNT2 | aryl hydrocarbon receptor nuclear translocator 2 |
| ARPP21 | cAMP regulated phosphoprotein 21 |
| ARRB1 | arrestin beta 1 |
| ARRDC3 | arrestin domain containing 3 |
| ARSDP1 | arylsulfatase D pseudogene 1 |
| ARSG | arylsulfatase G |
| ARX | aristaless related homeobox |
| ASAP3 | ArfGAP with SH3 domain, ankyrin repeat and PH domain 3 |
| ASCL1 | achaete-scute family bHLH transcription factor 1 |
| ASGR1 | asialoglycoprotein receptor 1 |
| ASIC1 | acid sensing ion channel subunit 1 |
| ASIC2 | acid sensing ion channel subunit 2 |
| ASIC4 | acid sensing ion channel subunit family member 4 |
| ASNS | asparagine synthetase (glutamine-hydrolyzing) |
| ASPA | aspartoacylase |
| ASPG | asparaginase |
| ASTN2 | astrotactin 2 |
| ATAD2 | ATPase family, AAA domain containing 2 |
| ATF3 | activating transcription factor 3 |
| ATF6B | activating transcription factor 6 beta |
| ATL2 | atlastin GTPase 2 |
| ATL3 | atlastin GTPase 3 |
| ATOH8 | atonal bHLH transcription factor 8 |
| ATP13A4 | ATPase 13A4 |
| ATP1A1 | ATPase Na+/K+ transporting subunit alpha 1 |
| ATP1A2 | ATPase Na+/K+ transporting subunit alpha 2 |
| ATP1A3 | ATPase Na+/K+ transporting subunit alpha 3 |
| ATP1B1 | ATPase Na+/K+ transporting subunit beta 1 |
| ATP1B2 | ATPase Na+/K+ transporting subunit beta 2 |

TABLE 1-continued

Gene symbols and names

| Symbol | Name |
| --- | --- |
| ATP1B3 | ATPase Na+/K+ transporting subunit beta 3 |
| ATP2A3 | ATPase sarcoplasmic/endoplasmic reticulum Ca2+ transporting 3 |
| ATP2B2 | ATPase plasma membrane Ca2+ transporting 2 |
| ATP2B3 | ATPase plasma membrane Ca2+ transporting 3 |
| ATP2C2 | ATPase secretory pathway Ca2+ transporting 2 |
| ATP6V0B | ATPase H+ transporting V0 subunit b |
| ATP8A1 | ATPase phospholipid transporting 8A1 |
| ATP8B1 | ATPase phospholipid transporting 8B1 |
| ATRNL1 | attractin like 1 |
| ATXN1 | ataxin 1 |
| ATXN7L2 | ataxin 7 like 2 |
| AVPI1 | arginine vasopressin induced 1 |
| AXL | AXL receptor tyrosine kinase |
| AZGP1 | alpha-2-glycoprotein 1, zinc-binding |
| AZIN1 | antizyme inhibitor 1 |
| B230209E15Rik | RIKEN cDNA B230209E15 gene |
| B3GALT4 | beta-1,3-galactosyltransferase 4 |
| B3GAT2 | beta-1,3-glucuronyltransferase 2 |
| B3GLCT | beta 3-glucosyltransferase |
| B3GNT5 | UDP-GlcNAc:betaGal beta-1,3-N-acetylglucosaminyltransferase 5 |
| B3GNT7 | UDP-GlcNAc:betaGal beta-1,3-N-acetylglucosaminyltransferase 7 |
| B4GALT6 | beta-1,4-galactosyltransferase 6 |
| BACH2 | BTB domain and CNC homolog 2 |
| BAD | BCL2 associated agonist of cell death |
| BAG3 | BCL2 associated athanogene 3 |
| BAIAP2 | BAI1 associated protein 2 |
| BAMBI | BMP and activin membrane bound inhibitor |
| BARHL1 | BarH like homeobox 1 |
| BARHL2 | BarH like homeobox 2 |
| BASP1 | brain abundant membrane attached signal protein 1 |
| BBS2 | Bardet-Biedl syndrome 2 |
| BC052040 | N/A |
| BCAR1 | BCAR1, Cas family scaffolding protein |
| BCAS1 | breast carcinoma amplified sequence 1 |
| BCAS2 | BCAS2, pre-mRNA processing factor |
| BCHE | butyrylcholinesterase |
| BCL11A | B-cell CLL/lymphoma 11A |
| BCL11B | B-cell CLL/lymphoma 11B |
| BDNF | brain derived neurotrophic factor |
| BEAN1 | brain expressed associated with NEDD4 1 |
| BEGAIN | brain enriched guanylate kinase associated |
| BEST3 | bestrophin 3 |
| BGN | biglycan |
| BHLHE22 | basic helix-loop-helix family member e22 |
| BHLHE40 | basic helix-loop-helix family member e40 |
| BHLHE40-AS1 | BHLHE40 antisense RNA 1 |
| BICD1 | BICD cargo adaptor 1 |
| BICD2 | BICD cargo adaptor 2 |
| BLM | Bloom syndrome RecQ like helicase |
| BLNK | B-cell linker |
| BMP2K | BMP2 inducible kinase |
| BMP3 | bone morphogenetic protein 3 |
| BMPER | BMP binding endothelial regulator |
| BMS1P21 | BMS1, ribosome biogenesis factor pseudogene 21 |
| BNC2 | basonuclin 2 |
| BOC | BOC cell adhesion associated, oncogene regulated |
| BRINP2 | BMP/retinoic acid inducible neural specific 2 |
| BRINP3 | BMP/retinoic acid inducible neural specific 3 |
| BSG | basigin (Ok blood group) |
| BSN | bassoon presynaptic cytomatrix protein |
| BTAF1 | B-TFIID TATA-box binding protein associated factor 1 |
| BTBD1 | BTB domain containing 1 |
| BTBD11 | BTB domain containing 11 |
| BTBD17 | BTB domain containing 17 |
| BTG1 | BTG anti-proliferation factor 1 |
| BTG2 | BTG anti-proliferation factor 2 |
| BTN1A1 | butyrophilin subfamily 1 member A1 |
| BUB1B | BUB1 mitotic checkpoint serine/threonine kinase B |
| BZW1 | basic leucine zipper and W2 domains 1 |
| C10orf90 | chromosome 10 open reading frame 90 |
| C11orf87 | chromosome 11 open reading frame 87 |
| C12orf49 | chromosome 12 open reading frame 49 |

TABLE 1-continued

Gene symbols and names

| Symbol | Name |
| --- | --- |
| C14orf132 | chromosome 14 open reading frame 132 |
| C14orf37 | chromosome 14 open reading frame 37 |
| C1orf146 | chromosome 1 open reading frame 146 |
| C1orf21 | chromosome 1 open reading frame 21 |
| C1orf61 | chromosome 1 open reading frame 61 |
| C1QA | complement C1q A chain |
| C1QB | complement C1q B chain |
| C1QL1 | complement C1q like 1 |
| C1QL2 | complement C1q like 2 |
| C1QTNF4 | C1q and TNF related 4 |
| C1RL | complement C1r subcomponent like |
| C21orf91 | chromosome 21 open reading frame 91 |
| C2orf27A | chromosome 2 open reading frame 27A |
| C2orf69 | chromosome 2 open reading frame 69 |
| C2orf72 | chromosome 2 open reading frame 72 |
| C2orf73 | chromosome 2 open reading frame 73 |
| C2orf80 | chromosome 2 open reading frame 80 |
| C3 | complement C3 |
| C3orf67 | chromosome 3 open reading frame 67 |
| C4orf22 | chromosome 4 open reading frame 22 |
| C4orf33 | chromosome 4 open reading frame 33 |
| C6orf106 | chromosome 6 open reading frame 106 |
| C6orf163 | chromosome 6 open reading frame 163 |
| C8orf34 | chromosome 8 open reading frame 34 |
| C8orf46 | chromosome 8 open reading frame 46 |
| C9orf135 | chromosome 9 open reading frame 135 |
| C9orf72 | chromosome 9 open reading frame 72 |
| CA12 | carbonic anhydrase 12 |
| CA14 | carbonic anhydrase 14 |
| CA2 | carbonic anhydrase 2 |
| CA4 | carbonic anhydrase 4 |
| CA7 | carbonic anhydrase 7 |
| CA8 | carbonic anhydrase 8 |
| CAB39L | calcium binding protein 39 like |
| CABIN1 | calcineurin binding protein 1 |
| CABLES1 | Cdk5 and Abl enzyme substrate 1 |
| CABP1 | calcium binding protein 1 |
| CACHD1 | cache domain containing 1 |
| CACNA1A | calcium voltage-gated channel subunit alpha1 A |
| CACNA1B | calcium voltage-gated channel subunit alpha1 B |
| CACNA1D | calcium voltage-gated channel subunit alpha1 D |
| CACNA1E | calcium voltage-gated channel subunit alpha1 E |
| CACNA1G | calcium voltage-gated channel subunit alpha1 G |
| CACNA2D1 | calcium voltage-gated channel auxiliary subunit alpha2delta 1 |
| CACNA2D2 | calcium voltage-gated channel auxiliary subunit alpha2delta 2 |
| CACNA2D3 | calcium voltage-gated channel auxiliary subunit alpha2delta 3 |
| CACNB3 | calcium voltage-gated channel auxiliary subunit beta 3 |
| CACNB4 | calcium voltage-gated channel auxiliary subunit beta 4 |
| CACNG3 | calcium voltage-gated channel auxiliary subunit gamma 3 |
| CACNG4 | calcium voltage-gated channel auxiliary subunit gamma 4 |
| CACNG5 | calcium voltage-gated channel auxiliary subunit gamma 5 |
| CACNG8 | calcium voltage-gated channel auxiliary subunit gamma 8 |
| CACYBP | calcyclin binding protein |
| CADM3 | cell adhesion molecule 3 |
| CADPS | calcium dependent secretion activator |
| CADPS2 | calcium dependent secretion activator 2 |
| CALB1 | calbindin 1 |
| CALB2 | calbindin 2 |
| CALCRL | calcitonin receptor like receptor |
| CALHM3 | calcium homeostasis modulator 3 |
| CALN1 | calneuron 1 |
| CALR | calreticulin |
| CALY | calcyon neuron specific vesicular protein |
| CAMK1G | calcium/calmodulin dependent protein kinase IG |
| CAMK2A | calcium/calmodulin dependent protein kinase II alpha |

TABLE 1-continued

Gene symbols and names

| Symbol | Name |
| --- | --- |
| CAMK2G | calcium/calmodulin dependent protein kinase II gamma |
| CAMK4 | calcium/calmodulin dependent protein kinase IV |
| CAMKK2 | calcium/calmodulin dependent protein kinase kinase 2 |
| CAMKV | CaM kinase like vesicle associated |
| CAP2 | cyclase associated actin cytoskeleton regulatory protein 2 |
| CAPN1 | calpain 1 |
| CAPN3 | calpain 3 |
| CAPN5 | calpain 5 |
| CAPN9 | calpain 9 |
| CAPZB | capping actin protein of muscle Z-line beta subunit |
| Car12 | carbonic anhydrase 12 |
| Car14 | carbonic anhydrase 14 |
| Car2 | carbonic anhydrase 2 |
| Car4 | carbonic anhydrase 4 |
| Car7 | carbonic anhydrase 7 |
| Car8 | carbonic anhydrase 8 |
| CARMIL1 | capping protein regulator and myosin 1 linker 1 |
| CARNS1 | carnosine synthase 1 |
| CASP12 | caspase 12 (gene/pseudogene) |
| CASP3 | caspase 3 |
| CASP4 | caspase 4 |
| CASP9 | caspase 9 |
| CASQ2 | calsequestrin 2 |
| CASTOR1 | cytosolic arginine sensor for mTORC1 subunit 1 |
| CASTOR2 | cytosolic arginine sensor for mTORC1 subunit 2 |
| CATSPERG | cation channel sperm associated auxiliary subunit gamma |
| CAV1 | caveolin 1 |
| CAV2 | caveolin 2 |
| CBFA2T3 | CBFA2/RUNX1 translocation partner 3 |
| CBFB | core-binding factor beta subunit |
| CBLB | Cbl proto-oncogene B |
| CBLN1 | cerebellin 1 precursor |
| CBLN2 | cerebellin 2 precursor |
| CBLN3 | cerebellin 3 precursor |
| CBS | cystathionine-beta-synthase |
| CBWD6 | COBW domain containing 6 |
| CCBE1 | collagen and calcium binding EGF domains 1 |
| CCDC13 | coiled-coil domain containing 13 |
| CCDC146 | coiled-coil domain containing 146 |
| CCDC152 | coiled-coil domain containing 152 |
| CCDC155 | coiled-coil domain containing 155 |
| CCDC175 | coiled-coil domain containing 175 |
| CCDC180 | coiled-coil domain containing 180 |
| CCDC61 | coiled-coil domain containing 61 |
| CCDC80 | coiled-coil domain containing 80 |
| CCDC85A | coiled-coil domain containing 85A |
| CCDC88A | coiled-coil domain containing 88A |
| CCK | cholecystokinin |
| CCKBR | cholecystokinin B receptor |
| CCM2L | CCM2 like scaffolding protein |
| CCND1 | cyclin D1 |
| CCND2 | cyclin D2 |
| CCNH | cyclin H |
| CD101 | CD101 molecule |
| CD27 | CD27 molecule |
| CD33 | CD33 molecule |
| CD70 | CD70 molecule |
| CD74 | CD74 molecule |
| CD82 | CD82 molecule |
| CD83 | CD83 molecule |
| CD9 | CD9 molecule |
| CDADC1 | cytidine and dCMP deaminase domain containing 1 |
| CDC14B | cell division cycle 14B |
| CDC42EP1 | CDC42 effector protein 1 |
| CDC42EP3 | CDC42 effector protein 3 |
| CDC42EP4 | CDC42 effector protein 4 |
| CDH1 | cadherin 1 |
| CDH10 | cadherin 10 |
| CDH11 | cadherin 11 |
| CDH13 | cadherin 13 |
| CDH15 | cadherin 15 |
| CDH19 | cadherin 19 |

TABLE 1-continued

Gene symbols and names

| Symbol | Name |
| --- | --- |
| CDH2 | cadherin 2 |
| CDH23 | cadherin related 23 |
| CDH26 | cadherin 26 |
| CDH4 | cadherin 4 |
| CDH7 | cadherin 7 |
| CDH8 | cadherin 8 |
| CDHR1 | cadherin related family member 1 |
| CDK14 | cyclin dependent kinase 14 |
| CDK15 | cyclin dependent kinase 15 |
| CDK16 | cyclin dependent kinase 16 |
| CDK18 | cyclin dependent kinase 18 |
| CDK2 | cyclin dependent kinase 2 |
| CDK5R2 | cyclin dependent kinase 5 regulatory subunit 2 |
| CDK5RAP2 | CDK5 regulatory subunit associated protein 2 |
| CDKL1 | cyclin dependent kinase like 1 |
| CDKN1A | cyclin dependent kinase inhibitor 1A |
| CDO1 | cysteine dioxygenase type 1 |
| CDYL | chromodomain Y like |
| CDYL2 | chromodomain Y like 2 |
| CEBPB | CCAAT/enhancer binding protein beta |
| CEMIP | cell migration inducing hyaluronan binding protein |
| CEP126 | centrosomal protein 126 |
| CEP76 | centrosomal protein 76 |
| CEPT1 | choline/ethanolamine phosphotransferase 1 |
| CERCAM | cerebral endothelial cell adhesion molecule |
| CERKL | ceramide kinase like |
| CERS4 | ceramide synthase 4 |
| CFAP161 | cilia and flagella associated protein 161 |
| CFAP20 | cilia and flagella associated protein 20 |
| CFAP221 | cilia and flagella associated protein 221 |
| CFAP43 | cilia and flagella associated protein 43 |
| CFAP46 | cilia and flagella associated protein 46 |
| CFAP53 | cilia and flagella associated protein 53 |
| CFAP70 | cilia and flagella associated protein 70 |
| CFAP74 | cilia and flagella associated protein 74 |
| CGN | cingulin |
| CGNL1 | cingulin like 1 |
| CHAC1 | ChaC glutathione specific gamma-glutamylcyclotransferase 1 |
| CHD7 | chromodomain helicase DNA binding protein 7 |
| CHDH | choline dehydrogenase |
| CHGB | chromogranin B |
| CHID1 | chitinase domain containing 1 |
| CHL1 | cell adhesion molecule L1 like |
| CHN2 | chimerin 2 |
| CHODL | chondrolectin |
| CHORDC1 | cysteine and histidine rich domain containing 1 |
| CHRD | chordin |
| CHRM1 | cholinergic receptor muscarinic 1 |
| CHRM3 | cholinergic receptor muscarinic 3 |
| CHRNA3 | cholinergic receptor nicotinic alpha 3 subunit |
| CHST1 | carbohydrate sulfotransferase 1 |
| CHST10 | carbohydrate sulfotransferase 10 |
| CHST11 | carbohydrate sulfotransferase 11 |
| CHST12 | carbohydrate sulfotransferase 12 |
| CHST15 | carbohydrate sulfotransferase 15 |
| CHST5 | carbohydrate sulfotransferase 5 |
| CHST8 | carbohydrate sulfotransferase 8 |
| CHST9 | carbohydrate sulfotransferase 9 |
| CHSY1 | chondroitin sulfate synthase 1 |
| CHSY3 | chondroitin sulfate synthase 3 |
| CHTF18 | chromosome transmission fidelity factor 18 |
| CIPC | CLOCK interacting pacemaker |
| CIT | citron rho-interacting serine/threonine kinase |
| CKMT1B | creatine kinase, mitochondrial 1B |
| CLASRP | CLK4 associating serine/arginine rich protein |
| CLCN1 | chloride voltage-gated channel 1 |
| CLCN3 | chloride voltage-gated channel 3 |
| CLCN5 | chloride voltage-gated channel 5 |
| CLDN1 | claudin 1 |
| CLDN11 | claudin 11 |
| CLEC2L | C-type lectin domain family 2 member L |
| CLEC7A | C-type lectin domain containing 7A |
| CLIC5 | chloride intracellular channel 5 |
| CLIC6 | chloride intracellular channel 6 |
| CLK1 | CDC like kinase 1 |

TABLE 1-continued

Gene symbols and names

| Symbol | Name |
| --- | --- |
| CLMN | calmin |
| CLMP | CXADR like membrane protein |
| CLSTN2 | calsyntenin 2 |
| CLSTN3 | calsyntenin 3 |
| CLVS2 | clavesin 2 |
| CMTM5 | CKLF like MARVEL transmembrane domain containing 5 |
| CMTM8 | CKLF like MARVEL transmembrane domain containing 8 |
| CNDP1 | camosine dipeptidase 1 |
| CNIH3 | cornichon family AMPA receptor auxiliary protein 3 |
| CNKSR3 | CNKSR family member 3 |
| CNMD | chondromodulin |
| CNP | 2',3'-cyclic nucleotide 3' phosphodiesterase |
| CNPY1 | canopy FGF signaling regulator 1 |
| CNR1 | cannabinoid receptor 1 |
| CNTFR | ciliary neurotrophic factor receptor |
| CNTN2 | contactin 2 |
| CNTN3 | contactin 3 |
| CNTN4 | contactin 4 |
| CNTN5 | contactin 5 |
| CNTNAP4 | contactin associated protein like 4 |
| CNTNAP5 | contactin associated protein like 5 |
| Cntnap5a | contactin associated protein-like 5A |
| COBL | cordon-bleu WH2 repeat protein |
| COL11A1 | collagen type XI alpha 1 chain |
| COL11A2 | collagen type XI alpha 2 chain |
| COL12A1 | collagen type XII alpha 1 chain |
| COL13A1 | collagen type XIII alpha 1 chain |
| COL15A1 | collagen type XV alpha 1 chain |
| COL18A1 | collagen type XVIII alpha 1 chain |
| COL1A1 | collagen type I alpha 1 chain |
| COL1A2 | collagen type I alpha 2 chain |
| COL20A1 | collagen type XX alpha 1 chain |
| COL22A1 | collagen type XXII alpha 1 chain |
| COL23A1 | collagen type XXIII alpha 1 chain |
| COL25A1 | collagen type XXV alpha 1 chain |
| COL4A1 | collagen type IV alpha 1 chain |
| COL4A5 | collagen type IV alpha 5 chain |
| COL5A1 | collagen type V alpha 1 chain |
| COL5A3 | collagen type V alpha 3 chain |
| COL6A1 | collagen type VI alpha 1 chain |
| COL9A1 | collagen type IX alpha 1 chain |
| COLEC12 | collectin subfamily member 12 |
| COLGALT2 | collagen beta(1-O)galactosyltransferase 2 |
| COQ10B | coenzyme Q10B |
| CORIN | corin, serine peptidase |
| CORO1C | coronin 1C |
| CORO2A | coronin 2A |
| CORO2B | coronin 2B |
| CORO6 | coronin 6 |
| COTL1 | coactosin like F-actin binding protein 1 |
| COX6B2 | cytochrome c oxidase subunit 6B2 |
| CPE | carboxypeptidase E |
| CPLX2 | complexin 2 |
| CPLX3 | complexin 3 |
| CPM | carboxypeptidase M |
| CPNE4 | copine 4 |
| CPNE7 | copine 7 |
| CPNE8 | copine 8 |
| CPNE9 | copine family member 9 |
| CPVL | carboxypeptidase, vitellogenic like |
| CREB3L1 | cAMP responsive element binding protein 3 like 1 |
| CREB3L2 | cAMP responsive element binding protein 3 like 2 |
| CRIM1 | cysteine rich transmembrane BMP regulator 1 |
| CRIPT | CXXC repeat containing interactor of PDZ3 domain |
| CRISPLD1 | cysteine rich secretory protein LCCL domain containing 1 |
| CRISPLD2 | cysteine rich secretory protein LCCL domain containing 2 |
| CRLF1 | cytokine receptor like factor 1 |
| CRTAC1 | cartilage acidic protein 1 |
| CRY1 | cryptochrome circadian regulator 1 |
| CRYAB | crystallin alpha B |
| CRYBA2 | crystallin beta A2 |
| CRYBG3 | crystallin beta-gamma domain containing 3 |

TABLE 1-continued

Gene symbols and names

| Symbol | Name |
| --- | --- |
| CRYL1 | crystallin lambda 1 |
| CRYM | crystallin mu |
| CRYM-AS1 | CRYM antisense RNA 1 |
| CSF1R | colony stimulating factor 1 receptor |
| CSMD1 | CUB and Sushi multiple domains 1 |
| CSMD2 | CUB and Sushi multiple domains 2 |
| CSPG4 | chondroitin sulfate proteoglycan 4 |
| CSPG5 | chondroitin sulfate proteoglycan 5 |
| CSRNP1 | cysteine and serine rich nuclear protein 1 |
| CSRNP3 | cysteine and serine rich nuclear protein 3 |
| CSRP1 | cysteine and glycine rich protein 1 |
| CSTA | cystatin A |
| Csta1 | cystatin A1 |
| CSTF2T | cleavage stimulation factor subunit 2 tau variant |
| CTH | cystathionine gamma-lyase |
| CTNNA3 | catenin alpha 3 |
| CTSL | cathepsin L |
| CTSS | cathepsin S |
| CTTNBP2 | cortactin binding protein 2 |
| CTXN1 | cortexin 1 |
| CTXN3 | cortexin 3 |
| CUL7 | cullin 7 |
| CX3CL1 | C-X3-C motif chemokine ligand 1 |
| CX3CR1 | C-X3-C motif chemokine receptor 1 |
| CXCL12 | C-X-C motif chemokine ligand 12 |
| CXCL14 | C-X-C motif chemokine ligand 14 |
| CXCL5 | C-X-C motif chemokine ligand 5 |
| CXCR4 | C-X-C motif chemokine receptor 4 |
| CXorf36 | chromosome X open reading frame 36 |
| CXXC4 | CXXC finger protein 4 |
| CYB5A | cytochrome b5 type A |
| CYCS | cytochrome c, somatic |
| CYFIP2 | cytoplasmic FMR1 interacting protein 2 |
| CYGB | cytoglobin |
| CYP27A1 | cytochrome P450 family 27 subfamily A member 1 |
| CYP2D6 | cytochrome P450 family 2 subfamily D member 6 |
| CYP2J2 | cytochrome P450 family 2 subfamily J member 2 |
| Cyp2j9 | cytochrome P450, family 2, subfamily j, polypeptide 9 |
| CYP7B1 | cytochrome P450 family 7 subfamily B member 1 |
| CYR61 | cysteine rich angiogenic inducer 61 |
| CYSTM1 | cysteine rich transmembrane module containing 1 |
| CYYR1 | cysteine and tyrosine rich 1 |
| D430019H16Rik | RIKEN cDNA D430019H16 gene |
| D430041D05Rik | RIKEN cDNA D430041D05 gene |
| D430042O09Rik | RIKEN cDNA D430042O09 gene |
| D630003M21Rik | RIKEN cDNA D630003M21 gene |
| D7Ertd443e | DNA segment, Chr 7, ERATO Doi 443, expressed |
| DAB1 | DAB1, reelin adaptor protein |
| DACH1 | dachshund family transcription factor 1 |
| DACT2 | dishevelled binding antagonist of beta catenin 2 |
| DAGLA | diacylglycerol lipase alpha |
| DAO | D-amino acid oxidase |
| DAPK1 | death associated protein kinase 1 |
| DAPK2 | death associated protein kinase 2 |
| DBH | dopamine beta-hydroxylase |
| DCBLD1 | discoidin, CUB and LCCL domain containing 1 |
| DCC | DCC netrin 1 receptor |
| DCLK1 | doublecortin like kinase 1 |
| DCUN1D3 | defective in cullin neddylation 1 domain containing 3 |
| DCX | doublecortin |
| DDHD1 | DDHD domain containing 1 |
| DDIT3 | DNA damage inducible transcript 3 |
| DDIT4 | DNA damage inducible transcript 4 |
| DDIT4L | DNA damage inducible transcript 4 like |
| DDN | dendrin |
| DDO | D-aspartate oxidase |
| DDR2 | discoidin domain receptor tyrosine kinase 2 |
| DDX3Y | DEAD-box helicase 3, Y-linked |
| DDX49 | DEAD-box helicase 49 |
| DEDD2 | death effector domain containing 2 |
| DEPDC1B | DEP domain containing 1B |
| DEPDC7 | DEP domain containing 7 |
| DES | desmin |
| DGCR5 | DiGeorge syndrome critical region gene 5 (non-protein coding) |

TABLE 1-continued

Gene symbols and names

| Symbol | Name |
| --- | --- |
| DGKA | diacylglycerol kinase alpha |
| DGKB | diacylglycerol kinase beta |
| DGKH | diacylglycerol kinase eta |
| DGKI | diacylglycerol kinase iota |
| DHDDS | dehydrodolichyl diphosphate synthase subunit |
| DHFR | dihydrofolate reductase |
| DIRAS2 | DIRAS family GTPase 2 |
| DISP2 | dispatched RND transporter family member 2 |
| DISP3 | dispatched RND transporter family member 3 |
| DIXDC1 | DIX domain containing 1 |
| DKK4 | dickkopf WNT signaling pathway inhibitor 4 |
| DLC1 | DLC1 Rho GTPase activating protein |
| DLG1 | discs large MAGUK scaffold protein 1 |
| DLG4 | discs large MAGUK scaffold protein 4 |
| DLGAP2 | DLG associated protein 2 |
| DLGAP4 | DLG associated protein 4 |
| Dlx4os | distal-less homeobox 4, opposite strand |
| Dlx6os1 | distal-less homeobox 6, opposite strand 1 |
| DMD | dystrophin |
| DMGDH | dimethylglycine dehydrogenase |
| DMP1 | dentin matrix acidic phosphoprotein 1 |
| DNAH5 | dynein axonemal heavy chain 5 |
| DNAH6 | dynein axonemal heavy chain 6 |
| DNAJA1 | DnaJ heat shock protein family (Hsp40) member A1 |
| DNAJA4 | DnaJ heat shock protein family (Hsp40) member A4 |
| DNAJB1 | DnaJ heat shock protein family (Hsp40) member B1 |
| DNAJB4 | DnaJ heat shock protein family (Hsp40) member B4 |
| DNAJB5 | DnaJ heat shock protein family (Hsp40) member B5 |
| DNAJB6 | DnaJ heat shock protein family (Hsp40) member B6 |
| DNAJC27 | DnaJ heat shock protein family (Hsp40) member C27 |
| DNAJC7 | DnaJ heat shock protein family (Hsp40) member C7 |
| DNER | delta/notch like EGF repeat containing |
| DNMBP | dynamin binding protein |
| DOC2B | double C2 domain beta |
| DOCK1 | dedicator of cytokinesis 1 |
| DOCK5 | dedicator of cytokinesis 5 |
| DOCK6 | dedicator of cytokinesis 6 |
| DOCK7 | dedicator of cytokinesis 7 |
| DOCK8 | dedicator of cytokinesis 8 |
| DOK6 | docking protein 6 |
| DOPEY2 | dopey family member 2 |
| DPF3 | double PHD fingers 3 |
| DPP10 | dipeptidyl peptidase like 10 |
| DPY19L1 | dpy-19 like C-mannosyltransferase 1 |
| DPY19L2 | dpy-19 like 2 |
| DPY19L4 | dpy-19 like 4 |
| DPYD | dihydropyrimidine dehydrogenase |
| DPYSL3 | dihydropyrimidinase like 3 |
| DPYSL4 | dihydropyrimidinase like 4 |
| DRD1 | dopamine receptor D1 |
| DRD2 | dopamine receptor D2 |
| DSCAML1 | DS cell adhesion molecule like 1 |
| DTX4 | deltex E3 ubiquitin ligase 4 |
| DUS3L | dihydrouridine synthase 3 like |
| DUSP1 | dual specificity phosphatase 1 |
| DUSP16 | dual specificity phosphatase 16 |
| DUSP22 | dual specificity phosphatase 22 |
| DUSP26 | dual specificity phosphatase 26 |
| DUSP5 | dual specificity phosphatase 5 |
| DYNLT3 | dynein light chain Tctex-type 3 |
| DYRK1B | dual specificity tyrosine phosphorylation regulated kinase 1B |
| DYRK4 | dual specificity tyrosine phosphorylation regulated kinase 4 |
| DYSF | dysferlin |
| DZANK1 | double zinc ribbon and ankyrin repeat domains 1 |
| DZIP1L | DAZ interacting zinc finger protein 1 like |
| E2F3 | E2F transcription factor 3 |
| EBF1 | early B-cell factor 1 |
| EBF2 | early B-cell factor 2 |
| EBF3 | early B-cell factor 3 |
| EBF4 | early B-cell factor 4 |
| ECD | ecdysoneless cell cycle regulator |
| ECE1 | endothelin converting enzyme 1 |
| ECHDC2 | enoyl-CoA hydratase domain containing 2 |

TABLE 1-continued

Gene symbols and names

| Symbol | Name |
| --- | --- |
| EDEM1 | ER degradation enhancing alpha-mannosidase like protein 1 |
| EDIL3 | EGF like repeats and discoidin domains 3 |
| EDNRB | endothelin receptor type B |
| EFEMP1 | EGF containing fibulin like extracellular matrix protein 1 |
| EFHC2 | EF-hand domain containing 2 |
| EFHD1 | EF-hand domain family member D1 |
| EFHD2 | EF-hand domain family member D2 |
| EFNA5 | ephrin A5 |
| EFNB3 | ephrin B3 |
| EFR3B | EFR3 homolog B |
| EGF | epidermal growth factor |
| EGFR | epidermal growth factor receptor |
| EGLN3 | egl-9 family hypoxia inducible factor 3 |
| EGR1 | early growth response 1 |
| EGR3 | early growth response 3 |
| EHD3 | EH domain containing 3 |
| EIF2AK3 | eukaryotic translation initiation factor 2 alpha kinase 3 |
| EIF2S3 | eukaryotic translation initiation factor 2 subunit gamma |
| Eif2s3y | eukaryotic translation initiation factor 2, subunit 3, structural gene Y-linked |
| EIF4A3 | eukaryotic translation initiation factor 4A3 |
| ELAVL2 | ELAV like RNA binding protein 2 |
| ELAVL3 | ELAV like RNA binding protein 3 |
| ELAVL4 | ELAV like RNA binding protein 4 |
| ELF2 | E74 like ETS transcription factor 2 |
| ELFN1 | extracellular leucine rich repeat and fibronectin type III domain containing 1 |
| ELMO1 | engulfment and cell motility 1 |
| ELMO2 | engulfment and cell motility 2 |
| ELMOD1 | ELMO domain containing 1 |
| ELN | elastin |
| ELOVL1 | ELOVL fatty acid elongase 1 |
| ELOVL2 | ELOVL fatty acid elongase 2 |
| ELOVL5 | ELOVL fatty acid elongase 5 |
| ELOVL7 | ELOVL fatty acid elongase 7 |
| ELP1 | elongator complex protein 1 |
| EME2 | essential meiotic structure-specific endonuclease subunit 2 |
| EMILIN2 | elastin microfibril interfacer 2 |
| EML5 | echinoderm microtubule associated protein like 5 |
| EMP2 | epithelial membrane protein 2 |
| EN2 | engrailed homeobox 2 |
| ENAH | ENAH, actin regulator |
| ENC1 | ectodermal-neural cortex 1 |
| ENOX1 | ecto-NOX disulfide-thiol exchanger 1 |
| ENPP1 | ectonucleotide pyrophosphatase/phosphodiesterase 1 |
| ENPP2 | ectonucleotide pyrophosphatase/phosphodiesterase 2 |
| ENPP4 | ectonucleotide pyrophosphatase/phosphodiesterase 4 |
| ENPP6 | ectonucleotide pyrophosphatase/phosphodiesterase 6 |
| ENTPD2 | ectonucleoside triphosphate diphosphohydrolase 2 |
| EPB41L1 | erythrocyte membrane protein band 4.1 like 1 |
| EPB41L4B | erythrocyte membrane protein band 4.1 like 4B |
| EPHA3 | EPH receptor A3 |
| EPHA4 | EPH receptor A4 |
| EPHA6 | EPH receptor A6 |
| EPHB1 | EPH receptor B1 |
| EPHB4 | EPH receptor B4 |
| EPN1 | epsin 1 |
| EPS15 | epidermal growth factor receptor pathway substrate 15 |
| ERBB3 | erb-b2 receptor tyrosine kinase 3 |
| ERBB4 | erb-b2 receptor tyrosine kinase 4 |
| ERBIN | erbb2 interacting protein |
| ERC2 | ELKS/RAB6-interacting/CAST family member 2 |
| ERG28 | ergosterol biosynthesis 28 homolog |
| ERGIC1 | endoplasmic reticulum-golgi intermediate compartment 1 |
| ERICH5 | glutamate rich 5 |
| ERMN | ermin |
| ERRFI1 | ERBB receptor feedback inhibitor 1 |
| ESRRB | estrogen related receptor beta |

TABLE 1-continued

Gene symbols and names

| Symbol | Name |
|--------|------|
| ESRRG | estrogen related receptor gamma |
| ESYT2 | extended synaptotagmin 2 |
| EIF1 | eukaryotic translation termination factor 1 |
| Etl4 | enhancer trap locus 4 |
| ETNPPL | ethanolamine-phosphate phospho-lyase |
| ETS1 | ETS proto-oncogene 1, transcription factor |
| ETV1 | ETS variant 1 |
| ETV3 | ETS variant 3 |
| ETV4 | ETS variant 4 |
| ETV5 | ETS variant 5 |
| EVA1A | eva-1 homolog A, regulator of programmed cell death |
| EVF2_5P | N/A |
| EXOSC4 | exosome component 4 |
| EXPH5 | exophilin 5 |
| EXTL2 | exostosin like glycosyltransferase 2 |
| EYA1 | EYA transcriptional coactivator and phosphatase 1 |
| EYS | eyes shut homolog (*Drosophila*) |
| F3 | coagulation factor III, tissue factor |
| FA2H | fatty acid 2-hydroxylase |
| FAM102A | family with sequence similarity 102 member A |
| FAM102B | family with sequence similarity 102 member B |
| FAM107A | family with sequence similarity 107 member A |
| FAM107B | family with sequence similarity 107 member B |
| FAM114A1 | family with sequence similarity 114 member A1 |
| FAM117A | family with sequence similarity 117 member A |
| FAM122C | family with sequence similarity 122C |
| FAM124A | family with sequence similarity 124 member A |
| FAM131A | family with sequence similarity 131 member A |
| FAM135B | family with sequence similarity 135 member B |
| FAM167A | family with sequence similarity 167 member A |
| FAM171B | family with sequence similarity 171 member B |
| FAM196A | family with sequence similarity 196 member A |
| FAM198B | family with sequence similarity 198 member B |
| FAM19A1 | family with sequence similarity 19 member A1, C-C motif chemokine like |
| FAM19A4 | family with sequence similarity 19 member A4, C-C motif chemokine like |
| FAM20A | FAM20A, golgi associated secretory pathway pseudokinase |
| FAM212B | family with sequence similarity 212 member B |
| FAM222B | family with sequence similarity 222 member B |
| FAM43A | family with sequence similarity 43 member A |
| FAM46A | family with sequence similarity 46 member A |
| FAM46C | family with sequence similarity 46 member C |
| FAM49B | family with sequence similarity 49 member B |
| FAM53A | family with sequence similarity 53 member A |
| FAM69A | family with sequence similarity 69 member A |
| FAM83D | family with sequence similarity 83 member D |
| FAM84A | family with sequence similarity 84 member A |
| FAM89A | family with sequence similarity 89 member A |
| FAM8A4P | family with sequence similarity 8 member A4, pseudogene |
| FAM92B | family with sequence similarity 92 member B |
| FAR2 | fatty acyl-CoA reductase 2 |
| FARP1 | FERM, ARH/RhoGEF and pleckstrin domain protein 1 |
| FAT1 | FAT atypical cadherin 1 |
| FAT2 | FAT atypical cadherin 2 |
| FAT3 | FAT atypical cadherin 3 |
| FBLN2 | fibulin 2 |
| FBN1 | fibrillin 1 |
| FBN2 | fibrillin 2 |
| FBXL21 | F-box and leucine rich repeat protein 21 (gene/pseudogene) |
| FBXO24 | F-box protein 24 |
| FBXO32 | F-box protein 32 |
| FBXW5 | F-box and WD repeat domain containing 5 |
| FBXW9 | F-box and WD repeat domain containing 9 |
| FCER2 | Fc fragment of IgE receptor II |
| FCHSD2 | FCH and double SH3 domains 2 |
| FDFT1 | farnesyl-diphospate farnesyltransferase 1 |
| FEM1C | fem-1 homolog C |
| FERMT1 | fermitin family member 1 |
| FEZF2 | FEZ family zinc finger 2 |
| FGD3 | FYVE, RhoGEF and PH domain containing 3 |

TABLE 1-continued

Gene symbols and names

| Symbol | Name |
|--------|------|
| FGD4 | FYVE, RhoGEF and PH domain containing 4 |
| FGD6 | FYVE, RhoGEF and PH domain containing 6 |
| FGF13 | fibroblast growth factor 13 |
| FGF3 | fibroblast growth factor 3 |
| FGF5 | fibroblast growth factor 5 |
| FGFBP3 | fibroblast growth factor binding protein 3 |
| FGFR1 | fibroblast growth factor receptor 1 |
| FGFR2 | fibroblast growth factor receptor 2 |
| FGFR3 | fibroblast growth factor receptor 3 |
| FGGY | FGGY carbohydrate kinase domain containing |
| FHDC1 | FH2 domain containing 1 |
| FHL3 | four and a half LIM domains 3 |
| FHL5 | four and a half LIM domains 5 |
| FHOD3 | formin homology 2 domain containing 3 |
| FIBIN | fin bud initiation factor homolog (zebrafish) |
| FIGN | fidgetin, microtubule severing factor |
| FILIP1L | filamin A interacting protein 1 like |
| FJX1 | four jointed box 1 |
| FKBP4 | FK506 binding protein 4 |
| FKBP5 | FK506 binding protein 5 |
| FLI1 | Fli-1 proto-oncogene, ETS transcription factor |
| FLNB | filamin B |
| FLRT2 | fibronectin leucine rich transmembrane protein 2 |
| FLT3 | fms related tyrosine kinase 3 |
| FMNL1 | formin like 1 |
| FMNL3 | formin like 3 |
| FMO3 | flavin containing monooxygenase 3 |
| FNDC3B | fibronectin type III domain containing 3B |
| FOLH1 | folate hydrolase 1 |
| FOS | Fos proto-oncogene, AP-1 transcription factor subunit |
| FOSB | FosB proto-oncogene, AP-1 transcription factor subunit |
| FOSL2 | FOS like 2, AP-1 transcription factor subunit |
| FOXA1 | forkhead box A1 |
| FOXA2 | forkhead box A2 |
| FOXG1 | forkhead box G1 |
| FOXH1 | forkhead box H1 |
| FOXP4 | forkhead box P4 |
| FRAS1 | Fraser extracellular matrix complex subunit 1 |
| FREM1 | FRAS1 related extracellular matrix 1 |
| FRMD1 | FERM domain containing 1 |
| FRMD3 | FERM domain containing 3 |
| FRMD4A | FERM domain containing 4A |
| FRMD4B | FERM domain containing 4B |
| FRMPD1 | FERM and PDZ domain containing 1 |
| FRMPD2 | FERM and PDZ domain containing 2 |
| FRMPD4 | FERM and PDZ domain containing 4 |
| FRRS1 | ferric chelate reductase 1 |
| FRRS1L | ferric chelate reductase 1 like |
| FRY | FRY microtubule binding protein |
| FSD2 | fibronectin type III and SPRY domain containing 2 |
| FSIP2 | fibrous sheath interacting protein 2 |
| FSTL4 | follistatin like 4 |
| FSTL5 | follistatin like 5 |
| FTH1 | ferritin heavy chain 1 |
| FTL | ferritin light chain |
| FXYD1 | FXYD domain containing ion transport regulator 1 |
| FXYD7 | FXYD domain containing ion transport regulator 7 |
| FZD7 | frizzled class receptor 7 |
| FZD8 | frizzled class receptor 8 |
| FZD9 | frizzled class receptor 9 |
| FZR1 | fizzy and cell division cycle 20 related 1 |
| GAB1 | GRB2 associated binding protein 1 |
| GAB2 | GRB2 associated binding protein 2 |
| GABARAPL1 | GABA type A receptor associated protein like 1 |
| GABBR1 | gamma-aminobutyric acid type B receptor subunit 1 |
| GABBR2 | gamma-aminobutyric acid type B receptor subunit 2 |
| GABRA2 | gamma-aminobutyric acid type A receptor alpha2 subunit |
| GABRA4 | gamma-aminobutyric acid type A receptor alpha4 subunit |
| GABRA6 | gamma-aminobutyric acid type A receptor alpha6 subunit |
| GABRB1 | gamma-aminobutyric acid type A receptor beta1 subunit |

TABLE 1-continued

Gene symbols and names

| Symbol | Name |
| --- | --- |
| GABRD | gamma-aminobutyric acid type A receptor delta subunit |
| GABRG2 | gamma-aminobutyric acid type A receptor gamma2 subunit |
| GABRG3 | gamma-aminobutyric acid type A receptor gamma3 subunit |
| GACAT2 | gastric cancer associated transcript 2 (non-protein coding) |
| GAD | N/A |
| Gad1 | glutamate decarboxylase 1 |
| GAD2 | glutamate decarboxylase 2 |
| GADD45A | growth arrest and DNA damage inducible alpha |
| GAL3ST1 | galactose-3-O-sulfotransferase 1 |
| GAL3ST4 | galactose-3-O-sulfotransferase 4 |
| GALNT14 | polypeptide N-acetylgalactosaminyltransferase 14 |
| GALNT15 | polypeptide N-acetylgalactosaminyltransferase 15 |
| GALNT16 | polypeptide N-acetylgalactosaminyltransferase 16 |
| GALNT17 | polypeptide N-acetylgalactosaminyltransferase 17 |
| GALNT18 | polypeptide N-acetylgalactosaminyltransferase 18 |
| GALNT3 | polypeptide N-acetylgalactosaminyltransferase 3 |
| GALNT5 | polypeptide N-acetylgalactosaminyltransferase 5 |
| GALNT6 | polypeptide N-acetylgalactosaminyltransferase 6 |
| GALNTL6 | polypeptide N-acetylgalactosaminyltransferase like 6 |
| GALR1 | galanin receptor 1 |
| GAP43 | growth associated protein 43 |
| GAPDH | glyceraldehyde-3-phosphate dehydrogenase |
| GAREM2 | GRB2 associated regulator of MAPK1 subtype 2 |
| GARNL3 | GTPase activating Rap/RanGAP domain like 3 |
| GAS1 | growth arrest specific 1 |
| GATM | glycine amidinotransferase |
| Gatsl2 | GATS protein-like 2 |
| GBAP1 | glucosylceramidase beta pseudogene 1 |
| GCA | grancalcin |
| GCH1 | GTP cyclohydrolase 1 |
| GCK | glucokinase |
| GDA | guanine deaminase |
| GDF10 | growth differentiation factor 10 |
| GDF11 | growth differentiation factor 11 |
| GDPD4 | glycerophosphodiester phosphodiesterase domain containing 4 |
| GDPD5 | glycerophosphodiester phosphodiesterase domain containing 5 |
| GEM | GTP binding protein overexpressed in skeletal muscle |
| GFAP | glial fibrillary acidic protein |
| GFRA2 | GDNF family receptor alpha 2 |
| GHITM | growth hormone inducible transmembrane protein |
| GHR | growth hormone receptor |
| GIPC2 | GIPC PDZ domain containing family member 2 |
| GIPR | gastric inhibitory polypeptide receptor |
| GJA1 | gap junction protein alpha 1 |
| GJB1 | gap junction protein beta 1 |
| GJB4 | gap junction protein beta 4 |
| GJB6 | gap junction protein beta 6 |
| GJC2 | gap junction protein gamma 2 |
| GJC3 | gap junction protein gamma 3 |
| GJD2 | gap junction protein delta 2 |
| GLB1L3 | galactosidase beta 1 like 3 |
| GLDC | glycine decarboxylase |
| GLDN | gliomedin |
| GLI1 | GLI family zinc finger 1 |
| GLI2 | GLI family zinc finger 2 |
| GLI3 | GLI family zinc finger 3 |
| GLIPR1 | GLI pathogenesis related 1 |
| GLIPR2 | GLI pathogenesis related 2 |
| GLIS1 | GLIS family zinc finger 1 |
| GLIS3 | GLIS family zinc finger 3 |
| GLP2R | glucagon like peptide 2 receptor |
| GLRA1 | glycine receptor alpha 1 |
| GLUD1 | glutamate dehydrogenase 1 |
| GLUL | glutamate-ammonia ligase |
| Gm11549 | predicted gene 11549 |
| Gm136 | predicted gene 136 |
| Gm20425 | predicted gene 20425 |
| Gm266 | predicted gene 266 |
| Gm28653 | predicted gene 28653 |

TABLE 1-continued

Gene symbols and names

| Symbol | Name |
| --- | --- |
| Gm5083 | predicted gene 5083 |
| Gm5089 | predicted gene 5089 |
| Gm5468 | predicted gene 5468 |
| Gm8179 | N/A |
| GNA12 | G protein subunit alpha 12 |
| GNAL | G protein subunit alpha L |
| GNAO1 | G protein subunit alpha o1 |
| GNB3 | G protein subunit beta 3 |
| GNG11 | G protein subunit gamma 11 |
| GNG12 | G protein subunit gamma 12 |
| GNG13 | G protein subunit gamma 13 |
| GNG2 | G protein subunit gamma 2 |
| GNL3 | G protein nucleolar 3 |
| GOLGA7B | golgin A7 family member B |
| GOT1 | glutamic-oxaloacetic transaminase 1 |
| GPATCH4 | G-patch domain containing 4 |
| GPC2 | glypican 2 |
| GPC6 | glypican 6 |
| GPCPD1 | glycerophosphocholine phosphodiesterase 1 |
| GPHN | gephyrin |
| GPNMB | glycoprotein nmb |
| GPR107 | G protein-coupled receptor 107 |
| GPR135 | G protein-coupled receptor 135 |
| GPR153 | G protein-coupled receptor 153 |
| GPR161 | G protein-coupled receptor 161 |
| GPR22 | G protein-coupled receptor 22 |
| GPR34 | G protein-coupled receptor 34 |
| GPR37 | G protein-coupled receptor 37 |
| GPR37L1 | G protein-coupled receptor 37 like 1 |
| GPR63 | G protein-coupled receptor 63 |
| GPR84 | G protein-coupled receptor 84 |
| GPRASP2 | G protein-coupled receptor associated sorting protein 2 |
| GPRC5C | G protein-coupled receptor class C group 5 member C |
| GPSM2 | G protein signaling modulator 2 |
| GPX2 | glutathione peroxidase 2 |
| GRAMD2B | GRAM domain containing 2B |
| Gramd3 | GRAM domain containing 3 |
| GRAMD4 | GRAM domain containing 4 |
| GRB10 | growth factor receptor bound protein 10 |
| GRB14 | growth factor receptor bound protein 14 |
| GRB7 | growth factor receptor bound protein 7 |
| GREB1 | growth regulation by estrogen in breast cancer 1 |
| GREB1L | growth regulation by estrogen in breast cancer 1 like |
| GRHL1 | grainy head like transcription factor 1 |
| GRIA1 | glutamate ionotropic receptor AMPA type subunit 1 |
| GRIA3 | glutamate ionotropic receptor AMPA type subunit 3 |
| GRID1 | glutamate ionotropic receptor delta type subunit 1 |
| GRID2 | glutamate ionotropic receptor delta type subunit 2 |
| GRID2IP | Grid2 interacting protein |
| GRIK1 | glutamate ionotropic receptor kainate type subunit 1 |
| GRIK2 | glutamate ionotropic receptor kainate type subunit 2 |
| GRIK3 | glutamate ionotropic receptor kainate type subunit 3 |
| GRIN2A | glutamate ionotropic receptor NMDA type subunit 2A |
| GRIN2B | glutamate ionotropic receptor NMDA type subunit 2B |
| GRIN2C | glutamate ionotropic receptor NMDA type subunit 2C |
| GRIN2D | glutamate ionotropic receptor NMDA type subunit 2D |
| GRIP1 | glutamate receptor interacting protein 1 |
| GRK3 | G protein-coupled receptor kinase 3 |
| GRK4 | G protein-coupled receptor kinase 4 |
| GRK5 | G protein-coupled receptor kinase 5 |
| GRM1 | glutamate metabotropic receptor 1 |
| GRM4 | glutamate metabotropic receptor 4 |
| GRM5 | glutamate metabotropic receptor 5 |
| GRM7 | glutamate metabotropic receptor 7 |
| GRM8 | glutamate metabotropic receptor 8 |
| GSAP | gamma-secretase activating protein |
| GSDME | gasdermin E |
| GSN | gelsolin |
| GSTM1 | glutathione S-transferase mu 1 |
| GSTO2 | glutathione S-transferase omega 2 |

TABLE 1-continued

Gene symbols and names

| Symbol | Name |
|---|---|
| GSX1 | GS homeobox 1 |
| GTF2A1L | general transcription factor IIA subunit 1 like |
| GTF2B | general transcription factor IIB |
| GTPBP2 | GTP binding protein 2 |
| GTSCR1 | Gilles de la Tourette syndrome chromosome region, candidate 1 |
| GUCY1A3 | guanylate cyclase 1 soluble subunit alpha |
| GYG2 | glycogenin 2 |
| GYG2P1 | glycogenin 2 pseudogene 1 |
| GYS1 | glycogen synthase 1 |
| GZF1 | GDNF inducible zinc finger protein 1 |
| HAMP | hepcidin antimicrobial peptide |
| HAPLN2 | hyaluronan and proteoglycan link protein 2 |
| HAS2 | hyaluronan synthase 2 |
| HCN1 | hyperpolarization activated cyclic nucleotide gated potassium channel 1 |
| HCN2 | hyperpolarization activated cyclic nucleotide gated potassium and sodium channel 2 |
| HCN4 | hyperpolarization activated cyclic nucleotide gated potassium channel 4 |
| HDAC8 | histone deacetylase 8 |
| HDHD2 | haloacid dehalogenase like hydrolase domain containing 2 |
| HEBP1 | heme binding protein 1 |
| HECA | hdc homolog, cell cycle regulator |
| HECTD2-AS1 | N/A |
| HECW1 | HECT, C2 and WW domain containing E3 ubiquitin protein ligase 1 |
| HEG1 | heart development protein with EGF like domains 1 |
| HEPACAM | hepatic and glial cell adhesion molecule |
| HERPUD1 | homocysteine inducible ER protein with ubiquitin like domain 1 |
| HES1 | hes family bHLH transcription factor 1 |
| HES3 | hes family bHLH transcription factor 3 |
| HEY2 | hes related family bHLH transcription factor with YRPW motif 2 |
| HGF | hepatocyte growth factor |
| HHATL | hedgehog acyltransferase like |
| HHIP | hedgehog interacting protein |
| HIF3A | hypoxia inducible factor 3 alpha subunit |
| HIGD1A | HIG1 hypoxia inducible domain family member 1A |
| HIP1 | huntingtin interacting protein 1 |
| HIP1R | huntingtin interacting protein 1 related |
| HIPK4 | homeodomain interacting protein kinase 4 |
| HIST1H2BD | histone cluster 1 H2B family member d |
| HIST2H2BA | histone cluster 2 H2B family member a (pseudogene) |
| HIST2H2BE | histone cluster 2 H2B family member e |
| HIST2H2BF | histone cluster 2 H2B family member f |
| HK2 | hexokinase 2 |
| HMCES | 5-hydroxymethylcytosine binding, ES cell specific |
| HMGCLL1 | 3-hydroxymethyl-3-methylglutaryl-CoA lyase like 1 |
| HMGCR | 3-hydroxy-3-methylglutaryl-CoA reductase |
| HMGCS1 | 3-hydroxy-3-methylglutaryl-CoA synthase 1 |
| HMGN1 | high mobility group nucleosome binding domain 1 |
| HOMER1 | homer scaffolding protein 1 |
| HOMER3 | homer scaffolding protein 3 |
| HOXD1 | homeobox D1 |
| HPCAL1 | hippocalcin like 1 |
| HPCAL4 | hippocalcin like 4 |
| HPN | hepsin |
| HPSE2 | heparanase 2 (inactive) |
| HRASLS | HRAS like suppressor |
| HRH2 | histamine receptor H2 |
| HRH3 | histamine receptor H3 |
| HS3ST1 | heparan sulfate-glucosamine 3-sulfotransferase 1 |
| HS3ST2 | heparan sulfate-glucosamine 3-sulfotransferase 2 |
| HS3ST4 | heparan sulfate-glucosamine 3-sulfotransferase 4 |
| HS6ST2 | heparan sulfate 6-O-sulfotransferase 2 |
| HSD17B11 | hydroxysteroid 17-beta dehydrogenase 11 |
| HSD17B12 | hydroxysteroid 17-beta dehydrogenase 12 |
| HSP90AA1 | heat shock protein 90 alpha family class A member 1 |
| HSP90AB1 | heat shock protein 90 alpha family class B member 1 |
| HSPA1A | heat shock protein family A (Hsp70) member 1A |
| HSPA1B | heat shock protein family A (Hsp70) member 1B |
| HSPA4 | heat shock protein family A (Hsp70) member 4 |

TABLE 1-continued

Gene symbols and names

| Symbol | Name |
|---|---|
| HSPA4L | heat shock protein family A (Hsp70) member 4 like |
| HSPA8 | heat shock protein family A (Hsp70) member 8 |
| HSPA9 | heat shock protein family A (Hsp70) member 9 |
| HSPB1 | heat shock protein family B (small) member 1 |
| HSPD1 | heat shock protein family D (Hsp60) member 1 |
| HSPE1-MOB4 | HSPE1-MOB4 readthrough |
| HSPH1 | heat shock protein family H (Hsp110) member 1 |
| HTR1B | 5-hydroxytryptamine receptor 1B |
| HTR2A | 5-hydroxytryptamine receptor 2A |
| HTR2C | 5-hydroxytryptamine receptor 2C |
| HTR5A | 5-hydroxytryptamine receptor 5A |
| HTR5A-AS1 | HTR5A antisense RNA 1 |
| HTRA1 | HtrA serine peptidase 1 |
| HUNK | hormonally up-regulated Neu-associated kinase |
| ICAM5 | intercellular adhesion molecule 5 |
| ICMT | isoprenylcysteine carboxyl methyltransferase |
| Icosl | icos ligand |
| ICOSLG | inducible T-cell costimulator ligand |
| ID2 | inhibitor of DNA binding 2 |
| ID4 | inhibitor of DNA binding 4, HLH protein |
| IDI1 | isopentenyl-diphosphate delta isomerase 1 |
| IFFO1 | intermediate filament family orphan 1 |
| IFNLR1 | interferon lambda receptor 1 |
| IFRD1 | interferon related developmental regulator 1 |
| IFT43 | intraflagellar transport 43 |
| IGDCC3 | immunoglobulin superfamily DCC subclass member 3 |
| IGDCC4 | immunoglobulin superfamily DCC subclass member 4 |
| IGF2 | insulin like growth factor 2 |
| IGFBP3 | insulin like growth factor binding protein 3 |
| IGFBP5 | insulin like growth factor binding protein 5 |
| IGSF11 | immunoglobulin superfamily member 11 |
| IGSF3 | immunoglobulin superfamily member 3 |
| IL15 | interleukin 15 |
| IL16 | interleukin 16 |
| IL18 | interleukin 18 |
| IL20RB | interleukin 20 receptor subunit beta |
| IL22 | interleukin 22 |
| IL33 | interleukin 33 |
| ILDR2 | immunoglobulin like domain containing receptor 2 |
| Iltifb | interleukin 10-related T cell-derived inducible factor beta |
| IMPA2 | inositol monophosphatase 2 |
| IMPG1 | interphotoreceptor matrix proteoglycan 1 |
| INAVA | innate immunity activator |
| INF2 | inverted formin, FH2 and WH2 domain containing |
| INHBA | inhibin beta A subunit |
| INPP1 | inositol polyphosphate-1-phosphatase |
| INPP4B | inositol polyphosphate-4-phosphatase type II B |
| INPP5A | inositol polyphosphate-5-phosphatase A |
| INPP5D | inositol polyphosphate-5-phosphatase D |
| INSC | INSC, spindle orientation adaptor protein |
| INSIG1 | insulin induced gene 1 |
| IPCEF1 | interaction protein for cytohesin exchange factors 1 |
| IQCH | IQ motif containing H |
| IQGAP1 | IQ motif containing GTPase activating protein 1 |
| IQSEC1 | IQ motif and Sec7 domain 1 |
| IQSEC3 | IQ motif and Sec7 domain 3 |
| IRAK2 | interleukin 1 receptor associated kinase 2 |
| IRX1 | iroquois homeobox 1 |
| IRX2 | iroquois homeobox 2 |
| IRX5 | iroquois homeobox 5 |
| ISYNA1 | inositol-3-phosphate synthase 1 |
| ITGA11 | integrin subunit alpha 11 |
| ITGA2 | integrin subunit alpha 2 |
| ITGA4 | integrin subunit alpha 4 |
| ITGA5 | integrin subunit alpha 5 |
| ITGA7 | integrin subunit alpha 7 |
| ITGA8 | integrin subunit alpha 8 |
| ITGA9 | integrin subunit alpha 9 |
| ITGAV | integrin subunit alpha V |
| ITGB4 | integrin subunit beta 4 |
| ITGB5 | integrin subunit beta 5 |
| ITGB8 | integrin subunit beta 8 |
| ITIH3 | inter-alpha-trypsin inhibitor heavy chain 3 |

TABLE 1-continued

Gene symbols and names

| Symbol | Name |
| --- | --- |
| ITM2A | integral membrane protein 2A |
| ITPKA | inositol-trisphosphate 3-kinase A |
| ITPKB | inositol-trisphosphate 3-kinase B |
| ITPR1 | inositol 1,4,5-trisphosphate receptor type 1 |
| ITPRIPL2 | ITPRIP like 2 |
| ITSN2 | intersectin 2 |
| JAG1 | jagged 1 |
| JAM2 | junctional adhesion molecule 2 |
| JAM3 | junctional adhesion molecule 3 |
| JAML | junction adhesion molecule like |
| JAZF1 | JAZF zinc finger 1 |
| JDP2 | Jun dimerization protein 2 |
| JKAMP | JNK1/MAPK8 associated membrane protein |
| JMY | junction mediating and regulatory protein, p53 cofactor |
| JOSD1 | Josephin domain containing 1 |
| JPH1 | junctophilin 1 |
| JPH3 | junctophilin 3 |
| JUN | Jun proto-oncogene, AP-1 transcription factor subunit |
| JUNB | JunB proto-oncogene, AP-1 transcription factor subunit |
| JUND | JunD proto-onoogene, AP-1 transcription factor subunit |
| KANK1 | KN motif and ankyrin repeat domains 1 |
| KANK2 | KN motif and ankyrin repeat domains 2 |
| KANK4 | KN motif and ankyrin repeat domains 4 |
| KCNA1 | potassium voltage-gated channel subfamily A member 1 |
| KCNA2 | potassium voltage-gated channel subfamily A member 2 |
| KCNA3 | potassium voltage-gated channel subfamily A member 3 |
| KCNA4 | potassium voltage-gated channel subfamily A member 4 |
| KCNAB1 | potassium voltage-gated channel subfamily A member regulatory beta subunit 1 |
| KCNAB2 | potassium voltage-gated channel subfamily A regulatory beta subunit 2 |
| KCNAB3 | potassium voltage-gated channel subfamily A regulatory beta subunit 3 |
| KCNC1 | potassium voltage-gated channel subfamily C member 1 |
| KCNC2 | potassium voltage-gated channel subfamily C member 2 |
| KCNC3 | potassium voltage-gated channel subfamily C member 3 |
| KCND3 | potassium voltage-gated channel subfamily D member 3 |
| KCNF1 | potassium voltage-gated channel modifier subfamily F member 1 |
| KCNG4 | potassium voltage-gated channel modifier subfamily G member 4 |
| KCNH1 | potassium voltage-gated channel subfamily H member 1 |
| KCNH5 | potassium voltage-gated channel subfamily H member 5 |
| KCNH7 | potassium voltage-gated channel subfamily H member 7 |
| KCNH8 | potassium voltage-gated channel subfamily H member 8 |
| KCNIP1 | potassium voltage-gated channel interacting protein 1 |
| KCNIP2 | potassium voltage-gated channel interacting protein 2 |
| KCNIP4 | potassium voltage-gated channel interacting protein 4 |
| KCNJ10 | potassium voltage-gated channel subfamily J member 10 |
| KCNJ12 | potassium voltage-gated channel subfamily J member 12 |
| KCNJ16 | potassium voltage-gated channel subfamily J member 16 |
| KCNJ3 | potassium voltage-gated channel subfamily J member 3 |
| KCNJ4 | potassium voltage-gated channel subfamily J member 4 |
| KCNJ6 | potassium voltage-gated channel subfamily J member 6 |

TABLE 1-continued

Gene symbols and names

| Symbol | Name |
| --- | --- |
| KCNK1 | potassium two pore domain channel subfamily K member 1 |
| KCNK10 | potassium two pore domain channel subfamily K member 10 |
| KCNK12 | potassium two pore domain channel subfamily K member 12 |
| KCNK13 | potassium two pore domain channel subfamily K member 13 |
| KCNK3 | potassium two pore domain channel subfamily K member 3 |
| KCNMA1 | potassium calcium-activated channel subfamily M alpha 1 |
| KCNN3 | potassium calcium-activated channel subfamily N member 3 |
| KCNQ3 | potassium voltage-gated channel subfamily Q member 3 |
| KCNQ5 | potassium voltage-gated channel subfamily Q member 5 |
| KCNT2 | potassium sodium-activated channel subfamily T member 2 |
| KCNV1 | potassium voltage-gated channel modifier subfamily V member 1 |
| Kctd12b | potassium channel tetramerization domain containing 12b |
| KCTD13 | potassium channel tetramerization domain containing 13 |
| KCTD21-AS1 | KCTD21 antisense RNA 1 |
| KCTD3 | potassium channel tetramerization domain containing 3 |
| KDELR3 | KDEL endoplasmic reticulum protein retention receptor 3 |
| KDM5C | lysine demethylase 5C |
| KDM5D | lysine demethylase 5D |
| KEL | Kell blood group, metallo-endopeptidase |
| KHDRBS3 | KH RNA binding domain containing, signal transduction associated 3 |
| KIA1755 | N/A |
| KIAA0513 | KIAA0513 |
| KIAA0556 | KIAA0556 |
| KIAA0895 | KIAA0895 |
| KIAA0895L | KIAA0895 like |
| KIAA1024 | KIAA1024 |
| KIAA1217 | KIAA1217 |
| KIAA1456 | KIAA1456 |
| KIAA1549L | KIAA1549 like |
| KIAA1644 | KIAA1644 |
| KIF13A | kinesin family member 13A |
| KIF13B | kinesin family member 13B |
| KIF19 | kinesin family member 19 |
| Kif19a | kinesin family member 19A |
| KIF21B | kinesin family member 21B |
| KIF26B | kinesin family member 26B |
| KIF3B | kinesin family member 3B |
| KIF6 | kinesin family member 6 |
| Kirrel | kin of IRRE like (Drosophila) |
| KIRREL1 | kirre like nephrin family adhesion molecule 1 |
| KIT | KIT proto-oncogene receptor tyrosine kinase |
| Kitl | kit ligand |
| KITLG | KIT ligand |
| KLHDC4 | kelch domain containing 4 |
| KLHL13 | kelch like family member 13 |
| KLHL15 | kelch like family member 15 |
| KLHL22 | kelch like family member 22 |
| KLHL5 | kelch like family member 5 |
| KLK6 | kallikrein related peptidase 6 |
| KNDC1 | kinase non-catalytic C-lobe domain containing 1 |
| KNOP1 | lysine rich nucleolar protein 1 |
| KNTC1 | kinetochore associated 1 |
| KRT222 | keratin 222 |
| KRT24 | keratin 24 |
| KRTAP10-1 | keratin associated protein 10-1 |
| KRTAP10-10 | keratin associated protein 10-10 |
| KRTAP10-11 | keratin associated protein 10-11 |
| KRTAP10-12 | keratin associated protein 10-12 |
| KRTAP10-2 | keratin associated protein 10-2 |
| KRTAP10-3 | keratin associated protein 10-3 |

TABLE 1-continued

Gene symbols and names

| Symbol | Name |
|---|---|
| KRTAP10-4 | keratin associated protein 10-4 |
| KRTAP10-5 | keratin associated protein 10-5 |
| KRTAP10-6 | keratin associated protein 10-6 |
| KRTAP10-7 | keratin associated protein 10-7 |
| KRTAP10-8 | keratin associated protein 10-8 |
| KRTAP10-9 | keratin associated protein 10-9 |
| KRTAP12-2 | keratin associated protein 12-2 |
| KSR2 | kinase suppressor of ras 2 |
| L1CAM | L1 cell adhesion molecule |
| L3HYPDH | trans-L-3-hydroxyproline dehydratase |
| L3MBTL2 | L3MBTL2, polycomb repressive complex 1 subunit |
| LACTB2-AS1 | LACTB2 antisense RNA 1 |
| LAMA1 | laminin subunit alpha 1 |
| LAMA2 | laminin subunit alpha 2 |
| LAMA3 | laminin subunit alpha 3 |
| LAMA4 | laminin subunit alpha 4 |
| LAMB1 | laminin subunit beta 1 |
| LAMB2 | laminin subunit beta 2 |
| LAMP5 | lysosomal associated membrane protein family member 5 |
| LAPTM4B | lysosomal protein transmembrane 4 beta |
| LARP6 | La ribonucleoprotein domain family member 6 |
| LARS2 | leucyl-tRNA synthetase 2, mitochondrial |
| LBH | limb bud and heart development |
| LBX1 | ladybird homeobox 1 |
| LCAT | lecithin-cholesterol acyltransferase |
| LCN8 | lipocalin 8 |
| LCORL | ligand dependent nuclear receptor corepressor like |
| LDAH | lipid droplet associated hydrolase |
| LDB2 | LIM domain binding 2 |
| LDB3 | LIM domain binding 3 |
| LECT2 | leukocyte cell derived chemotaxin 2 |
| LENG9 | leukocyte receptor cluster member 9 |
| LFNG | LFNG O-fucosylpeptide 3-beta-N-acetylglucosaminyltransferase |
| LGALS3 | galectin 3 |
| LGI2 | leucine rich repeat LGI family member 2 |
| LGI4 | leucine rich repeat LGI family member 4 |
| LGR5 | leucine rich repeat containing G protein-coupled receptor 5 |
| LGR6 | leucine rich repeat containing G protein-coupled receptor 6 |
| Lhfp | lipoma HMGIC fusion partner |
| LHFPL2 | LHFPL tetraspan subfamily member 2 |
| LHFPL3 | LHFPL tetraspan subfamily member 3 |
| LHFPL6 | LHFPL tetraspan subfamily member 6 |
| LHX1 | LIM homeobox 1 |
| Lhx1os | LIM homeobox 1, opposite strand |
| LHX5 | LIM homeobox 5 |
| LIMD1 | LIM domains containing 1 |
| LIMS2 | LIM zinc finger domain containing 2 |
| LIN28B | lin-28 homolog B |
| LIN7A | lin-7 homolog A, crumbs cell polarity complex component |
| LINC00278 | long intergenic non-protein coding RNA 278 |
| LINC00457 | long intergenic non-protein coding RNA 457 |
| LINC00499 | long intergenic non-protein coding RNA 499 |
| LINC00844 | long intergenic non-protein coding RNA 844 |
| LINC00963 | long intergenic non-protein coding RNA 963 |
| LINC01032 | long intergenic non-protein coding RNA 1032 |
| LINC01158 | long intergenic non-protein coding RNA 1158 |
| LINC01208 | long intergenic non-protein coding RNA 1208 |
| LINC01515 | long intergenic non-protein coding RNA 1515 |
| LINC01544 | long intergenic non-protein coding RNA 1544 |
| LINC01933 | long intergenic non-protein coding RNA 1933 |
| LINC02112 | long intergenic non-protein coding RNA 2112 |
| LINC02125 | long intergenic non-protein coding RNA 2125 |
| LINC02398 | long intergenic non-protein coding RNA 2398 |
| LINC02405 | long intergenic non-protein coding RNA 2405 |
| LINCMD1 | long intergenic non-protein coding RNA, muscle differentiation 1 |
| LINGO1 | leucine rich repeat and Ig domain containing 1 |
| 1700063D05Rik | RIKEN cDNA 1700063D05 gene |
| 1700086L19Rik | RIKEN cDNA 1700086L19 gene |
| 1700124L16Rik | RIKEN cDNA 1700124L16 gene |
| 2510003B16Rik | N/A |

TABLE 1-continued

Gene symbols and names

| Symbol | Name |
|---|---|
| 4930449E18Rik | N/A |
| 6330403K07Rik | RIKEN cDNA 6330403K07 gene |
| 9330117O12Rik | N/A |
| 9330188P03Rik | N/A |
| 9530026P05Rik | RIKEN cDNA 9530026P05 gene |
| A230001M10Rik | RIKEN cDNA A230001M10 gene |
| A330049N07Rik | RIKEN cDNA A330049N07 gene |
| A530058N18Rik | RIKEN cDNA A530058N18 gene |
| A730017C20Rik | RIKEN cDNA A730017C20 gene |
| Ackr1 | atypical chemokine receptor 1 (Duffy blood group) |
| Adarb2 | adenosine deaminase, RNA-specific, B2 |
| Adipor2 | adiponectin receptor 2 |
| AI504432 | expressed sequence AI504432 |
| Alms1-ps2 | ALMS1, centrosome and basal body associated, pseudogene 2 |
| Anks1b | ankyrin repeat and sterile alpha motif domain containing 1B |
| Apoe | apolipoprotein E |
| Arhgap26 | Rho GTPase activating protein 26 |
| Arl4c | ADP-ribosylation factor-like 4C |
| Arrdc2 | arrestin domain containing 2 |
| Asphd1 | aspartate beta-hydroxylase domain containing 1 |
| Atp6ap1l | ATPase, H+ transporting lysosomal accessory protein 1-like |
| AU022751 | expressed sequence AU022751 |
| B3galt5 | UDP-Gal:betaGlcNAc beta 1,3-galactosyltransferase, polypeptide 5 |
| Bcl2l15 | BCL2-like 15 |
| Bmp4 | bone morphogenetic protein 4 |
| Btg1-ps1 | B cell translocation gene 1, anti-proliferative, pseudogene 1 |
| Bzrap1 | N/A |
| C030029H02Rik | RIKEN cDNA C030029H02 gene |
| C130030K03Rik | N/A |
| Cacna1d | calcium channel, voltage-dependent, L type, alpha 1D subunit |
| Calcrl | calcitonin receptor-like |
| Ccdc190 | coiled-coil domain containing 190 |
| Ccdc78 | coiled-coil domain containing 78 |
| Ccp110 | centriolar coiled coil protein 110 |
| Cdh22 | cadherin 22 |
| Celrr | cerebellum expressed regulatory RNA |
| Chadl | chondroadherin-like |
| Chd3os | chromodomain helicase DNA binding protein 3, opposite strand |
| Cntn2 | contactin 2 |
| Cntnap5b | contactin associated protein-like 5B |
| Cntnap5c | contactin associated protein-like 5C |
| Col18a1 | collagen, type XVIII, alpha 1 |
| Cplx2 | complexin 2 |
| Cpne2 | copine II |
| Cyp2j12 | cytochrome P450, family 2, subfamily j, polypeptide 12 |
| D430036J16Rik | RIKEN cDNA D430036J16 gene |
| Dbpht2 | DNA binding protein with his-thr domain |
| Defb23 | defensin beta 23 |
| Diras2 | DIRAS family, GTP-binding RAS-like 2 |
| Dnah11 | dynein, axonemal, heavy chain 11 |
| Dock10 | dedicator of cytokinesis 10 |
| Dscam | DS cell adhesion molecule |
| Elfn2 | leucine rich repeat and fibronectin type III, extracellular 2 |
| Epb41l2 | erythrocyte membrane protein band 4.1 like 2 |
| Epn2 | epsin 2 |
| Erbin | Erbb2 interacting protein |
| Fam173a | family with sequence similarity 173, member A |
| Fam21 | N/A |
| Fam3c | family with sequence similarity 3, member C |
| Far2 | fatty acyl CoA reductase 2 |
| Far2 | fatty acyl CoA reductase 3 |
| Far2 | fatty acyl CoA reductase 4 |
| Fbxw15 | F-box and WD-40 domain protein 15 |
| Frmpd3 | FERM and PDZ domain containing 3 |
| Fzd7 | frizzled class receptor 7 |
| G0s2 | G0/G1 switch gene 2 |
| Gap43 | growth associated protein 43 |

TABLE 1-continued

Gene symbols and names

| Symbol | Name |
|---|---|
| Gbp11 | guanylate binding protein 11 |
| Gdpd5 | glycerophosphodiester phosphodiesterase domain containing 5 |
| Gfra1 | glial cell line derived neurotrophic factor family receptor alpha 1 |
| Glce | glucuronyl C5-epimerase |
| Gm10471 | predicted gene 10471 |
| Gm11780 | predicted gene 11780 |
| Gm14204 | predicted gene 14204 |
| Gm1979 | predicted gene 1979 |
| Gm21671 | predicted gene, 21671 |
| Gm2694 | predicted gene 2694 |
| Gm30731 | predicted gene, 30731 |
| Gm5803 | N/A |
| Gm5862 | predicted gene 5862 |
| Gm6277 | predicted gene 6277 |
| Gm6277 | predicted gene 6277 |
| Gm9895 | N/A |
| Gpr12 | G-protein coupled receptor 12 |
| Grm4 | glutamate receptor, metabotropic 4 |
| H2-Bl | histocompatibility 2, blastocyst |
| Hecw1 | |
| LINGO2 | leucine rich repeat and Ig domain containing 2 |
| LIPG | lipase G, endothelial type |
| LITAF | lipopolysaccharide induced TNF factor |
| LMCD1 | LIM and cysteine rich domains 1 |
| LMNTD2 | lamin tail domain containing 2 |
| LMO2 | LIM domain only 2 |
| LOC100506990 | N/A |
| LONRF2 | LON peptidase N-terminal domain and ring finger 2 |
| LOXL2 | lysyl oxidase like 2 |
| LPAR1 | lysophosphatidic acid receptor 1 |
| LPCAT2 | lysophosphatidylcholine acyltransferase 2 |
| LPCAT4 | lysophosphatidylcholine acyltransferase 4 |
| LPL | lipoprotein lipase |
| LPP | LIM domain containing preferred translocation partner in lipoma |
| LRCH1 | leucine rich repeats and calponin homology domain containing 1 |
| LRIG1 | leucine rich repeats and immunoglobulin like domains 1 |
| LRP1 | LDL receptor related protein 1 |
| LRP1B | LDL receptor related protein 1B |
| LRP2 | LDL receptor related protein 2 |
| LRPAP1 | LDL receptor related protein associated protein 1 |
| LRRC1 | leucine rich repeat containing 1 |
| LRRC2 | leucine rich repeat containing 2 |
| LRRC20 | leucine rich repeat containing 20 |
| LRRC38 | leucine rich repeat containing 38 |
| LRRC3B | leucine rich repeat containing 3B |
| LRRC4C | leucine rich repeat containing 4C |
| LRRC69 | leucine rich repeat containing 69 |
| LRRC7 | leucine rich repeat containing 7 |
| LRRK2 | leucine rich repeat kinase 2 |
| LRRTM4 | leucine rich repeat transmembrane neuronal 4 |
| LRTM1 | leucine rich repeats and transmembrane domains 1 |
| LSM5 | LSM5 homolog, U6 small nuclear RNA and mRNA degradation associated |
| LTBP2 | latent transforming growth factor beta binding protein 2 |
| LTK | leukocyte receptor tyrosine kinase |
| LURAP1 | leucine rich adaptor protein 1 |
| LURAP1L | leucine rich adaptor protein 1 like |
| LY6E | lymphocyte antigen 6 family member E |
| LYPD1 | LY6/PLAUR domain containing 1 |
| LYPD6 | LY6/PLAUR domain containing 6 |
| LYPD6B | LY6/PLAUR domain containing 6B |
| LYRM1 | LYR motif containing 1 |
| LYZL4 | lysozyme like 4 |
| MAATS1 | MYCBP associated and testis expressed 1 |
| MAF | MAF bZIP transcription factor |
| MAFF | MAF bZIP transcription factor F |
| MAG | myelin associated glycoprotein |
| MAGI3 | membrane associated guanylate kinase, WW and PDZ domain containing 3 |

TABLE 1-continued

Gene symbols and names

| Symbol | Name |
|---|---|
| MAGT1 | magnesium transporter 1 |
| MAK | male germ cell associated kinase |
| MAL | mal, T-cell differentiation protein |
| MAL2 | mal, T-cell differentiation protein 2 (gene/pseudogene) |
| MAMSTR | MEF2 activating motif and SAP domain containing transcriptional regulator |
| Man1a | mannosidase 1, alpha |
| MAN1A1 | mannosidase alpha class 1A member 1 |
| MAN1C1 | mannosidase alpha class 1C member 1 |
| MAN2A1 | mannosidase alpha class 2A member 1 |
| MAP2K6 | mitogen-activated protein kinase 6 |
| MAP6D1 | MAP6 domain containing 1 |
| MAP7 | microtubule associated protein 7 |
| MAPK12 | mitogen-activated protein kinase 12 |
| MAPK4 | mitogen-activated protein kinase 4 |
| MAPRE2 | microtubule associated protein RP/EB family member 2 |
| MARC2 | mitochondrial amidoxime reducing component 2 |
| MARCH1 | membrane associated ring-CH-type finger 1 |
| MARCH11 | membrane associated ring-CH-type finger 11 |
| MARCKS | myristoylated alanine rich protein kinase C substrate |
| MARCKSL1 | MARCKS like 1 |
| MARVELD2 | MARVEL domain containing 2 |
| MASP1 | mannan binding lectin serine peptidase 1 |
| MATN1 | matrilin 1, cartilage matrix protein |
| MATN4 | matrilin 4 |
| MBOAT1 | membrane bound O-acyltransferase domain containing 1 |
| MBOAT2 | membrane bound O-acyltransferase domain containing 2 |
| MBOAT7 | membrane bound O-acyltransferase domain containing 7 |
| MBP | myelin basic protein |
| MCAM | melanoma cell adhesion molecule |
| MCC | mutated in colorectal cancers |
| MCL1 | MCL1, BCL2 family apoptosis regulator |
| MCTP1 | multiple C2 and transmembrane domain containing 1 |
| MDFI | MyoD family inhibitor |
| MDGA1 | MAM domain containing glycosylphosphatidylinositol anchor 1 |
| MDGA2 | MAM domain containing glycosylphosphatidylinositol anchor 2 |
| MED12L | mediator complex subunit 12 like |
| MEF2C | myocyte enhancer factor 2C |
| MEF2C-AS1 | MEF2C antisense RNA 1 |
| MEG8 | maternally expressed 8, small nucleolar RNA host gene |
| MEGF10 | multiple EGF like domains 10 |
| MEGF11 | multiple EGF like domains 11 |
| MEI4 | meiotic double-stranded break formation protein 4 |
| MEIS1 | Meis homeobox 1 |
| MEIS2 | Meis homeobox 2 |
| MEIS3 | Meis homeobox 3 |
| MERTK | MER proto-oncogene, tyrosine kinase |
| METRN | meteorin, glial cell differentiation regulator |
| METTL7A | methyltransferase like 7A |
| METTL9 | methyltransferase like 9 |
| MFAP3L | microfibril associated protein 3 like |
| MFF | mitochondrial fission factor |
| MFGE8 | milk fat globule-EGF factor 8 protein |
| MFHAS1 | malignant fibrous histiocytoma amplified sequence 1 |
| MFSD2A | major facilitator superfamily domain containing 2A |
| MFSD9 | major facilitator superfamily domain containing 9 |
| MGAT3 | mannosyl (beta-1,4-)-glycoprotein beta-1,4-N-acetylglucosaminyltransferase |
| MGAT4C | MGAT4 family member C |
| MGAT5B | mannosyl (alpha-1,6-)-glycoprotein beta-1,6-N-acetyl-glucosaminyltransferase, isozyme B |
| MGLL | monoglyceride lipase |
| MGP | matrix Gla protein |
| MGST1 | microsomal glutathione S-transferase 1 |
| MIAT | myocardial infarction associated transcript (non-protein coding) |

TABLE 1-continued

Gene symbols and names

| Symbol | Name |
|---|---|
| MICAL2 | microtubule associated monooxygenase, calponin and LIM domain containing 2 |
| MICALCL | MICAL C-terminal like |
| MID1 | midline 1 |
| MID2 | midline 2 |
| MIDN | midnolin |
| MIR136 | microRNA 136 |
| MIR31HG | MIR31 host gene |
| MIR346 | microRNA 346 |
| MIR34C | microRNA 34c |
| MIR3671 | microRNA 3671 |
| MIR384 | microRNA 384 |
| MIR646HG | MIR646 host gene |
| MIR6723 | microRNA 6723 |
| MIR7-3HG | MIR7-3 host gene |
| MIR9-3HG | MIR9-3 host gene |
| MKX | mohawk homeobox |
| MLC1 | megalencephalic leukoencephalopathy with subcortical cysts 1 |
| MLLT11 | MLLT11, transcription factor 7 cofactor |
| MLYCD | malonyl-CoA decarboxylase |
| MMD2 | monocyte to macrophage differentiation associated 2 |
| MMP14 | matrix metallopeptidase 14 |
| MMP15 | matrix metallopeptidase 15 |
| MMP16 | matrix metallopeptidase 16 |
| MMP2 | matrix metallopeptidase 2 |
| MMP24 | matrix metallopeptidase 24 |
| MNS1 | meiosis specific nuclear structural 1 |
| MOBP | myelin-associated oligodendrocyte basic protein |
| MOG | myelin oligodendrocyte glycoprotein |
| MORF4L2 | mortality factor 4 like 2 |
| MPND | MPN domain containing |
| MPP6 | membrane palmitoylated protein 6 |
| MPP7 | membrane palmitoylated protein 7 |
| MPPED1 | metallophosphoesterase domain containing 1 |
| MPZ | myelin protein zero |
| MRAP2 | melanocortin 2 receptor accessory protein 2 |
| MRGPRF | MAS related GPR family member F |
| MRLN | myoregulin |
| MRM2 | mitochondrial rRNA methyltransferase 2 |
| MRPL18 | mitochondrial ribosomal protein L18 |
| MSI1 | musashi RNA binding protein 1 |
| MSMO1 | methylsterol monooxygenase 1 |
| MSRA | methionine sulfoxide reductase A |
| MSX2 | msh homeobox 2 |
| MT2A | metallothionein 2A |
| MT3 | metallothionein 3 |
| MTCH1 | mitochondrial carrier 1 |
| MTCH2 | mitochondrial carrier 2 |
| MT-CO1 | mitochondrially encoded cytochrome c oxidase I |
| MTFP1 | mitochondrial fission process 1 |
| MTHFD1L | methylenetetrahydrofolate dehydrogenase (NADP+ dependent) 1 like |
| MTHFD2L | methylenetetrahydrofolate dehydrogenase (NADP+ dependent) 2 like |
| MTHFSD | methenyltetrahydrofolate synthetase domain containing |
| MT-ND4 | mitochondrially encoded NADH:ubiquinone oxidoreductase core subunit 4 |
| MTRF1 | mitochondrial translation release factor 1 |
| MTRNR2L6 | MT-RNR2-like 6 |
| MTRNR2L8 | MT-RNR2-like 8 |
| MTSS1 | MTSS1, I-BAR domain containing |
| MTTP | microsomal triglyceride transfer protein |
| MVP | major vault protein |
| MXD1 | MAX dimerization protein 1 |
| MXD4 | MAX dimerization protein 4 |
| MXRA8 | matrix remodeling associated 8 |
| MYBPC1 | myosin binding protein C, slow type |
| MYCL | MYCL proto-oncogene, bHLH transcription factor |
| MYH11 | myosin heavy chain 11 |
| MYH14 | myosin heavy chain 14 |
| MYH6 | myosin heavy chain 6 |
| MYLIP | myosin regulatory light chain interacting protein |
| MYO10 | myosin X |

TABLE 1-continued

Gene symbols and names

| Symbol | Name |
|---|---|
| MYO16 | myosin XVI |
| MYO1D | myosin ID |
| MYO7A | myosin VIIA |
| MYORG | myogenesis regulating glycosidase (putative) |
| MYOT | myotilin |
| MYRF | myelin regulatory factor |
| MYRIP | myosin VIIA and Rab interacting protein |
| MYT1 | myelin transcription factor 1 |
| MYT1L | myelin transcription factor 1 like |
| N/A | N/A |
| NAA20 | N(alpha)-acetyltransferase 20, NatB catalytic subunit |
| NAB2 | NGFI-A binding protein 2 |
| NAF1 | nuclear assembly factor 1 ribonucleoprotein |
| NAMA | non-protein coding RNA, associated with MAP kinase pathway and growth arrest |
| NAMPT | nicotinamide phosphoribosyltransferase |
| NAPA | NSF attachment protein alpha |
| NARS2 | asparaginyl-tRNA synthetase 2, mitochondrial |
| NAT8 | N-acetyltransferase 8 (putative) |
| Nat8f5 | N-acetyltransferase 8 (GCN5-related) family member 5 |
| NAV2 | neuron navigator 2 |
| NCALD | neurocalcin delta |
| NCAM2 | neural cell adhesion molecule 2 |
| NCAN | neurocan |
| NCEH1 | neutral cholesterol ester hydrolase 1 |
| NCKAP5 | NCK associated protein 5 |
| NDEL1 | nudE neurodevelopment protein 1 like 1 |
| NDNF | neuron derived neurotrophic factor |
| NDRG1 | N-myc downstream regulated 1 |
| NDRG2 | NDRG family member 2 |
| NDST3 | N-deacetylase and N-sulfotransferase 3 |
| NDST4 | N-deacetylase and N-sulfotransferase 4 |
| NEAT1 | nuclear paraspeckle assembly transcript 1 (non-protein coding) |
| NECAB1 | N-terminal EF-hand calcium binding protein 1 |
| NECTIN3 | nectin cell adhesion molecule 3 |
| NEDD4 | neural precursor cell expressed, developmentally down-regulated 4, E3 ubiquitin protein ligase |
| NEDD4L | neural precursor cell expressed, developmentally down-regulated 4-like, E3 ubiquitin protein ligase |
| NEFH | neurofilament heavy |
| NEFL | neurofilament light |
| NEFM | neurofilament medium |
| NEGR1 | neuronal growth regulator 1 |
| NEK2 | NIMA related kinase 2 |
| NEK4 | NIMA related kinase 4 |
| NELL1 | neural EGFL like 1 |
| NEO1 | neogenin 1 |
| NES | nestin |
| NETO1 | neuropilin and tolloid like 1 |
| NEU4 | neuraminidase 4 |
| NEURL1 | neuralized E3 ubiquitin protein ligase 1 |
| Neurl1a | neuralized E3 ubiquitin protein ligase 1A |
| NEUROD1 | neuronal differentiation 1 |
| NEUROD6 | neuronal differentiation 6 |
| NEXN | nexilin F-actin binding protein |
| NFAM1 | NFAT activating protein with ITAM motif 1 |
| NFATC2 | nuclear factor of activated T-cells 2 |
| NFATC4 | nuclear factor of activated T-cells 4 |
| NFIL3 | nuclear factor, interleukin 3 regulated |
| NFKBID | NFKB inhibitor delta |
| NHS | NHS actin remodeling regulator |
| NHSL1 | NHS like 1 |
| NHSL2 | NHS like 2 |
| NID1 | nidogen 1 |
| NINJ2 | ninjurin 2 |
| NIPAL4 | NIPA like domain containing 4 |
| NKAIN2 | sodium/potassium transporting ATPase interacting 2 |
| NKAIN3 | sodium/potassium transporting ATPase interacting 3 |
| NKAIN4 | sodium/potassium transporting ATPase interacting 4 |
| NKD1 | naked cuticle homolog 1 |

TABLE 1-continued

Gene symbols and names

| Symbol | Name |
| --- | --- |
| NKIRAS2 | NFKB inhibitor interacting Ras like 2 |
| NKRF | NFKB repressing factor |
| NKX2-2 | NK2 homeobox 2 |
| NLGN3 | neuroligin 3 |
| NLGN4Y | neuroligin 4, Y-linked |
| NLN | neurolysin |
| NNT | nicotinamide nucleotide transhydrogenase |
| NOL3 | nucleolar protein 3 |
| NOS1 | nitric oxide synthase 1 |
| NOTCH1 | notch 1 |
| NOTCH3 | notch 3 |
| NPAS4 | neuronal PAS domain protein 4 |
| NPL | N-acetylneuraminate pyruvate lyase |
| NPR1 | natriuretic peptide receptor 1 |
| NPR3 | natriuretic peptide receptor 3 |
| NPY1R | neuropeptide Y receptor Y1 |
| NPY6R | neuropeptide Y receptor Y6 (pseudogene) |
| NR3C2 | nuclear receptor subfamily 3 group C member 2 |
| NR4A1 | nuclear receptor subfamily 4 group A member 1 |
| NR4A2 | nuclear receptor subfamily 4 group A member 2 |
| NR4A3 | nuclear receptor subfamily 4 group A member 3 |
| NRBF2 | nuclear receptor binding factor 2 |
| NRCAM | neuronal cell adhesion molecule |
| NREP | neuronal regeneration related protein |
| NRG1 | neuregulin 1 |
| NRG2 | neuregulin 2 |
| NRG3 | neuregulin 3 |
| NRGN | neurogranin |
| NRIP3 | nuclear receptor interacting protein 3 |
| NRK | Nik related kinase |
| NRXN1 | neurexin 1 |
| NRXN2 | neurexin 2 |
| NRXN3 | neurexin 3 |
| NT5DC2 | 5'-nucleotidase domain containing 2 |
| NT5E | 5'-nucleotidase ecto |
| NTF3 | neurotrophin 3 |
| NTM | neurotrimin |
| NTN1 | netrin 1 |
| NTN4 | netrin 4 |
| NTNG1 | netrin G1 |
| NTNG2 | netrin G2 |
| NTSR1 | neurotensin receptor 1 |
| NTSR2 | neurotensin receptor 2 |
| NUDC | nuclear distribution C, dynein complex regulator |
| NUDCD3 | NudC domain containing 3 |
| NUDT4 | nudix hydrolase 4 |
| NUMBL | NUMB like, endocytic adaptor protein |
| NUP58 | nucleoporin 58 |
| NUP62CL | nucleoporin 62 C-terminal like |
| NUP93 | nucleoporin 93 |
| NWD1 | NACHT and WD repeat domain containing 1 |
| NXN | nucleoredoxin |
| NXNL2 | nucleoredoxin like 2 |
| NXPE3 | neurexophilin and PC-esterase domain family member 3 |
| NYAP2 | neuronal tyrosine-phosphorylated phosphoinositide-3-kinase adaptor 2 |
| NYX | nyctalopin |
| OAT | ornithine aminotransferase |
| OGDHL | oxoglutarate dehydrogenase like |
| OLFM1 | olfactomedin 1 |
| OLFM2 | olfactomedin 2 |
| OLFM3 | olfactomedin 3 |
| OLIG1 | oligodendrocyte transcription factor 1 |
| OLIG2 | oligodendrocyte transcription factor 2 |
| ONECUT1 | one cut homeobox 1 |
| ONECUT2 | one cut homeobox 2 |
| OPALIN | oligodendrocytic myelin paranodal and inner loop protein |
| OPHN1 | oligophrenin 1 |
| OPLAH | 5-oxoprolinase, ATP-hydrolysing |
| OPRD1 | opioid receptor delta 1 |
| OPTC | opticin |
| OSBP | oxysterol binding protein |
| OSBPL10 | oxysterol binding protein like 10 |
| OSBPL3 | oxysterol binding protein like 3 |

TABLE 1-continued

Gene symbols and names

| Symbol | Name |
| --- | --- |
| OTUD6B | OTU domain containing 6B |
| OTUD6B-AS1 | OTUD6B antisense RNA 1 (head to head) |
| OXSR1 | oxidative stress responsive 1 |
| P2RY1 | purinergic receptor P2Y1 |
| P2RY12 | purinergic receptor P2Y12 |
| P4HA1 | prolyl 4-hydroxylase subunit alpha 1 |
| P4HA2 | prolyl 4-hydroxylase subunit alpha 2 |
| P4HA2-AS1 | P4HA2 antisense RNA 1 |
| PACS2 | phosphofurin acidic cluster sorting protein 2 |
| PAFAH1B1 | platelet activating factor acetylhydrolase 1b regulatory subunit 1 |
| PAGR1 | PAXIP1 associated glutamate rich protein 1 |
| PAK5 | p21 (RAC1) activated kinase 5 |
| Pak7 | p21 protein (Cdc42/Rac)-activated kinase 7 |
| PALM2 | paralemmin 2 |
| PAM | peptidylglycine alpha-amidating monooxygenase |
| PANX2 | pannexin 2 |
| PAQR4 | progestin and adipoQ receptor family member 4 |
| PAQR6 | progestin and adipoQ receptor family member 6 |
| PARD3 | par-3 family cell polarity regulator |
| PARD3B | par-3 family cell polarity regulator beta |
| PARD6G | par-6 family cell polarity regulator gamma |
| PARD6G-AS1 | PARD6G antisense RNA 1 |
| PARM1 | prostate androgen-regulated mucin-like protein 1 |
| PATJ | PATJ, crumbs cell polarity complex component |
| PAX2 | paired box 2 |
| PAX3 | paired box 3 |
| PAX6 | paired box 6 |
| PAXBP1 | PAX3 and PAX7 binding protein 1 |
| PBX3 | PBX homeobox 3 |
| PBXIP1 | PBX homeobox interacting protein 1 |
| PC | pyruvate carboxylase |
| PCBP1 | poly(rC) binding protein 1 |
| PCDH1 | protocadherin 1 |
| PCDH15 | protocadherin related 15 |
| PCDH17 | protocadherin 17 |
| PCDH9 | protocadherin 9 |
| PCDHA1 | protocadherin alpha 1 |
| PCDHA3 | protocadherin alpha 3 |
| PCGF5 | polycomb group ring finger 5 |
| PCK1 | phosphoenolpyruvate carboxykinase 1 |
| PCP2 | Purkinje cell protein 2 |
| PCP4 | Purkinje cell protein 4 |
| Pcsk1 | proprotein convertase subtilisin/kexin type 1 |
| PCSK5 | proprotein convertase subtilisin/kexin type 5 |
| PCSK6 | proprotein convertase subtilisin/kexin type 6 |
| PCSK7 | proprotein convertase subtilisin/kexin type 7 |
| Pcx | pyruvate carboxylase |
| PCYT1B | phosphate cytidylyltransferase 1, choline, beta |
| PDC | phosducin |
| PDE1A | phosphodiesterase 1A |
| PDE1B | phosphodiesterase 1B |
| PDE1C | phosphodiesterase 1C |
| PDE3A | phosphodiesterase 3A |
| PDE3B | phosphodiesterase 3B |
| PDE4D | phosphodiesterase 4D |
| PDE5A | phosphodiesterase 5A |
| PDE7A | phosphodiesterase 7A |
| PDE7B | phosphodiesterase 7B |
| PDE8A | phosphodiesterase 8A |
| PDE8B | phosphodiesterase 8B |
| PDE9A | phosphodiesterase 9A |
| PDGFC | platelet derived growth factor C |
| PDGFD | platelet derived growth factor D |
| PDGFRA | platelet derived growth factor receptor alpha |
| PDGFRB | platelet derived growth factor receptor beta |
| PDK3 | pyruvate dehydrogenase kinase 3 |
| PDLIM3 | PDZ and LIM domain 3 |
| PDLIM4 | PDZ and LIM domain 4 |
| PDZD3 | PDZ domain containing 3 |
| PDZD7 | PDZ domain containing 7 |
| Pdzph1 | PDZ and pleckstrin homology domains 1 |
| PDZRN4 | PDZ domain containing ring finger 4 |
| PEA15 | proliferation and apoptosis adaptor protein 15 |
| Peal5a | phosphoprotein enriched in astrocytes 15A |
| PEBP4 | phosphatidylethanolamine binding protein 4 |

TABLE 1-continued

Gene symbols and names

| Symbol | Name |
| --- | --- |
| PEG3 | paternally expressed 3 |
| PENK | proenkephalin |
| PER1 | period circadian regulator 1 |
| PET100 | PET100 homolog |
| PEX5L | peroxisomal biogenesis factor 5 like |
| PFKFB4 | 6-phosphofructo-2-kinase/fructose-2,6-biphosphatase 4 |
| PFKM | phosphofructokinase, muscle |
| PFKP | phosphofructokinase, platelet |
| PGGHG | protein-glucosylgalactosylhydroxylysine glucosidase |
| PGM2L1 | phosphoglucomutase 2 like 1 |
| PGM5 | phosphoglucomutase 5 |
| PGR | progesterone receptor |
| PHACTR2-AS1 | PHACTR2 antisense RNA 1 |
| PHF10 | PHD finger protein 10 |
| PHF21B | PHD finger protein 21B |
| PHF24 | PHD finger protein 24 |
| PHKA1 | phosphorylase kinase regulatory subunit alpha 1 |
| PHKA2 | phosphorylase kinase regulatory subunit alpha 2 |
| PHKG1 | phosphorylase kinase catalytic subunit gamma 1 |
| PHOX2A | paired like homeobox 2a |
| PHYHIP | phytanoyl-CoA 2-hydroxylase interacting protein |
| PI16 | peptidase inhibitor 16 |
| PID1 | phosphotyrosine interaction domain containing 1 |
| PIEZO2 | piezo type mechanosensitive ion channel component 2 |
| PIGA | phosphatidylinositol glycan anchor biosynthesis class A |
| PIGH | phosphatidylinositol glycan anchor biosynthesis class H |
| PIGS | phosphatidylinositol glycan anchor biosynthesis class S |
| PIGZ | phosphatidylinositol glycan anchor biosynthesis class Z |
| PIH1D3 | PIH1 domain containing 3 |
| Pih1h3b | PIH1 domain containing 3B |
| PK3C2B | phosphatidylinositol-4-phosphate 3-kinase catalytic subunit type 2 beta |
| PIK3R1 | phosphoinositide-3-kinase regulatory subunit 1 |
| PILRA | paired immunoglobin like type 2 receptor alpha |
| PIM3 | Pim-3 proto-oncogene, serine/threonine kinase |
| PIN4 | peptidylprolyl cis/trans isomerase, NIMA-interacting 4 |
| PIP4K2A | phosphatidylinositol-5-phosphate 4-kinase type 2 alpha |
| PIP5K1C | phosphatidylinositol-4-phosphate 5-kinase type 1 gamma |
| PIPOX | pipecolic acid and sarcosine oxidase |
| PITPNM3 | PITPNM family member 3 |
| PIWIL1 | piwi like RNA-mediated gene silencing 1 |
| PKD1 | polycystin 1, transient receptor potential channel interacting |
| PKD2 | polycystin 2, transient receptor potential cation channel |
| PKD2L1 | polycystin 2 like 1, transient receptor potential cation channel |
| PKDCC | protein kinase domain containing, cytoplasmic |
| PKIA | cAMP-dependent protein kinase inhibitor alpha |
| PKMYT1 | protein kinase, membrane associated tyrosine/threonine 1 |
| PKNOX2 | PBX/knotted 1 homeobox 2 |
| PKP3 | plakophilin 3 |
| PLA2G16 | phospholipase A2 group XVI |
| PLA2G3 | phospholipase A2 group III |
| PLA2G4A | phospholipase A2 group IVA |
| PLA2G4E | phospholipase A2 group IVE |
| PLA2G5 | phospholipase A2 group V |
| PLA2G7 | phospholipase A2 group VII |
| PLAG1 | PLAG1 zinc finger |
| PLAT | plasminogen activator, tissue type |
| PLCB1 | phospholipase C beta 1 |
| PLCE1 | phospholipase C epsilon 1 |
| PLCH1 | phospholipase C eta 1 |
| PLCH2 | phospholipase C eta 2 |
| PLCL1 | phospholipase C like 1 (inactive) |

TABLE 1-continued

Gene symbols and names

| Symbol | Name |
| --- | --- |
| PLCXD3 | phosphatidylinositol specific phospholipase C X domain containing 3 |
| PLD1 | phospholipase D1 |
| PLD4 | phospholipase D family member 4 |
| PLD5 | phospholipase D family member 5 |
| PLEKHD1 | pleckstrin homology and coiled-coil domain containing D1 |
| PLEKHG3 | pleckstrin homology and RhoGEF domain containing G3 |
| PLEKHG5 | pleckstrin homology and RhoGEF domain containing G5 |
| PLEKHH1 | pleckstrin homology, MyTH4 and FERM domain containing H1 |
| PLEKHH2 | pleckstrin homology, MyTH4 and FERM domain containing H2 |
| PLEKHO2 | pleckstrin homology domain containing O2 |
| PLK2 | polo like kinase 2 |
| PLK5 | polo like kinase 5 |
| PLLP | plasmolipin |
| PLOD2 | procollagen-lysine, 2-oxoglutarate 5-dioxygenase 2 |
| PLP1 | proteolipid protein 1 |
| PLPP2 | phospholipid phosphatase 2 |
| PLPP3 | phospholipid phosphatase 3 |
| PLPP4 | phospholipid phosphatase 4 |
| PLPPR1 | phospholipid phosphatase related 1 |
| PLPPR4 | phospholipid phosphatase related 4 |
| PLS1 | plastin 1 |
| PLSCR1 | phospholipid scramblase 1 |
| PLSCR4 | phospholipid scramblase 4 |
| PLTP | phospholipid transfer protein |
| PLXDC1 | plexin domain containing 1 |
| PLXDC2 | plexin domain containing 2 |
| PLXNA1 | plexin A1 |
| PLXNA4 | plexin A4 |
| PLXNB1 | plexin B1 |
| PLXNB3 | plexin B3 |
| PLXNC1 | plexin C1 |
| PMEL | premelanosome protein |
| PMEPA1 | prostate transmembrane protein, androgen induced 1 |
| PMP2 | peripheral myelin protein 2 |
| PMP22 | peripheral myelin protein 22 |
| PMVK | phosphomevalonate kinase |
| PNLIP | pancreatic lipase |
| PNMA2 | PNMA family member 2 |
| PNP | purine nucleoside phosphorylase |
| PNPLA3 | patatin like phospholipase domain containing 3 |
| PNPLA8 | patatin like phospholipase domain containing 8 |
| POLR2A | RNA polymerase II subunit A |
| POLR2J3 | RNA polymerase II subunit J3 |
| PON2 | paraoxonase 2 |
| POR | cytochrome p450 oxidoreductase |
| POU3F2 | POU class 3 homeobox 2 |
| PPARG | peroxisome proliferator activated receptor gamma |
| PPFIA4 | PTPRF interacting protein alpha 4 |
| PPFIBP1 | PPFIA binding protein 1 |
| PPFIBP2 | PPFIA binding protein 2 |
| PPM1E | protein phosphatase, Mg2+/Mn2+ dependent 1E |
| PPM1H | protein phosphatase, Mg2+/Mn2+ dependent 1H |
| PPM1J | protein phosphatase, Mg2+/Mn2+ dependent 1J |
| PPP1R11 | protein phosphatase 1 regulatory inhibitor subunit 11 |
| PPP1R14A | protein phosphatase 1 regulatory inhibitor subunit 14A |
| PPP1R15A | protein phosphatase 1 regulatory subunit 15A |
| PPP1R16B | protein phosphatase 1 regulatory subunit 16B |
| PPP1R17 | protein phosphatase 1 regulatory subunit 17 |
| PPP1R1C | protein phosphatase 1 regulatory inhibitor subunit 1C |
| PPP1R36 | protein phosphatase 1 regulatory subunit 36 |
| PPP2CA | protein phosphatase 2 catalytic subunit alpha |
| PPP2R2C | protein phosphatase 2 regulatory subunit Bgamma |
| PPP4R4 | protein phosphatase 4 regulatory subunit 4 |
| PPP6R2 | protein phosphatase 6 regulatory subunit 2 |
| PRAG1 | PEAK1 related, kinase-activating pseudokinase 1 |
| PRDM1 | PR/SET domain 1 |

TABLE 1-continued

Gene symbols and names

| Symbol | Name |
| --- | --- |
| PRDM8 | PR/SET domain 8 |
| PRELP | proline and arginine rich end leucine rich repeat protein |
| PREX1 | phosphatidylinositol-3,4,5-trisphosphate dependent Rac exchange factor 1 |
| PREX2 | phosphatidylinositol-3,4,5-trisphosphate dependent Rac exchange factor 2 |
| PRICKLE1 | prickle planar cell polarity protein 1 |
| PRIMA1 | proline rich membrane anchor 1 |
| PRKAG2 | protein kinase AMP-activated non-catalytic subunit gamma 2 |
| PRKAG3 | protein kinase AMP-activated non-catalytic subunit gamma 3 |
| PRKCB | protein kinase C beta |
| PRKCD | protein kinase C delta |
| PRKCG | protein kinase C gamma |
| PRKCQ | protein kinase C theta |
| PRKD3 | protein kinase D3 |
| PRKG1 | protein kinase, cGMP-dependent, type I |
| PRKG2 | protein kinase, cGMP-dependent, type II |
| PRKY | protein kinase, Y-linked pseudogene |
| PRMT8 | protein arginine methyltransferase 8 |
| PRMT9 | protein arginine methyltransferase 9 |
| PRNP | prion protein |
| PROCR | protein C receptor |
| PRODH | proline dehydrogenase 1 |
| PROX1 | prospero homeobox 1 |
| PRR5 | proline rich 5 |
| PRR5L | proline rich 5 like |
| PRRC1 | proline rich coiled-coil 1 |
| PRRG3 | proline rich and Gla domain 3 |
| PRRT2 | proline rich transmembrane protein 2 |
| PRRT4 | proline rich transmembrane protein 4 |
| PRRX1 | paired related homeobox 1 |
| PRSS51 | protease, serine 51 |
| PRSS55 | protease, serine 55 |
| PSD2 | pleckstrin and Sec7 domain containing 2 |
| PSRC1 | proline and serine rich coiled-coil 1 |
| PSTPIP2 | proline-serine-threonine phosphatase interacting protein 2 |
| PTCH2 | patched 2 |
| PTCHD1 | patched domain containing 1 |
| PTCHD4 | patched domain containing 4 |
| PTER | phosphotriesterase related |
| PTGES3 | prostaglandin E synthase 3 |
| PTGFRN | prostaglandin F2 receptor inhibitor |
| PTK2B | protein tyrosine kinase 2 beta |
| PTK7 | protein tyrosine kinase 7 (inactive) |
| PTMS | parathymosin |
| PTN | pleiotrophin |
| PTP4A1 | protein tyrosine phosphatase type IVA, member 1 |
| PTP4A3 | protein tyrosine phosphatase type IVA, member 3 |
| PTPN14 | protein tyrosine phosphatase, non-receptor type 14 |
| PTPN22 | protein tyrosine phosphatase, non-receptor type 22 |
| PTPN3 | protein tyrosine phosphatase, non-receptor type 3 |
| PTPN5 | protein tyrosine phosphatase, non-receptor type 5 |
| PTPRB | protein tyrosine phosphatase, receptor type B |
| PTPRE | protein tyrosine phosphatase, receptor type E |
| PTPRJ | protein tyrosine phosphatase, receptor type J |
| PTPRK | protein tyrosine phosphatase, receptor type K |
| PTPRM | protein tyrosine phosphatase, receptor type M |
| PTPRN | protein tyrosine phosphatase, receptor type N |
| PTPRO | protein tyrosine phosphatase, receptor type O |
| PTPRR | protein tyrosine phosphatase, receptor type R |
| PTPRT | protein tyrosine phosphatase, receptor type T |
| PTPRZ1 | protein tyrosine phosphatase, receptor type Z1 |
| PTTG1 | pituitary tumor-transforming 1 |
| PUDP | pseudouridine 5'-phosphatase |
| PURB | purine rich element binding protein B |
| PVALB | parvalbumin |
| PXDC1 | PX domain containing 1 |
| PXDN | peroxidasin |
| PXDNL | peroxidasin like |
| PXK | PX domain containing serine/threonine kinase like |
| PXN | paxillin |
| PXYLP1 | 2-phosphoxylose phosphatase 1 |

TABLE 1-continued

Gene symbols and names

| Symbol | Name |
| --- | --- |
| PYGM | glycogen phosphorylase, muscle associated |
| PYROXD2 | pyridine nucleotide-disulphide oxidoreductase domain 2 |
| QDPR | quinoid dihydropteridine reductase |
| Qk | quaking |
| QKI | QKI, KH domain containing RNA binding |
| QPRT | quinolinate phosphoribosyltransferase |
| RAB11FIP1 | RAB11 family interacting protein 1 |
| RAB15 | RAB15, member RAS oncogene family |
| RAB27A | RAB27A, member RAS oncogene family |
| RAB27B | RAB27B, member RAS oncogene family |
| RAB31 | RAB31, member RAS oncogene family |
| RAB33A | RAB33A, member RAS oncogene family |
| RAB34 | RAB34, member RAS oncogene family |
| RAB37 | RAB37, member RAS oncogene family |
| RAB3A | RAB3A, member RAS oncogene family |
| RAB3B | RAB3B, member RAS oncogene family |
| RAB3C | RAB3C, member RAS oncogene family |
| RAB6B | RAB6B, member RAS oncogene family |
| RAI2 | retinoic acid induced 2 |
| RALGPS2 | Ral GEF with PH domain and SH3 binding motif 2 |
| RALYL | RALY RNA binding protein like |
| RAMP1 | receptor activity modifying protein 1 |
| RAMP2 | receptor activity modifying protein 2 |
| RANBP2 | RAN binding protein 2 |
| RANBP3L | RAN binding protein 3 like |
| RAPGEF3 | Rap guanine nucleotide exchange factor 3 |
| RAPGEF4 | Rap guanine nucleotide exchange factor 4 |
| RARB | retinoic acid receptor beta |
| RASAL1 | RAS protein activator like 1 |
| RASAL2 | RAS protein activator like 2 |
| RASGEF1B | RasGEF domain family member 1B |
| RASGRF1 | Ras protein specific guanine nucleotide releasing factor 1 |
| RASGRP1 | RAS guanyl releasing protein 1 |
| RASGRP3 | RAS guanyl releasing protein 3 |
| RASIP1 | Ras interacting protein 1 |
| RASL11B | RAS like family 11 member B |
| RASL12 | RAS like family 12 |
| RASSF2 | Ras association domain family member 2 |
| RBFOX3 | RNA binding fox-1 homolog 3 |
| RBKS | ribokinase |
| RBM22 | RNA binding motif protein 22 |
| RBM24 | RNA binding motif protein 24 |
| RBM25 | RNA binding motif protein 25 |
| RBM7 | RNA binding motif protein 7 |
| RBMS3 | RNA binding motif single stranded interacting protein 3 |
| RBP2 | retinol binding protein 2 |
| RBPJL | recombination signal binding protein for immunoglobulin kappa J region like |
| RBPMS2 | RNA binding protein with multiple splicing 2 |
| RCAN2 | regulator of calcineurin 2 |
| RCN1 | reticulocalbin 1 |
| RCN2 | reticulocalbin 2 |
| RECK | reversion inducing cysteine rich protein with kazal motifs |
| REEP1 | receptor accessory protein 1 |
| RELN | reelin |
| REP15 | RAB15 effector protein |
| REPIN1 | replication initiator 1 |
| RERG | RAS like estrogen regulated growth inhibitor |
| RET | ret proto-oncogene |
| RETREG1 | reticulophagy regulator 1 |
| RFTN1 | raftlin, lipid raft linker 1 |
| RFX4 | regulatory factor X4 |
| RGCC | regulator of cell cycle |
| RGL3 | ral guanine nucleotide dissociation stimulator like 3 |
| RGMA | repulsive guidance molecule family member a |
| RGMB | repulsive guidance molecule family member b |
| RGS16 | regulator of G protein signaling 16 |
| RGS2 | regulator of G protein signaling 2 |
| RGS20 | regulator of G protein signaling 20 |
| RGS4 | regulator of G protein signaling 4 |
| RGS6 | regulator of G protein signaling 6 |
| RGS7BP | regulator of G protein signaling 7 binding protein |

TABLE 1-continued

Gene symbols and names

| Symbol | Name |
| --- | --- |
| RGS8 | regulator of G protein signaling 8 |
| RGS9 | regulator of G protein signaling 9 |
| RHBG | Rh family B glycoprotein (gene/pseudogene) |
| RHCG | Rh family C glycoprotein |
| RHEB | Ras homolog, mTORC1 binding |
| RHOB | ras homolog family member B |
| RHOBTB1 | Rho related BTB domain containing 1 |
| RHOBTB3 | Rho related BTB domain containing 3 |
| RHOD | ras homolog family member D |
| RHOJ | ras homolog family member J |
| RHOU | ras homolog family member U |
| RHPN2 | rhophilin Rho GTPase binding protein 2 |
| RIMBP2 | RIMS binding protein 2 |
| RIMS1 | regulating synaptic membrane exocytosis 1 |
| RIMS3 | regulating synaptic membrane exocytosis 3 |
| RIMS4 | regulating synaptic membrane exocytosis 4 |
| RIN2 | Ras and Rab interactor 2 |
| RIT2 | Ras like without CAAX 2 |
| RLBP1 | retinaldehyde binding protein 1 |
| RLF | rearranged L-myc fusion |
| RNF112 | ring finger protein 112 |
| RNF122 | ring finger protein 122 |
| RNF139 | ring finger protein 139 |
| RNF152 | ring finger protein 152 |
| RNF17 | ring finger protein 17 |
| RNF182 | ring finger protein 182 |
| RNF207 | ring finger protein 207 |
| RNF212 | ring finger protein 212 |
| RNF215 | ring finger protein 215 |
| RNF217 | ring finger protein 217 |
| RNF220 | ring finger protein 220 |
| RNF39 | ring finger protein 39 |
| RNF43 | ring finger protein 43 |
| ROBO2 | roundabout guidance receptor 2 |
| ROBO3 | roundabout guidance receptor 3 |
| RORA | RAR related orphan receptor A |
| RPA1 | replication protein A1 |
| RPH3A | rabphilin 3A |
| RPL10 | ribosomal protein L10 |
| RPL13 | ribosomal protein L13 |
| RPRM | reprimo, TP53 dependent G2 arrest mediator homolog |
| RPS4Y1 | ribosomal protein S4, Y-linked 1 |
| RPS6KA1 | ribosomal protein S6 kinase A1 |
| RPS6KA5 | ribosomal protein S6 kinase A5 |
| RPUSD3 | RNA pseudouridylate synthase domain containing 3 |
| RRNAD1 | ribosomal RNA adenine dimethylase domain containing 1 |
| RSPO1 | R-spondin 1 |
| RSPO2 | R-spondin 2 |
| RSPO4 | R-spondin 4 |
| RTL4 | retrotransposon Gag like 4 |
| RTN1 | reticulon 1 |
| RTN4R | reticulon 4 receptor |
| RTN4RL1 | reticulon 4 receptor like 1 |
| RTN4RL2 | reticulon 4 receptor like 2 |
| RUBCNL | RUN and cysteine rich domain containing beclin 1 interacting protein like |
| RUNX1T1 | RUNX1 translocation partner 1 |
| RUVBL2 | RuvB like AAA ATPase 2 |
| RXFP1 | relaxin/insulin like family peptide receptor 1 |
| RYR1 | ryanodine receptor 1 |
| RYR2 | ryanodine receptor 2 |
| RYR3 | ryanodine receptor 3 |
| S100A4 | S100 calcium binding protein A4 |
| S100B | S100 calcium binding protein B |
| S1PR1 | sphingosine-1-phosphate receptor 1 |
| S1PR5 | sphingosine-1-phosphate receptor 5 |
| SALL1 | spalt like transcription factor 1 |
| SAMD12 | sterile alpha motif domain containing 12 |
| SAMD9L | sterile alpha motif domain containing 9 like |
| SAPCD2 | suppressor APC domain containing 2 |
| SAT1 | spermidine/spermine N1-acetyltransferase 1 |
| SBDS | SBDS, ribosome maturation factor |
| SBNO2 | strawberry notch homolog 2 |

TABLE 1-continued

Gene symbols and names

| Symbol | Name |
| --- | --- |
| SCAMP5 | secretory carrier membrane protein 5 |
| SCARA3 | scavenger receptor class A member 3 |
| SCEL | sciellin |
| SCG3 | secretogranin III |
| SCGN | secretagogin, EF-hand calcium binding protein |
| SCHLAP1 | SWI/SNF complex antagonist associated with prostate cancer 1 (non-protein coding) |
| SCN1A | sodium voltage-gated channel alpha subunit 1 |
| SCN2A | sodium voltage-gated channel alpha subunit 2 |
| SCN2B | sodium voltage-gated channel beta subunit 2 |
| SCN4B | sodium voltage-gated channel beta subunit 4 |
| SCN9A | sodium voltage-gated channel alpha subunit 9 |
| SCNN1G | sodium channel epithelial 1 gamma subunit |
| SCRT1 | scratch family transcriptional repressor 1 |
| SCUBE1 | signal peptide, CUB domain and EGF like domain containing 1 |
| SDC1 | syndecan 1 |
| SDC3 | syndecan 3 |
| SDC4 | syndecan 4 |
| SDK1 | sidekick cell adhesion molecule 1 |
| SEC14L5 | SEC14 like lipid binding 5 |
| SEC24D | SEC24 homolog D, COPII coat complex component |
| SEL1L3 | SEL1L family member 3 |
| SELENOK | selenoprotein K |
| SELENOM | selenoprotein M |
| SELPLG | selectin P ligand |
| SEMA3B | semaphorin 3B |
| SEMA3C | semaphorin 3C |
| SEMA3D | semaphorin 3D |
| SEMA3E | semaphorin 3E |
| SEMA3G | semaphorin 3G |
| SEMA4D | semaphorin 4D |
| SEMA4G | semaphorin 4G |
| SEMA5A | semaphorin 5A |
| SEMA5B | semaphorin 5B |
| SEMA6A | semaphorin 6A |
| SEMA6D | semaphorin 6D |
| SEPSECS | Sep (O-phosphoserine) tRNA:Sec (selenocysteine) tRNA synthase |
| SEPT4 | septin 4 |
| SEPT7 | septin 7 |
| SERINC2 | serine incorporator 2 |
| SERP1 | stress associated endoplasmic reticulum protein 1 |
| SERPINB1 | serpin family B member 1 |
| Serpinb1a | serine (or cysteine) peptidase inhibitor, clade B, member 1a |
| SERPINE2 | serpin family E member 2 |
| SERPINH1 | serpin family H member 1 |
| SERPINI1 | serpin family I member 1 |
| SERPINI2 | serpin family I member 2 |
| SERTM1 | serine rich and transmembrane domain containing 1 |
| SESTD1 | SEC14 and spectrin domain containing 1 |
| SETBP1 | SET binding protein 1 |
| SEZ6L2 | seizure related 6 homolog like 2 |
| SF3B4 | splicing factor 3b subunit 4 |
| SFXN5 | sideroflexin 5 |
| SGCA | sarcoglycan alpha |
| SGCD | sarcoglycan delta |
| SGK2 | SGK2, serine/threonine kinase 2 |
| SGMS2 | sphingomyelin synthase 2 |
| SH2B2 | SH2B adaptor protein 2 |
| SH2D1A | SH2 domain containing 1A |
| SH2D4B | SH2 domain containing 4B |
| SH3BGRL2 | SH3 domain binding glutamate rich protein like 2 |
| SH3BP2 | SH3 domain binding protein 2 |
| SH3BP4 | SH3 domain binding protein 4 |
| SH3D19 | SH3 domain containing 19 |
| SH3GL3 | SH3 domain containing GRB2 like 3, endophilin A3 |
| SH3RF1 | SH3 domain containing ring finger 1 |
| SH3RF3 | SH3 domain containing ring finger 3 |
| SH3TC2 | SH3 domain and tetratricopeptide repeats 2 |
| SHANK1 | SH3 and multiple ankyrin repeat domains 1 |
| SHANK2 | SH3 and multiple ankyrin repeat domains 2 |
| SHANK3 | SH3 and multiple ankyrin repeat domains 3 |

TABLE 1-continued

Gene symbols and names

| Symbol | Name |
|---|---|
| SHC3 | SHC adaptor protein 3 |
| SHC4 | SHC adaptor protein 4 |
| SHF | Src homology 2 domain containing F |
| SHISA6 | shisa family member 6 |
| SHISA7 | shisa family member 7 |
| SHISA8 | shisa family member 8 |
| SHROOM2 | shroom family member 2 |
| SHROOM3 | shroom family member 3 |
| SHROOM4 | shroom family member 4 |
| SHTN1 | shootin 1 |
| SIAH2 | siah E3 ubiquitin protein ligase 2 |
| SIAH3 | siah E3 ubiquitin protein ligase family member 3 |
| SIDT1 | SID1 transmembrane family member 1 |
| SIK3 | SIK family kinase 3 |
| SIPA1L1 | signal induced proliferation associated 1 like 1 |
| SIPA1L2 | signal induced proliferation associated 1 like 2 |
| SIPA1L3 | signal induced proliferation associated 1 like 3 |
| SIRPA | signal regulatory protein alpha |
| SIX4 | SIX homeobox 4 |
| SKAP2 | src kinase associated phosphoprotein 2 |
| SKOR1 | SKI family transcriptional corepressor 1 |
| SKOR2 | SKI family transcriptional corepressor 2 |
| SLC12A2 | solute carrier family 12 member 2 |
| SLC12A3 | solute carrier family 12 member 3 |
| SLC12A4 | solute carrier family 12 member 4 |
| SLC12A5 | solute carrier family 12 member 5 |
| SLC12A8 | solute carrier family 12 member 8 |
| SLC13A1 | solute carrier family 13 member 1 |
| SLC13A5 | solute carrier family 13 member 5 |
| SLC14A1 | solute carrier family 14 member 1 (Kidd blood group) |
| SLC14A2 | solute carrier family 14 member 2 |
| SLC15A2 | solute carrier family 15 member 2 |
| SLC16A10 | solute carrier family 16 member 10 |
| SLC17A4 | solute carrier family 17 member 4 |
| SLC17A7 | solute carrier family 17 member 7 |
| SLC18A3 | solute carrier family 18 member A3 |
| SLC19A1 | solute carrier family 19 member 1 |
| SLC19A2 | solute carrier family 19 member 2 |
| SLC1A1 | solute carrier family 1 member 1 |
| SLC1A3 | solute carrier family 1 member 3 |
| SLC1A4 | solute carrier family 1 member 4 |
| SLC1A6 | solute carrier family 1 member 6 |
| SLC20A1 | solute carrier family 20 member 1 |
| SLC22A15 | solute carrier family 22 member 15 |
| SLC22A23 | solute carrier family 22 member 23 |
| SLC22A4 | solute carrier family 22 member 4 |
| SLC22A6 | solute carrier family 22 member 6 |
| SLC22A8 | solute carrier family 22 member 8 |
| SLC24A3 | solute carrier family 24 member 3 |
| SLC24A4 | solute carrier family 24 member 4 |
| SLC25A18 | solute carrier family 25 member 18 |
| SLC25A29 | solute carrier family 25 member 29 |
| SLC25A3 | solute carrier family 25 member 3 |
| SLC25A33 | solute carrier family 25 member 33 |
| SLC25A6 | solute carrier family 25 member 6 |
| SLC26A3 | solute carrier family 26 member 3 |
| SLC26A5 | solute carrier family 26 member 5 |
| SLC26A8 | solute carrier family 26 member 8 |
| SLC27A6 | solute carrier family 27 member 6 |
| SLC2A10 | solute carrier family 2 member 10 |
| SLC2A13 | solute carrier family 2 member 13 |
| SLC2A3 | solute carrier family 2 member 3 |
| SLC2A4 | solute carrier family 2 member 4 |
| SLC30A3 | solute carrier family 30 member 3 |
| SLC31A2 | solute carrier family 31 member 2 |
| SLC32A1 | solute carrier family 32 member 1 |
| SLC35D1 | solute carrier family 35 member D1 |
| SLC35F1 | solute carrier family 35 member F1 |
| SLC35F4 | solute carrier family 35 member F4 |
| SLC38A1 | solute carrier family 38 member 1 |
| SLC38A10 | solute carrier family 38 member 10 |
| SLC38A5 | solute carrier family 38 member 5 |
| SLC38A7 | solute carrier family 38 member 7 |
| SLC39A12 | solute carrier family 39 member 12 |
| SLC41A1 | solute carrier family 41 member 1 |

TABLE 1-continued

Gene symbols and names

| Symbol | Name |
|---|---|
| SLC43A2 | solute carrier family 43 member 2 |
| SLC43A3 | solute carrier family 43 member 3 |
| SLC44A5 | solute carrier family 44 member 5 |
| SLC45A1 | solute carrier family 45 member 1 |
| SLC45A3 | solute carrier family 45 member 3 |
| SLC4A4 | solute carrier family 4 member 4 |
| SLC4A7 | solute carrier family 4 member 7 |
| SLC5A11 | solute carrier family 5 member 11 |
| SLC5A4 | solute carrier family 5 member 4 |
| SLC5A7 | solute carrier family 5 member 7 |
| SLC5A8 | solute carrier family 5 member 8 |
| SLC6A12 | solute carrier family 6 member 12 |
| SLC6A13 | solute carrier family 6 member 13 |
| SLC6A3 | solute carrier family 6 member 3 |
| SLC6A7 | solute carrier family 6 member 7 |
| SLC7A1 | solute carrier family 7 member 1 |
| SLC7A10 | solute carrier family 7 member 10 |
| SLC7A11 | solute carrier family 7 member 11 |
| SLC7A14 | solute carrier family 7 member 14 |
| SLC7A3 | solute carrier family 7 member 3 |
| SLC7A5 | solute carrier family 7 member 5 |
| SLC8A1 | solute carrier family 8 member A1 |
| SLC8A1-AS1 | SLC8A1 antisense RNA 1 |
| SLC8A2 | solute carrier family 8 member A2 |
| SLC8A3 | solute carrier family 8 member A3 |
| SLC8B1 | solute carrier family 8 member B1 |
| SLC9A3 | solute carrier family 9 member A3 |
| SLC9A9 | solute carrier family 9 member A9 |
| SLCO2B1 | solute carrier organic anion transporter family member 2B1 |
| SLCO4A1 | solute carrier organic anion transporter family member 4A1 |
| SLCO4C1 | solute carrier organic anion transporter family member 4C1 |
| SLFN11 | schlafen family member 11 |
| SLIT2 | slit guidance ligand 2 |
| SLIT3 | slit guidance ligand 3 |
| SLITRK1 | SLIT and NTRK like family member 1 |
| SLITRK6 | SLIT and NTRK like family member 6 |
| SMAD3 | SMAD family member 3 |
| SMAD7 | SMAD family member 7 |
| SMIM17 | small integral membrane protein 17 |
| SMOC1 | SPARC related modular calcium binding 1 |
| SMPX | small muscle protein, X-linked |
| SNAI2 | snail family transcriptional repressor 2 |
| SNAI3-AS1 | SNAI3 antisense RNA 1 |
| SNAPC1 | small nuclear RNA activating complex polypeptide 1 |
| SNCAIP | synuclein alpha interacting protein |
| SNED1 | sushi, nidogen and EGF like domains 1 |
| SNHG5 | small nucleolar RNA host gene 5 |
| SNTB1 | syntrophin beta 1 |
| SNX22 | sorting nexin 22 |
| SNX33 | sorting nexin 33 |
| SOAT1 | sterol O-acyltransferase 1 |
| SOBP | sine oculis binding protein homolog |
| SOCS2 | suppressor of cytokine signaling 2 |
| SOD1 | superoxide dismutase 1 |
| SOD3 | superoxide dismutase 3 |
| SORBS2 | sorbin and SH3 domain containing 2 |
| SORBS3 | sorbin and SH3 domain containing 3 |
| SORCS3 | sortilin related VPS10 domain containing receptor 3 |
| SOS1 | SOS Ras/Rac guanine nucleotide exchange factor 1 |
| SOX10 | SRY-box 10 |
| SOX13 | SRY-box 13 |
| Sox1ot | Sox1 overlapping transcript |
| SOX2 | SRY-box 2 |
| SOX6 | SRY-box 6 |
| SOX8 | SRY-box 8 |
| SOX9 | SRY-box 9 |
| SP5 | Sp5 transcription factor |
| SPAG5 | sperm associated antigen 5 |
| SPAG9 | sperm associated antigen 9 |
| SPARC | secreted protein acidic and cysteine rich |
| SPARCL1 | SPARC like 1 |
| SPATA13 | spermatogenesis associated 13 |

TABLE 1-continued

| Gene symbols and names | |
| --- | --- |
| Symbol | Name |
| SPATA9 | spermatogenesis associated 9 |
| SPATC1 | spermatogenesis and centriole associated 1 |
| SPECC1 | sperm antigen with calponin homology and coiled-coil domains 1 |
| SPEG | SPEG complex locus |
| SPHK2 | sphingosine kinase 2 |
| SPHKAP | SPHK1 interactor, AKAP domain containing |
| SPOCK3 | SPARC/osteonectin, cwcv and kazal like domains proteoglycan 3 |
| SPON1 | spondin 1 |
| SPON2 | spondin 2 |
| SPP1 | secreted phosphoprotein 1 |
| SPRED3 | sprouty related EVH1 domain containing 3 |
| SPRY4-AS1 | SPRY4 antisense RNA 1 |
| SPSB4 | splA/ryanodine receptor domain and SOCS box containing 4 |
| SPTB | spectrin beta, erythrocytic |
| SPTBN2 | spectrin beta, non-erythrocytic 2 |
| SPTY2D1 | SPT2 chromatin protein domain containing 1 |
| SRC | SRC proto-oncogene, non-receptor tyrosine kinase |
| SRCIN1 | SRC kinase signaling inhibitor 1 |
| SRGAP1 | SLIT-ROBO Rho GTPase activating protein 1 |
| SRGN | serglycin |
| SRPX | sushi repeat containing protein, X-linked |
| SRRM4 | serine/arginine repetitive matrix 4 |
| SRSF3 | serine and arginine rich splicing factor 3 |
| SSH1 | slingshot protein phosphatase 1 |
| SSTR1 | somatostatin receptor 1 |
| SSTR2 | somatostatin receptor 2 |
| ST13 | ST13, Hsp70 interacting protein |
| ST18 | ST18, C2H2C-type zinc finger |
| ST3GAL2 | ST3 beta-galactoside alpha-2,3-sialyltransferase 2 |
| ST3GAL5 | ST3 beta-galactoside alpha-2,3-sialyltransferase 5 |
| ST5 | suppression of tumorigenicity 5 |
| ST6GAL2 | ST6 beta-galactoside alpha-2,6-sialyltransferase 2 |
| ST6GALNAC3 | ST6 N-acetylgalactosaminide alpha-2,6-sialyltransferase 3 |
| ST6GALNAC5 | ST6 N-acetylgalactosaminide alpha-2,6-sialyltransferase 5 |
| STAB2 | stabilin 2 |
| STAC | SH3 and cysteine rich domain |
| STAC2 | SH3 and cysteine rich domain 2 |
| STAG3 | stromal antigen 3 |
| STAMBPL1 | STAM binding protein like 1 |
| STARD13 | StAR related lipid transfer domain containing 13 |
| STARD8 | StAR related lipid transfer domain containing 8 |
| STAT2 | signal transducer and activator of transcription 2 |
| STAT5A | signal transducer and activator of transcription 5A |
| STC2 | stanniocalcin 2 |
| STEAP3 | STEAP3 metalloreductase |
| STIP1 | stress induced phosphoprotein 1 |
| STK17B | serine/threonine kinase 17b |
| STK19 | serine/threonine kinase 19 |
| STK3 | serine/threonine kinase 3 |
| STK32A | serine/threonine kinase 32A |
| STK32B | serine/threonine kinase 32B |
| STK33 | serine/threonine kinase 33 |
| STK38L | serine/threonine kinase 38 like |
| STMN4 | stathmin4 |
| STON1 | stonin 1 |
| STON2 | stonin 2 |
| STOX2 | storkhead box 2 |
| STRAP | serine/threonine kinase receptor associated protein |
| STRC | stereocilin |
| SIRIP2 | striatin interacting protein 2 |
| STRN | striatin |
| STUM | stum, mechanosensory transduction mediator homolog |
| STX17 | syntaxin 17 |
| STXBP2 | syntaxin binding protein 2 |
| STXBP3 | syntaxin binding protein 3 |
| SULF2 | sulfatase 2 |
| SURF2 | surfeit 2 |
| SUSD5 | sushi domain containing 5 |
| SUSD6 | sushi domain containing 6 |
| SV2B | synaptic vesicle glycoprotein 2B |

TABLE 1-continued

| Gene symbols and names | |
| --- | --- |
| Symbol | Name |
| SV2C | synaptic vesicle glycoprotein 2C |
| SVEP1 | sushi, von Willebrand factor type A, EGF and pentraxin domain containing 1 |
| SVIL | supervillin |
| SVOP | SV2 related protein |
| SWAP70 | switching B-cell complex subunit SWAP70 |
| SYAP1 | synapse associated protein 1 |
| SYCP1 | synaptonemal complex protein 1 |
| SYN3 | synapsin III |
| SYNDIG1 | synapse differentiation inducing 1 |
| SYNDIG1L | synapse differentiation inducing 1 like |
| SYNJ2 | synaptojanin 2 |
| SYNPR | synaptoporin |
| SYT10 | synaptotagmin 10 |
| SYT12 | synaptotagmin 12 |
| SYT14 | synaptotagmin 14 |
| SYT16 | synaptotagmin 16 |
| SYT17 | synaptotagmin 17 |
| SYT2 | synaptotagmin 2 |
| SYT3 | synaptotagmin 3 |
| SYT4 | synaptotagmin 4 |
| SYT7 | synaptotagmin 7 |
| TANC1 | tetratricopeptide repeat, ankyrin repeat and coiled-coil containing 1 |
| TAOK2 | TAO kinase 2 |
| TAOK3 | TAO kinase 3 |
| TBC1D1 | TBC1 domain family member 1 |
| TBC1D4 | TBC1 domain family member 4 |
| TBC1D5 | TBC1 domain family member 5 |
| TBCEL | tubulin folding cofactor E like |
| TBL1X | transducin beta like 1X-linked |
| TBR1 | T-box, brain 1 |
| TBXAS1 | thromboxane A synthase 1 |
| TCEAL2 | transcription elongation factor A like 2 |
| TCEAL5 | transcription elongation factor A like 5 |
| TCEAL6 | transcription elongation factor A like 6 |
| TCEAL7 | transcription elongation factor A like 7 |
| TCEAL9 | transcription elongation factor A like 9 |
| TCERG1L | transcription elongation regulator 1 like |
| TCF7L1 | transcription factor 7 like 1 |
| TCP1 | t-complex 1 |
| TCP11L2 | t-complex 11 like 2 |
| TCTE1 | t-complex-associated-testis-expressed 1 |
| TCTEX1D1 | Tctex1 domain containing 1 |
| TDP1 | tyrosyl-DNA phosphodiesterase 1 |
| TEAD1 | TEA domain transcription factor 1 |
| TEAD4 | TEA domain transcription factor 4 |
| TEC | tec protein tyrosine kinase |
| TEK | TEK receptor tyrosine kinase |
| TES | testin LIM domain protein |
| TESC | tescalcin |
| TEX14 | testis expressed 14, intercellular bridge forming factor |
| TEX2 | testis expressed 2 |
| TEX36 | testis expressed 36 |
| TEX52 | testis expressed 52 |
| TEX9 | testis expressed 9 |
| TF | transferrin |
| TFAP2A | transcription factor AP-2 alpha |
| TFAP2B | transcription factor AP-2 beta |
| TFRC | transferrin receptor |
| TG | thyroglobulin |
| TGFB2 | transforming growth factor beta 2 |
| TGFB3 | transforming growth factor beta 3 |
| TGFBR2 | transforming growth factor beta receptor 2 |
| TH | tyrosine hydroxylase |
| THBS2 | thrombospondin 2 |
| THBS4 | thrombospondin 4 |
| THSD7B | thrombospondin type 1 domain containing 7B |
| THYN1 | thymocyte nuclear protein 1 |
| TIMP3 | TIMP metallopeptidase inhibitor 3 |
| TIPARP | TCDD inducible poly(ADP-ribose) polymerase |
| TLCD1 | TLC domain containing 1 |
| TLE4 | transducin like enhancer of split 4 |
| TLE6 | transducin like enhancer of split 6 |
| TLL1 | tolloid like 1 |

TABLE 1-continued

Gene symbols and names

| Symbol | Name |
| --- | --- |
| TLR3 | toll like receptor 3 |
| TLR4 | toll like receptor 4 |
| TM2D2 | TM2 domain containing 2 |
| TM4SF1 | transmembrane 4 L six family member 1 |
| TMC1 | transmembrane channel like 1 |
| TMC3-AS1 | TMC3 antisense RNA 1 |
| TMC7 | transmembrane channel like 7 |
| TMEM100 | transmembrane protein 100 |
| TMEM108 | transmembrane protein 108 |
| TMEM123 | transmembrane protein 123 |
| TMEM125 | transmembrane protein 125 |
| TMEM130 | transmembrane protein 130 |
| Tmem131 | transmembrane protein 131 |
| TMEM131L | transmembrane 131 like |
| TMEM132B | transmembrane protein 132B |
| TMEM132C | transmembrane protein 132C |
| TMEM132D | transmembrane protein 132D |
| TMEM132E | transmembrane protein 132E |
| TMEM144 | transmembrane protein 144 |
| TMEM150C | transmembrane protein 150C |
| TMEM163 | transmembrane protein 163 |
| TMEM175 | transmembrane protein 175 |
| TMEM176A | transmembrane protein 176A |
| TMEM176B | transmembrane protein 176B |
| Tmem178 | transmembrane protein 178 |
| TMEM178A | transmembrane protein 178A |
| TMEM178B | transmembrane protein 178B |
| TMEM179 | transmembrane protein 179 |
| TMEM184C | transmembrane protein 184C |
| TMEM198 | transmembrane protein 198 |
| TMEM2 | transmembrane protein 2 |
| TMEM200A | transmembrane protein 200A |
| TMEM252 | transmembrane protein 252 |
| TMEM254 | transmembrane protein 254 |
| TMEM255A | transmembrane protein 255A |
| TMEM255B | transmembrane protein 255B |
| TMEM266 | transmembrane protein 266 |
| TMEM270 | transmembrane protein 270 |
| TMEM44 | transmembrane protein 44 |
| TMEM51 | transmembrane protein 51 |
| TMEM63A | transmembrane protein 63A |
| TMEM88B | transmembrane protein 88B |
| TMEM98 | transmembrane protein 98 |
| TMOD1 | tropomodulin 1 |
| TMPRSS5 | transmembrane protease, serine 5 |
| TMTC1 | transmembrane and tetratricopeptide repeat containing 1 |
| TMTC4 | transmembrane and tetratricopeptide repeat containing 4 |
| TNC | tenascin C |
| TNFAIP6 | TNF alpha induced protein 6 |
| TNFRSF13C | TNF receptor superfamily member 13C |
| TNFRSF19 | TNF receptor superfamily member 19 |
| TNFSF9 | TNF superfamily member 9 |
| TNK2 | tyrosine kinase non receptor 2 |
| TNNI1 | troponin I1, slow skeletal type |
| TNR | tenascin R |
| TNS1 | tensin 1 |
| TNS3 | tensin 3 |
| TOB1 | transducer of ERBB2, 1 |
| TOGARAM2 | TOG array regulator of axonemal microtubules 2 |
| TOM1L1 | target of myb1 like 1 membrane trafficking protein |
| TOP1 | DNA topoisomerase I |
| TOX2 | TOX high mobility group box family member 2 |
| TOX3 | TOX high mobility group box family member 3 |
| TP53I11 | tumor protein p53 inducible protein 11 |
| TP53INP2 | tumor protein p53 inducible nuclear protein 2 |
| TP73 | tumor protein p73 |
| TPCN1 | two pore segment channel 1 |
| TPM3 | tropomyosin 3 |
| TPM4 | tropomyosin 4 |
| TPPP | tubulin polymerization promoting protein |
| TPT1 | tumor protein, translationally-controlled 1 |
| TRA2B | transformer 2 beta homolog |
| TRABD2B | TraB domain containing 2B |
| TRAF1 | TNF receptor associated factor 1 |

TABLE 1-continued

Gene symbols and names

| Symbol | Name |
| --- | --- |
| TRAF4 | TNF receptor associated factor 4 |
| TRAF5 | TNF receptor associated factor 5 |
| TRDN | triadin |
| TREH | trehalase |
| TREM2 | triggering receptor expressed on myeloid cells 2 |
| TRHDE | thyrotropin releasing hormone degrading enzyme |
| TRIL | TLR4 interactor with leucine rich repeats |
| TRIM15 | tripartite motif containing 15 |
| TRIM2 | tripartite motif containing 2 |
| TRIM26 | tripartite motif containing 26 |
| Trim30a | tripartite motif-containing 30A |
| TRIM36 | tripartite motif containing 36 |
| TRIM5 | tripartite motif containing 5 |
| TRIM59 | tripartite motif containing 59 |
| TRIM62 | tripartite motif containing 62 |
| TRIM67 | tripartite motif containing 67 |
| Trp53cor1 | tumor protein p53 pathway corepressor 1 |
| TRPC3 | transient receptor potential cation channel subfamily C member 3 |
| TRPC5 | transient receptor potential cation channel subfamily C member 5 |
| TRPC6 | transient receptor potential cation channel subfamily C member 6 |
| TRPC7 | transient receptor potential cation channel subfamily C member 7 |
| TRPM2 | transient receptor potential cation channel subfamily M member 2 |
| TRPV3 | transient receptor potential cation channel subfamily V member 3 |
| TRPV6 | transient receptor potential cation channel subfamily V member 6 |
| TSC22D2 | TSC22 domain family member 2 |
| TSC22D3 | TSC22 domain family member 3 |
| TSG1 | N/A |
| TSHB | thyroid stimulating hormone beta |
| TSHZ2 | teashirt zinc finger homeobox 2 |
| TSIX | TSIX transcript, XIST antisense RNA |
| TSPAN11 | tetraspanin 11 |
| TSPAN14 | tetraspanin 14 |
| TSPAN15 | tetraspanin 15 |
| TSPAN18 | tetraspanin 18 |
| TSPAN2 | tetraspanin 2 |
| TSPAN5 | tetraspanin 5 |
| TSPAN6 | tetraspanin 6 |
| TSPOAP1 | TSPO associated protein 1 |
| TSTD2 | thiosulfate sulfurtransferase like domain containing 2 |
| TTC23L | tetratricopeptide repeat domain 23 like |
| TTC28 | tetratricopeptide repeat domain 28 |
| TTC32 | tetratricopeptide repeat domain 32 |
| TTLL3 | tubulin tyrosine ligase like 3 |
| TTLL5 | tubulin tyrosine ligase like 5 |
| TTPA | alpha tocopherol transfer protein |
| TTTY10 | testis-specific transcript, Y-linked 10 (non-protein coding) |
| TTTY14 | testis-specific transcript, Y-linked 14 (non-protein coding) |
| TTTY15 | testis-specific transcript, Y-linked 15 (non-protein coding) |
| TTYH3 | tweety family member 3 |
| TUBA8 | tubulin alpha 8 |
| TUBB2B | tubulin beta 2B class IIb |
| TUBB4A | tubulin beta 4A class IVa |
| TULP3 | tubby like protein 3 |
| TUNAR | TCL1 upstream neural differentiation-associated RNA |
| TUSC3 | tumor suppressor candidate 3 |
| TWISTNB | TWIST neighbor |
| TXLNGY | taxilin gamma pseudogene, Y-linked |
| TXNIP | thioredoxin interacting protein |
| TXNL4A | thioredoxin like 4A |
| TYMS | thymidylate synthetase |
| U2AF1 | U2 small nuclear RNA auxiliary factor 1 |
| UAP1 | UDP-N-acetylglucosamine pyrophosphorylase 1 |
| UBASH3B | ubiquitin associated and SH3 domain containing B |
| UBB | ubiquitin B |

TABLE 1-continued

Gene symbols and names

| Symbol | Name |
| --- | --- |
| UBC | ubiquitin C |
| UBE2B | ubiquitin conjugating enzyme E2 B |
| UBE2QL1 | ubiquitin conjugating enzyme E2 Q family like 1 |
| UBE4A | ubiquitination factor E4A |
| UCP2 | uncoupling protein 2 |
| UFL1 | UFM1 specific ligase 1 |
| UFSP2 | UFM1 specific peptidase 2 |
| UGGT2 | UDP-glucose glycoprotein glucosyltansferase 2 |
| UGT8 | UDP glycosyltransferase 8 |
| Ugt8a | UDP galactosyltransferase 8A |
| UNC13C | unc-13 homolog C |
| UNC5B | unc-5 netrin receptor B |
| UNC5D | unc-5 netrin receptor D |
| UNC80 | unc-80 homolog NALCN channel complex subunit |
| UNCX | UNC homeobox |
| UPP1 | undine phosphorylase 1 |
| USP11 | ubiquitin specific peptidase 11 |
| USP28 | ubiquitin specific peptidase 28 |
| USP37 | ubiquitin specific peptidase 37 |
| USP4 | ubiquitin specific peptidase 4 |
| USP43 | ubiquitin specific peptidase 43 |
| USP9Y | ubiquitin specific peptidase 9, Y-linked |
| USPL1 | ubiquitin specific peptidase like 1 |
| UTY | ubiquitously transcribed tetratricopeptide repeat containing, Y-linked |
| VAMP1 | vesicle associated membrane protein 1 |
| VAT1L | vesicle amine transport 1 like |
| VAV2 | vav guanine nucleotide exchange factor 2 |
| VAX2 | ventral anterior homeobox 2 |
| VCAN | versican |
| VGLL4 | vestigial like family member 4 |
| VIM | vimentin |
| VIP | vasoactive intestinal peptide |
| VIPR2 | vasoactive intestinal peptide receptor 2 |
| VIT | vitrin |
| VMP1 | vacuole membrane protein 1 |
| VPS37B | VPS37B, ESCRT-I subunit |
| VSIG2 | V-set and immunoglobulin domain containing 2 |
| VSIG8 | V-set and immunoglobulin domain containing 8 |
| VSNL1 | visinin like 1 |
| VSTM2B | V-set and transmembrane domain containing 2B |
| VTN | vitronectin |
| VWA5A | von Willebrand factor A domain containing 5A |
| VWA5B2 | von Willebrand factor A domain containing 5B2 |
| VWC2 | von Willebrand factor C domain containing 2 |
| WASH7P | WAS protein family homolog 7 pseudogene |
| WDR17 | WD repeat domain 17 |
| WDR45B | WD repeat domain 45B |
| WDR49 | WD repeat domain 49 |
| WDR66 | WD repeat domain 66 |
| WFDC1 | WAP four-disulfide core domain 1 |
| WFS1 | wolframin ER transmembrane glycoprotein |
| WIF1 | WNT inhibitory factor 1 |
| WIPI1 | WD repeat domain, phosphoinositide interacting 1 |
| WLS | wntless Wnt ligand secretion mediator |
| WNT6 | Wnt family member 6 |
| WNT7A | Wnt family member 7A |
| WNT7B | Wnt family member 7B |
| WSCD1 | WSC domain containing 1 |
| WSCD2 | WSC domain containing 2 |
| WWC1 | WW and C2 domain containing 1 |
| WWC2 | WW and C2 domain containing 2 |
| XIST | X inactive specific transcript (non-protein coding) |
| XKR7 | XK related 7 |
| XRRA1 | X-ray radiation resistance associated 1 |
| XYLT1 | xylosyltransferase 1 |
| YBX2 | Y-box binding protein 2 |
| YES1 | YES proto-oncogene 1, Src family tyrosine kinase |
| YIPF5 | Yip1 domain family member 5 |
| YIPF7 | Yip1 domain family member 7 |
| ZBTB16 | zinc finger and BTB domain containing 16 |
| ZBTB21 | zinc finger and BTB domain containing 21 |
| ZBTB46 | zinc finger and BTB domain containing 46 |
| ZCCHC24 | zinc finger CCHC-type containing 24 |
| ZDHHC14 | zinc finger DHHC-type containing 14 |

TABLE 1-continued

Gene symbols and names

| Symbol | Name |
| --- | --- |
| ZDHHC2 | zinc finger DHHC-type containing 2 |
| ZDHHC23 | zinc finger DHHC-type containing 23 |
| ZEB2 | zinc finger E-box binding homeobox 2 |
| ZFAND2A | zinc finger AN1-type containing 2A |
| ZFAND5 | zinc finger AN1-type containing 5 |
| ZFAND6 | zinc finger AN1-type containing 6 |
| ZFHX4 | zinc finger homeobox 4 |
| ZFP36L1 | ZFP36 ring finger protein like 1 |
| Zfp385c | zinc finger protein 385C |
| Zfp395 | zinc finger protein 395 |
| Zfp423 | zinc finger protein 423 |
| Zfp462 | zinc finger protein 462 |
| Zfp521 | zinc finger protein 521 |
| Zfp608 | zinc finger protein 608 |
| Zfp804b | zinc finger protein 804B |
| Zfp831 | zinc finger protein 831 |
| ZFPM1 | zinc finger protein, FOG family member 1 |
| ZFPM2 | zinc finger protein, FOG family member 2 |
| ZFX | zinc finger protein, X-linked |
| ZFY | zinc finger protein, Y-linked |
| ZIC1 | Zic family member 1 |
| ZIC2 | Zic family member 2 |
| ZIC3 | Zic family member 3 |
| ZIC4 | Zic family member 4 |
| ZIC5 | Zic family member 5 |
| ZKSCAN1 | zinc finger with KRAB and SCAN domains 1 |
| ZMAT4 | zinc finger matrin-type 4 |
| ZNF10 | zinc finger protein 10 |
| ZNF124 | zinc finger protein 124 |
| ZNF131 | zinc finger protein 131 |
| ZNF141 | zinc finger protein 141 |
| ZNF184 | zinc finger protein 184 |
| ZNF212 | zinc finger protein 212 |
| ZNF219 | zinc finger protein 219 |
| ZNF253 | zinc finger protein 253 |
| ZNF304 | zinc finger protein 304 |
| ZNF331 | zinc finger protein 331 |
| ZNF385C | zinc finger protein 385C |
| ZNF395 | zinc finger protein 395 |
| ZNF404 | zinc finger protein 404 |
| ZNF423 | zinc finger protein 423 |
| ZNF462 | zinc finger protein 462 |
| ZNF496 | zinc finger protein 496 |
| ZNF521 | zinc finger protein 521 |
| ZNF546 | zinc finger protein 546 |
| ZNF580 | zinc finger protein 580 |
| ZNF585A | zinc finger protein 585A |
| ZNF607 | zinc finger protein 607 |
| ZNF608 | zinc finger protein 608 |
| ZNF703 | zinc finger protein 703 |
| ZNF711 | zinc finger protein 711 |
| ZNF736 | zinc finger protein 736 |
| ZNF804B | zinc finger protein 804B |
| ZNF831 | zinc finger protein 831 |
| ZNF84 | zinc finger protein 84 |
| ZNF891 | zinc finger protein 891 |
| ZNHIT1 | zinc finger HIT-type containing 1 |
| ZNRD1 | zinc ribbon domain containing 1 |
| ZNRF1 | zinc and ring finger 1 |
| ZP2 | zona pellucida glycoprotein 2 |
| ZSCAN29 | zinc finger and SCAN domain containing 29 |
| ZSCAN30 | zinc finger and SCAN domain containing 30 |
| ZSWIM6 | zinc finger SWIM-type containing 6 |
| ZYG11A | zyg-11 family member A, cell cycle regulator |
| ZYX | zyxin |
| Hpcal1 | hippocalcin-like 1 |
| Icmt | isoprenylcysteine carboxyl methyltransferase |
| Id2 | inhibitor of DNA binding 2 |
| Ifitm7 | interferon induced transmembrane protein 7 |
| Kalm | kalirin, RhoGEF kinase |
| Kcnd2 | potassium voltage-gated channel, Shal-related family, member 2 |
| Kcnj6 | potassium inwardly-rectifying channel, subfamily J, member 6 |
| Kcnk12 | potassium channel, subfamily K, member 12 |
| Kcnk9 | potassium channel, subfamily K, member 9 |

TABLE 1-continued

Gene symbols and names

| Symbol | Name |
|---|---|
| Kcns2 | K+ voltage-gated channel, subfamily S, 2 |
| Kirrel3 | kin of IRRE like 3 (*Drosophila*) |
| Lhfpl3 | lipoma HMGIC fusion partner-like 3 |
| Lhfpl3 | lipoma HMGIC fusion partner-like 3 |
| Limd1 | LIM domains containing 1 |
| Lrp8 | low density lipoprotein receptor-related protein 8, apolipoprotein e receptor |
| Mbp | myelin basic protein |
| Mir124a-1hg | Mir124-1 host gene (non-protein coding) |
| Mir6390 | microRNA 6390 |
| Mmp16 | matrix metallopeptidase 16 |
| Mt1 | metallothionein 1 |
| Mt2 | metallothionein 2 |
| Mthfd2 | methylenetetrahydrofolate dehydrogenase (NAD+ dependent), methenyltetrahydrofolate cyclohydrolase |
| Myrip | myosin VIIA and Rab interacting protein |
| Myt1l | myelin transcription factor 1-like |
| Nat8 | N-acetyltransferase 8 (GCN5-related) |
| Neat1 | nuclear paraspeckle assembly transcript 1 (non-protein coding) |
| Nhlrc4 | NHL repeat containing 4 |
| Nhsl2 | NHS-like 2 |
| Nos1 | nitric oxide synthase 1, neuronal |
| Nrep | neuronal regeneration related protein |
| Nrn1 | neuritin 1 |
| Nxph1 | neurexophilin 1 |
| Olfm2 | olfactomedin 2 |
| Opcml | opioid binding protein/cell adhesion molecule-like |
| Pagr1a | PAXIP1 associated glutamate rich protein 1A |
| Patj | PATJ, crumbs cell polarity complex component |
| Pcdh7 | protocadherin 7 |
| Phlda1 | pleckstrin homology like domain, family A, member 1 |
| Pkib | protein kinase inhibitor beta, cAMP dependent, testis specific |
| Plcxd3 | phosphatidylinositol-specific phospholipase C, X domain containing 3 |
| Pnpla7 | patatin-like phospholipase domain containing 7 |
| Prdm8 | PR domain containing 8 |
| Proca1 | protein interacting with cyclin A1 |
| Prodh | proline dehydrogenase |
| Prr18 | proline rich 18 |
| Prr36 | proline rich 36 |
| Ptch2 | patched 2 |
| Ptgds | prostaglandin D2 synthase (brain) |
| Rab34 | RAB34, member RAS oncogene family |
| Rasgrp3 | RAS, guanyl releasing protein 3 |
| Rgs8 | regulator of G-protein signaling 8 |
| Ror1 | receptor tyrosine kinase-like orphan receptor 1 |
| Rora | RAR-related orphan receptor alpha |
| Rtl4 | retrotransposon Gag like 4 |
| S100a3 | S100 calcium binding protein A3 |
| S1pr5 | sphingosine-1-phosphate receptor 5 |
| Scn2a | sodium channel, voltage-gated, type II, alpha |
| Sema5b | sema domain, seven thrombospondin repeats (type 1 and type 1-like), transmembrane domain (TM) and short cytoplasmic domain, (semaphorin) 5B |
| Sh3pxd2b | SH3 and PX domains 2B |
| Shf | Src homology 2 domain containing F |
| Slain1 | SLAIN motif family, member 1 |
| Slc1a2 | solute carrier family 1 (glial high affinity glutamate transporter), member 2 |
| Slc38a3 | solute carrier family 38, member 3 |
| Slitrk4 | SLIT and NTRK-like family, member 4 |
| Snx22 | sorting nexin 22 |
| Speer4a | spermatogenesis associated glutamate (E)-rich protein 4A |
| Sstr1 | somatostatin receptor 1 |
| Stxbp51 | syntaxin binding protein 5-like |
| Sv2b | synaptic vesicle glycoprotein 2 b |
| Syt1 | synaptotagmin I |
| Tbata | thymus, brain and testes associated |
| Tenm1 | teneurin transmembrane protein 1 |
| Tmem100 | transmembrane protein 100 |
| Tmem151b | transmembrane protein 151B |

TABLE 1-continued

Gene symbols and names

| Symbol | Name |
|---|---|
| Tmem176b | transmembrane protein 176B |
| Tmem229a | transmembrane protein 229A |
| Tmem88b | transmembrane protein 88B |
| Trf | transferrin |
| Tspyl4 | TSPY-like 4 |
| Ttyh1 | tweety family member 1 |
| Unc5d | unc-5 netrin receptor D |
| Usp54 | ubiquitin specific peptidase 54 |
| Wscd2 | WSC domain containing 2 |
| Xylt1 | xylosyltransferase 1 |
| Zdhhc23 | zinc finger, DHHC domain containing 23 |
| Zfand4 | zinc finger, AN1-type domain 4 |
| Zfp488 | zinc finger protein 488 |

For mice, Table 2 and Table 2b provide the unique ENSEMBL identifiers corresponding to the mouse genes (MUSG), transcripts (MUST), and proteins (if available) (MUSP) analyzed in the experiments herein. The unique identifiers for each ENSEMBL entry has been modified to remove the first five leading zeros (0) of the identifier after the ENSMUSG, ENSMUST, and ENSMUSP label. Where an ENSEMBL transcript or protein identifer was not available, GenBank transcripts (nucleic acid or protein) are included.

TABLE 2

ENSEMBL IDs for mice

| Symbol | MUSG | MUST | MUSP |
|---|---|---|---|
| 1700047M11Rik | 100147 | 189594 | N/A |
| 1700047M11Rik | 100147 | 185216 | N/A |
| 2410124H12Rik | 051297 | 160494 | N/A |
| 3110039M20Rik | 104861 | 127041 | N/A |
| 3110039M20Rik | 104861 | 145291 | N/A |
| 8030451O07Rik | N/A | N/A | N/A |
| 9530059O14Rik | 097736 | 181682 | N/A |
| 9530059O14Rik | 097736 | 181107 | N/A |
| 9530059O14Rik | 097736 | 215759 | N/A |
| 9530059O14Rik | 097736 | 181719 | N/A |
| A230077H06Rik | 100600 | 189574 | N/A |
| A230077H06Rik | 100600 | 188579 | N/A |
| A230077H06Rik | 100600 | 189855 | N/A |
| A230077H06Rik | 100600 | 205953 | N/A |
| A2m | 030111 | 204850 | 144862 |
| A2m | 030111 | 032203 | 032203 |
| A2m | 030111 | 203413 | N/A |
| A730036I17Rik | 056738 | 143346 | N/A |
| A730036I17Rik | 056738 | 148548 | N/A |
| A730036I17Rik | 056738 | 165505 | N/A |
| Aass | 029695 | 031707 | 031707 |
| Aass | 029695 | 138063 | N/A |
| Aass | 029695 | 149864 | 115079 |
| Aass | 029695 | 152280 | N/A |
| Aatk | 025375 | 103020 | 099309 |
| Aatk | 025375 | 064307 | 067181 |
| Aatk | 025375 | 103019 | 099308 |
| Aatk | 025375 | 150730 | N/A |
| Aatk | 025375 | 142959 | N/A |
| Aatk | 025375 | 134319 | N/A |
| Aatk | 025375 | 132575 | N/A |
| Aatk | 025375 | 136386 | N/A |
| Aatk | 025375 | 128836 | N/A |
| Abat | 057880 | 065987 | 063548 |
| Abat | 057880 | 140795 | N/A |
| Abat | 057880 | 115838 | 111504 |
| Abat | 057880 | 144444 | 121881 |
| Abat | 057880 | 115839 | 111505 |
| Abat | 057880 | 128459 | N/A |
| Abat | 057880 | 138987 | 116686 |
| Abca1 | 015243 | 030010 | 030010 |

TABLE 2-continued

| | | ENSEMBL IDs for mice | |
|---|---|---|---|
| Symbol | MUSG | MUST | MUSP |
| Abca1 | 015243 | 149127 | N/A |
| Abcc8 | 040136 | 210655 | 148169 |
| Abcc8 | 040136 | 209432 | 147431 |
| Abcc8 | 040136 | 210770 | 147925 |
| Abcc8 | 040136 | 210637 | N/A |
| Abcc8 | 040136 | 033123 | 033123 |
| Abcc8 | 040136 | 210110 | 147479 |
| Abcc8 | 040136 | 210986 | N/A |
| Abcc8 | 040136 | 210511 | 148198 |
| Abcg2 | 029802 | 147213 | 120940 |
| Abcg2 | 029802 | 204924 | N/A |
| Abcg2 | 029802 | 148008 | 114454 |
| Abcg2 | 029802 | 031822 | 031822 |
| Abcg2 | 029802 | 124542 | N/A |
| Abcg2 | 029802 | 145161 | 122924 |
| Abcg2 | 029802 | 143752 | 138608 |
| Abcg2 | 029802 | 203146 | 145435 |
| Abcg2 | 029802 | 114294 | 109933 |
| Abcg2 | 029802 | 204948 | 144876 |
| Abcg2 | 029802 | 143447 | N/A |
| Abcg2 | 029802 | 145685 | 138703 |
| Abcg2 | 029802 | 134426 | N/A |
| Abhd2 | 039202 | 037315 | 038361 |
| Abhd2 | 039202 | 135333 | N/A |
| Abhd5 | 032540 | 156520 | 122274 |
| Abhd5 | 032540 | 035128 | 135538 |
| Abhd5 | 032540 | 111497 | 107123 |
| Abhd5 | 032540 | 176005 | N/A |
| Abhd5 | 032540 | 175973 | 135807 |
| Abhd5 | 032540 | 214061 | N/A |
| Abhd5 | 032540 | 216775 | N/A |
| Abhd5 | 032540 | 154161 | 122939 |
| Abi3bp | 035258 | 048471 | 036257 |
| Abi3bp | 035258 | 096013 | 093712 |
| Abi3bp | 035258 | 096012 | 093711 |
| Abi3bp | 035258 | 171000 | 128818 |
| Ablim1 | 025085 | 079360 | 078336 |
| Ablim1 | 025085 | 111529 | 107154 |
| Ablim1 | 025085 | 099294 | 096897 |
| Ablim1 | 025085 | 111559 | 107184 |
| Ablim1 | 025085 | 111528 | 107153 |
| Ablim1 | 025085 | 111526 | 107151 |
| Ablim1 | 025085 | 111550 | 107175 |
| Ablim1 | 025085 | 111558 | 107183 |
| Ablim1 | 025085 | 111555 | 107180 |
| Ablim1 | 025085 | 111546 | 107172 |
| Ablim1 | 025085 | 111544 | 107169 |
| Ablim1 | 025085 | 156316 | N/A |
| Ablim1 | 025085 | 137389 | N/A |
| Ablim1 | 025085 | 127198 | N/A |
| Ablim1 | 025085 | 133782 | N/A |
| Ablim1 | 025085 | 134430 | N/A |
| Ablim1 | 025085 | 150425 | N/A |
| Ablim1 | 025085 | 128212 | N/A |
| Ablim1 | 025085 | 111524 | 107149 |
| Ablim1 | 025085 | 133369 | 117798 |
| Ablim1 | 025085 | 104902 | 127818 |
| Ablim2 | 029095 | 101280 | 098838 |
| Ablim2 | 029095 | 054598 | 050571 |
| Ablim2 | 029095 | 114205 | 109843 |
| Ablim2 | 029095 | 114210 | 109848 |
| Ablim2 | 029095 | 114206 | 109844 |
| Ablim2 | 029095 | 114204 | 109842 |
| Ablim2 | 029095 | 129347 | 123525 |
| Ablim2 | 029095 | 130233 | 118159 |
| Ablim2 | 029095 | 114203 | 109841 |
| Ablim2 | 029095 | 150146 | 144134 |
| Ablim2 | 029095 | 151636 | 123616 |
| Ablim2 | 029095 | 135885 | N/A |
| Ablim2 | 029095 | 151322 | 114616 |
| Ablim2 | 029095 | 125378 | 115931 |
| Ablim2 | 029095 | 153025 | N/A |
| Ablim2 | 029095 | 130209 | N/A |
| Ablim2 | 029095 | 153529 | 118019 |
| Ablim3 | 032735 | 049378 | 041243 |
| Ablim3 | 032735 | 166783 | 125836 |

TABLE 2-continued

| | | ENSEMBL IDs for mice | |
|---|---|---|---|
| Symbol | MUSG | MUST | MUSP |
| Abtb2 | 032724 | 076212 | 075566 |
| Abtb2 | 032724 | 131122 | N/A |
| Abtb2 | 032724 | 138580 | N/A |
| Acad8 | 031969 | 129490 | N/A |
| Acad8 | 031969 | 120367 | 112908 |
| Acad8 | 031969 | 151075 | N/A |
| Acad8 | 031969 | 215693 | 150728 |
| Acad8 | 031969 | 128923 | 122444 |
| Acad8 | 031969 | 132293 | 123012 |
| Acad8 | 031969 | 138102 | N/A |
| Acad8 | 031969 | 060513 | 054370 |
| Acer3 | 030760 | 033020 | 033020 |
| Acer3 | 030760 | 120520 | 112884 |
| Acer3 | 030760 | 151258 | 116127 |
| Acer3 | 030760 | 206182 | N/A |
| Acer3 | 030760 | 137899 | 120334 |
| Aco2 | 022477 | 023116 | 023116 |
| Aco2 | 022477 | 157003 | N/A |
| Aco2 | 022477 | 135198 | N/A |
| Aco2 | 022477 | 126352 | N/A |
| Aco2 | 022477 | 155704 | N/A |
| Aco2 | 022477 | 144324 | N/A |
| Acot11 | 034853 | 102762 | 099823 |
| Acot11 | 034853 | 065253 | 069636 |
| Acot11 | 034853 | 140541 | 124567 |
| Acot11 | 034853 | 144809 | N/A |
| Acot11 | 034853 | 156567 | 123942 |
| Acot11 | 034853 | 145061 | 125123 |
| Acot11 | 034853 | 148688 | 124385 |
| Acsbg1 | 032281 | 034822 | 034822 |
| Acsbg1 | 032281 | 138315 | 118133 |
| Acsbg1 | 032281 | 128163 | 119551 |
| Acsbg1 | 032281 | 128624 | 121622 |
| Acsbg1 | 032281 | 132914 | N/A |
| Acsm5 | 030972 | 207796 | 146520 |
| Acsm5 | 030972 | 066465 | 063416 |
| Acsm5 | 030972 | 207307 | 146737 |
| Acsm5 | 030972 | 207440 | 146938 |
| Acsm5 | 030972 | 207381 | 146715 |
| Acsm5 | 030972 | 207387 | 146357 |
| Acsm5 | 030972 | 207813 | 147176 |
| Actb | 029580 | 100497 | 098066 |
| Actb | 029580 | 196997 | N/A |
| Actb | 029580 | 167721 | 127663 |
| Actb | 029580 | 171419 | 130611 |
| Actb | 029580 | 167386 | N/A |
| Actb | 029580 | 163829 | 132135 |
| Actb | 029580 | 106216 | 101823 |
| Actb | 029580 | 165629 | N/A |
| Actb | 029580 | 164765 | N/A |
| Actbl2 | 055194 | 054716 | 052086 |
| Actr3b | 056367 | 128727 | 121629 |
| Actr3b | 056367 | 088244 | 085578 |
| Actr3b | 056367 | 198693 | N/A |
| Adam11 | 020926 | 103081 | 099370 |
| Adam11 | 020926 | 068150 | 069466 |
| Adam11 | 020926 | 124879 | N/A |
| Adam11 | 020926 | 141563 | N/A |
| Adam11 | 020926 | 142912 | N/A |
| Adam11 | 020926 | 126024 | N/A |
| Adam11 | 020926 | 134296 | N/A |
| Adam11 | 020926 | 143269 | N/A |
| Adam11 | 020926 | 135513 | N/A |
| Adam12 | 054555 | 067680 | 065213 |
| Adam12 | 054555 | 138363 | 114874 |
| Adam12 | 054555 | 134504 | 123161 |
| Adam12 | 054555 | 127524 | 120094 |
| Adam12 | 054555 | 206313 | N/A |
| Adam12 | 054555 | 206426 | N/A |
| Adam12 | 054555 | 154144 | N/A |
| Adamts10 | 024299 | 174666 | N/A |
| Adamts10 | 024299 | 173972 | N/A |
| Adamts10 | 024299 | 174104 | N/A |
| Adamts10 | 024299 | 173813 | N/A |
| Adamts10 | 024299 | 174348 | 133856 |
| Adamts10 | 024299 | 172922 | 133891 |

TABLE 2-continued

ENSEMBL IDs for mice

| Symbol | MUSG | MUST | MUSP |
|---|---|---|---|
| Adamts10 | 024299 | 173013 | 134181 |
| Adamts10 | 024299 | 173030 | 134549 |
| Adamts10 | 024299 | 174170 | N/A |
| Adamts10 | 024299 | 173241 | 134298 |
| Adamts10 | 024299 | 087623 | 084905 |
| Adamts10 | 024299 | 173931 | 133434 |
| Adamts15 | 033453 | 065112 | 067022 |
| Adamts15 | 033453 | 217070 | N/A |
| Adamts15 | 033453 | 216215 | 150677 |
| Adamts16 | 049538 | 080145 | 079041 |
| Adamts16 | 049538 | 123552 | 122031 |
| Adamts16 | 049538 | 109694 | 105316 |
| Adamts16 | 049538 | 130726 | N/A |
| Adamts18 | 053399 | 093113 | 090801 |
| Adamts18 | 053399 | 212665 | 148330 |
| Adamts18 | 053399 | 212437 | 148288 |
| Adamts18 | 053399 | 213076 | N/A |
| Adamts18 | 053399 | 213061 | N/A |
| Adamts18 | 053399 | 213078 | N/A |
| Adamts18 | 053399 | 212527 | N/A |
| Adamts2 | 036545 | 040523 | 040171 |
| Adamts2 | 036545 | 142118 | N/A |
| Adamts2 | 036545 | 125988 | N/A |
| Adamts2 | 036545 | 127534 | N/A |
| Adamts6 | 046169 | 224784 | 153665 |
| Adamts6 | 046169 | 223562 | 153504 |
| Adamts6 | 046169 | 224742 | 152936 |
| Adamts6 | 046169 | 224208 | 153359 |
| Adamts6 | 046169 | 224303 | 153431 |
| Adamts6 | 046169 | 224504 | 153194 |
| Adamts6 | 046169 | 065766 | 064570 |
| Adamts9 | 030022 | 113438 | 109065 |
| Adamts9 | 030022 | 125490 | N/A |
| Adamts9 | 030022 | 130314 | N/A |
| Adamts9 | 030022 | 203690 | N/A |
| Adamts9 | 030022 | 136751 | N/A |
| Adamts9 | 030022 | 167391 | 126498 |
| Adamtsl4 | 015850 | 117782 | 113424 |
| Adamtsl4 | 015850 | 015994 | 015994 |
| Adamtsl4 | 015850 | 151054 | N/A |
| Adamtsl4 | 015850 | 124410 | N/A |
| Adamtsl4 | 015850 | 148854 | 120844 |
| Adcy1 | 020431 | 020706 | 020706 |
| Adcy1 | 020431 | 135398 | N/A |
| Adcyap1r1 | 029778 | 070736 | 063784 |
| Adcyap1r1 | 029778 | 070756 | 066902 |
| Adcyap1r1 | 029778 | 166962 | 130742 |
| Adcyap1r1 | 029778 | 167484 | 131641 |
| Adcyap1r1 | 029778 | 172084 | 127319 |
| Adcyap1r1 | 029778 | 165857 | 129614 |
| Adcyap1r1 | 029778 | 167234 | 126994 |
| Adcyap1r1 | 029778 | 165786 | 130923 |
| Add2 | 030000 | 203529 | N/A |
| Add2 | 030000 | 204059 | 145160 |
| Add2 | 030000 | 203366 | 144849 |
| Add2 | 030000 | 203445 | 145494 |
| Add2 | 030000 | 205034 | 145034 |
| Add2 | 030000 | 203724 | 145296 |
| Add2 | 030000 | 203196 | 145104 |
| Add2 | 030000 | 203786 | 144694 |
| Add2 | 030000 | 203279 | 145452 |
| Add2 | 030000 | 032069 | 032069 |
| Adgra1 | 025475 | 026548 | 026548 |
| Adgra1 | 025475 | 137584 | N/A |
| Adgra1 | 025475 | 129454 | N/A |
| Adgra3 | 029090 | 030971 | 030971 |
| Adgra3 | 029090 | 196177 | N/A |
| Adgra3 | 029090 | 198818 | N/A |
| Adgra3 | 029090 | 196229 | N/A |
| Adgra3 | 029090 | 198868 | N/A |
| Adgra3 | 029090 | 196915 | N/A |
| Adgra3 | 029090 | 199132 | N/A |
| Adgrg1 | 031785 | 211850 | N/A |
| Adgrg1 | 031785 | 212581 | 148742 |
| Adgrg1 | 031785 | 179619 | 137520 |
| Adgrg1 | 031785 | 212660 | 148644 |

TABLE 2-continued

ENSEMBL IDs for mice

| Symbol | MUSG | MUST | MUSP |
|---|---|---|---|
| Adgrg1 | 031785 | 093271 | 090959 |
| Adgrg1 | 031785 | 211944 | 148386 |
| Adgrg1 | 031785 | 212799 | 148349 |
| Adgrg1 | 031785 | 212141 | 148331 |
| Adgrg1 | 031785 | 212976 | 148439 |
| Adgrg1 | 031785 | 212995 | 148309 |
| Adgrg1 | 031785 | 212956 | 148374 |
| Adgrg1 | 031785 | 212531 | 148650 |
| Adgrg1 | 031785 | 211984 | 148412 |
| Adgrg1 | 031785 | 212118 | 148304 |
| Adgrg1 | 031785 | 211806 | N/A |
| Adgrg1 | 031785 | 211911 | N/A |
| Adgrv1 | 069170 | 128120 | 122358 |
| Adgrv1 | 069170 | 095585 | 093245 |
| Adgrv1 | 069170 | 224088 | 153419 |
| Adgrv1 | 069170 | 125698 | 120136 |
| Adgrv1 | 069170 | 156631 | N/A |
| Adgrv1 | 069170 | 109565 | 105193 |
| Adgrv1 | 069170 | 129725 | N/A |
| Adgrv1 | 069170 | 156627 | N/A |
| Adgrv1 | 069170 | 146141 | N/A |
| Adgrv1 | 069170 | 125663 | N/A |
| Adgrv1 | 069170 | 126444 | 123552 |
| Adgrv1 | 069170 | 128585 | 121899 |
| Adgrv1 | 069170 | 146749 | 114579 |
| Adgrv1 | 069170 | 132045 | N/A |
| Adm | 030790 | 033054 | 033054 |
| Adm | 030790 | 185766 | N/A |
| Adora1 | 042429 | 086465 | 083656 |
| Adora1 | 042429 | 038191 | 043522 |
| Adora1 | 042429 | 187631 | 140801 |
| Adora1 | 042429 | 169927 | 132105 |
| Adra1a | 045875 | 159365 | 124322 |
| Adra1a | 045875 | 054661 | 053703 |
| Adra1a | 045875 | 160647 | N/A |
| Adra1a | 045875 | 225182 | 153103 |
| Adra1a | 045875 | 159068 | 124570 |
| Adra1a | 045875 | 161339 | 125354 |
| Adra1b | 050541 | 067258 | 070200 |
| Adra1b | 050541 | 139906 | 123435 |
| Adra1b | 050541 | 124306 | N/A |
| Adra1b | 050541 | 167574 | 129200 |
| Adra2b | 058620 | 104934 | 100539 |
| Adra2b | 058620 | 071902 | 071798 |
| Adrb2 | 045730 | 053640 | 062256 |
| AF529169 | 039313 | 044491 | 046111 |
| AF529169 | 039313 | 191465 | 140942 |
| Afap1 | 029094 | 064571 | 067779 |
| Afap1 | 029094 | 146300 | N/A |
| Afap1 | 029094 | 141824 | 119364 |
| Afap1 | 029094 | 212374 | 148414 |
| Afap1 | 029094 | 201482 | N/A |
| Afap1l1 | 033032 | 154876 | 121278 |
| Afap1l1 | 033032 | 120472 | 113286 |
| Afap1l1 | 033032 | 147278 | N/A |
| Aff2 | 031189 | 033532 | 033532 |
| Aff2 | 031189 | 143097 | N/A |
| Aff2 | 031189 | 151662 | N/A |
| Aff2 | 031189 | 139977 | N/A |
| Afp | 054932 | 042755 | 041006 |
| Afp | 054932 | 200693 | 144019 |
| Afp | 054932 | 201061 | N/A |
| Afp | 054932 | 200728 | N/A |
| Afp | 054932 | 202209 | N/A |
| Agap1 | 055013 | 027521 | 027521 |
| Agap1 | 055013 | 190096 | 140599 |
| Agap1 | 055013 | 185417 | N/A |
| Agap1 | 055013 | 074945 | 074478 |
| Agap1 | 055013 | 212721 | 148732 |
| Agap1 | 055013 | 212924 | 148317 |
| Agpat3 | 001211 | 001240 | 001240 |
| Agpat3 | 001211 | 105389 | 101028 |
| Agpat3 | 001211 | 105390 | 101029 |
| Agpat3 | 001211 | 105388 | 101027 |
| Agpat3 | 001211 | 105387 | 101026 |
| Agpat3 | 001211 | 146296 | N/A |

TABLE 2-continued

ENSEMBL IDs for mice

| Symbol | MUSG | MUST | MUSP |
|---|---|---|---|
| Agpat3 | 001211 | 219907 | N/A |
| Agpat3 | 001211 | 219932 | 151528 |
| Agpat3 | 001211 | 139282 | 119713 |
| Agpat3 | 001211 | 150828 | 114885 |
| Agpat3 | 001211 | 138035 | 121052 |
| Agpat3 | 001211 | 146899 | 114657 |
| Agpat3 | 001211 | 166360 | 132954 |
| Agpat4 | 023827 | 164143 | 128085 |
| Agpat4 | 023827 | 024594 | 024594 |
| Agpat4 | 023827 | 172259 | N/A |
| Agpat4 | 023827 | 167792 | 127477 |
| Agpat4 | 023827 | 170858 | 127417 |
| Agpat4 | 023827 | 167905 | N/A |
| Agrn | 041936 | 154494 | N/A |
| Agrn | 041936 | 105574 | 101199 |
| Agrn | 041936 | 071248 | 071229 |
| Agrn | 041936 | 105575 | 101200 |
| Agrn | 041936 | 181062 | N/A |
| Agrn | 041936 | 180572 | 137931 |
| Agrn | 041936 | 144749 | N/A |
| AI464131 | 046312 | 054920 | 059038 |
| AI464131 | 046312 | 149596 | 122357 |
| AI593442 | 078307 | 213937 | 149532 |
| AI593442 | 078307 | 213843 | 149128 |
| AI593442 | 078307 | 098768 | 096365 |
| Ak4 | 028527 | 102780 | 099841 |
| Ak4 | 028527 | 106946 | 102559 |
| Ak4 | 028527 | 106945 | 102558 |
| Ak4 | 028527 | 131397 | 115456 |
| Ak4 | 028527 | 133055 | 115454 |
| Ak4 | 028527 | 151561 | N/A |
| Ak4 | 028527 | 155749 | 121112 |
| Akain1 | 091636 | 169935 | 131134 |
| Akna | 039158 | 035724 | 041614 |
| Akna | 039158 | 140586 | N/A |
| Aldh1a1 | 053279 | 224807 | N/A |
| Aldh1a1 | 053279 | 225337 | 153410 |
| Aldh1a1 | 053279 | 224358 | N/A |
| Aldh1a1 | 053279 | 225313 | 153011 |
| Aldh1a1 | 053279 | 225249 | N/A |
| Aldh1a1 | 053279 | 087638 | 084918 |
| Aldh1a1 | 053279 | 224807 | N/A |
| Aldh1a1 | 053279 | 225337 | 153410 |
| Aldh1a1 | 053279 | 224358 | N/A |
| Aldh1a1 | 053279 | 225313 | 153011 |
| Aldh1a1 | 053279 | 225249 | N/A |
| Aldh1a1 | 053279 | 087638 | 084918 |
| Aldh1l1 | 030088 | 127199 | N/A |
| Aldh1l1 | 030088 | 130418 | 114304 |
| Aldh1l1 | 030088 | 032175 | 032175 |
| Aldh1l1 | 030088 | 203111 | 145233 |
| Aldh1l1 | 030088 | 204796 | 145380 |
| Aldh1l1 | 030088 | 152436 | N/A |
| Aldh1l1 | 030088 | 137669 | N/A |
| Aldh1l2 | 020256 | 020497 | 020497 |
| Aldh1l2 | 020256 | 146640 | 117076 |
| Aldh1l2 | 020256 | 147381 | N/A |
| Aldh1l2 | 020256 | 141184 | N/A |
| Aldh1l2 | 020256 | 138858 | N/A |
| Aldh1l2 | 020256 | 143793 | N/A |
| Aldh1l2 | 020256 | 125193 | N/A |
| Aldoc | 017390 | 102478 | 099536 |
| Aldoc | 017390 | 128032 | N/A |
| Aldoc | 017390 | 124090 | N/A |
| Aldoc | 017390 | 156039 | N/A |
| Aldoc | 017390 | 148689 | N/A |
| Aldoc | 017390 | 017534 | 017534 |
| Als2 | 026024 | 027178 | 027178 |
| Als2 | 026024 | 163058 | 125753 |
| Als2 | 026024 | 159166 | N/A |
| Als2 | 026024 | 160945 | 140990 |
| Als2 | 026024 | 188469 | N/A |
| Amz1 | 050022 | 126975 | N/A |
| Amz1 | 050022 | 060918 | 053110 |
| Amz1 | 050022 | 177057 | N/A |
| Amz1 | 050022 | 120630 | 113911 |

TABLE 2-continued

ENSEMBL IDs for mice

| Symbol | MUSG | MUST | MUSP |
|---|---|---|---|
| Amz1 | 050022 | 156006 | N/A |
| Amz1 | 050022 | 155644 | N/A |
| Amz1 | 050022 | 176035 | 135504 |
| Angpt1 | 022309 | 022921 | 022921 |
| Angpt1 | 022309 | 227738 | N/A |
| Angptl3 | 028553 | 030280 | 030280 |
| Angptl3 | 028553 | 136091 | N/A |
| Angptl3 | 028553 | 125546 | N/A |
| Ankrd33b | 022237 | 123325 | 118984 |
| Ankrd33b | 022237 | 156679 | 117974 |
| Ankrd33b | 022237 | 044324 | 037918 |
| Ankrd33b | 022237 | 110410 | 106040 |
| Ankrd33b | 022237 | 227867 | N/A |
| Ankrd33b | 022237 | 076942 | 076209 |
| Ankrd33b | 022237 | 227391 | N/A |
| Anln | 036777 | 040912 | 045873 |
| Anln | 036777 | 215006 | 149721 |
| Anln | 036777 | 217010 | N/A |
| Anln | 036777 | 216897 | N/A |
| Anln | 036777 | 216793 | 149740 |
| Anln | 036777 | 215486 | N/A |
| Ano4 | 035189 | 182462 | 138440 |
| Ano4 | 035189 | 182341 | 138193 |
| Ano4 | 035189 | 182613 | 138268 |
| Ano4 | 035189 | 182790 | 138325 |
| Ano4 | 035189 | 182598 | 138174 |
| Ano4 | 035189 | 182888 | N/A |
| Ano4 | 035189 | 182041 | N/A |
| Ano4 | 035189 | 182419 | 138435 |
| Ano4 | 035189 | 183268 | 138627 |
| Ano4 | 035189 | 181976 | 138792 |
| Ano4 | 035189 | 182624 | 138525 |
| Ano4 | 035189 | 180843 | N/A |
| Ano6 | 064210 | 071874 | 071770 |
| Ano6 | 064210 | 226936 | N/A |
| Ano6 | 064210 | 227791 | 153954 |
| Ano6 | 064210 | 226682 | N/A |
| Ano6 | 064210 | 227151 | 153853 |
| Ano6 | 064210 | 226932 | N/A |
| Ano6 | 064210 | 226793 | 154532 |
| Ano6 | 064210 | 226761 | N/A |
| Aox1 | 063558 | 001027 | 001027 |
| Aox1 | 063558 | 160168 | N/A |
| Apba2 | 030519 | 032732 | 032732 |
| Apba2 | 030519 | 205613 | 146269 |
| Apba2 | 030519 | 205604 | 146279 |
| Apba2 | 030519 | 206246 | 146038 |
| Apba2 | 030519 | 205551 | N/A |
| Apba2 | 030519 | 206061 | N/A |
| Apba2 | 030519 | 206630 | 146108 |
| Apbb2 | 029207 | 162955 | N/A |
| Apbb2 | 029207 | 162366 | 125116 |
| Apbb2 | 029207 | 160870 | 123978 |
| Apbb2 | 029207 | 159512 | 124807 |
| Apbb2 | 029207 | 159786 | 125211 |
| Apbb2 | 029207 | 201776 | N/A |
| Apbb2 | 029207 | 160775 | N/A |
| Apbb2 | 029207 | 162349 | 123752 |
| Apbb2 | 029207 | 160063 | 123778 |
| Apbb2 | 029207 | 161771 | N/A |
| Apbb2 | 029207 | 162401 | N/A |
| Apbb2 | 029207 | 160185 | N/A |
| Apbb2 | 029207 | 162382 | 124139 |
| Apbb2 | 029207 | 161879 | 125550 |
| Apbb2 | 029207 | 160103 | 123766 |
| Apbb2 | 029207 | 162994 | 125603 |
| Apbb2 | 029207 | 159357 | 124127 |
| Apbb2 | 029207 | 161716 | 124350 |
| Apbb2 | 029207 | 161936 | N/A |
| Apbb2 | 029207 | 159847 | N/A |
| Apbb2 | 029207 | 087256 | 084511 |
| Apcdd1 | 071847 | 096554 | 094302 |
| Apcdd1 | 071847 | 163716 | 125868 |
| Aplp1 | 006651 | 006828 | 006828 |
| Aplp1 | 006651 | 208792 | N/A |
| Aplp1 | 006651 | 208404 | N/A |

TABLE 2-continued

| ENSEMBL IDs for mice | | | |
|---|---|---|---|
| Symbol | MUSG | MUST | MUSP |
| Aplp1 | 006651 | 207514 | N/A |
| Aplp1 | 006651 | 209054 | N/A |
| Apod | 022548 | 130560 | 119827 |
| Apod | 022548 | 115230 | 110885 |
| Apod | 022548 | 023207 | N/A |
| Apod | 022548 | 156456 | N/A |
| Apod | 022548 | 155682 | N/A |
| Apod | 022548 | 145837 | N/A |
| Appl2 | 020263 | 020500 | 020500 |
| Appl2 | 020263 | 177187 | 135157 |
| Appl2 | 020263 | 176675 | 135672 |
| Appl2 | 020263 | 141048 | N/A |
| Appl2 | 020263 | 130285 | N/A |
| Appl2 | 020263 | 148096 | N/A |
| Appl2 | 020263 | 147582 | N/A |
| Appl2 | 020263 | 150351 | N/A |
| Appl2 | 020263 | 127788 | N/A |
| Appl2 | 020263 | 147118 | N/A |
| Appl2 | 020263 | 146876 | 121336 |
| Appl2 | 020263 | 150685 | 115903 |
| Appl2 | 020263 | 133719 | N/A |
| Appl2 | 020263 | 176294 | 135645 |
| Aqp4 | 024411 | 079081 | 078088 |
| Aqp7 | 028427 | 030136 | 030136 |
| Aqp7 | 028427 | 054945 | 093007 |
| Aqp7 | 028427 | 144201 | N/A |
| Aqp7 | 028427 | 149517 | N/A |
| Ar | 046532 | 052837 | 052648 |
| Arhgap10 | 037148 | 076316 | 075658 |
| Arhgap10 | 037148 | 210922 | 147485 |
| Arhgap10 | 037148 | 210519 | 147493 |
| Arhgap15 | 049744 | 055776 | 056461 |
| Arhgap15 | 049744 | 112824 | 108443 |
| Arhgap15 | 049744 | 112822 | 108441 |
| Arhgap15 | 049744 | 140528 | N/A |
| Arhgap15 | 049744 | 128630 | N/A |
| Arhgap20 | 053199 | 130405 | 120124 |
| Arhgap20 | 053199 | 065496 | 065633 |
| Arhgap20 | 053199 | 146509 | N/A |
| Arhgap20 | 053199 | 124907 | N/A |
| Arhgap20 | 053199 | 126567 | N/A |
| Arhgap20 | 053199 | 149754 | N/A |
| Arhgap22 | 063506 | 165792 | 153801 |
| Arhgap22 | 063506 | 111956 | 107587 |
| Arhgap22 | 063506 | 131086 | 154002 |
| Arhgap22 | 063506 | 137590 | N/A |
| Arhgap22 | 063506 | 111955 | 107586 |
| Arhgap22 | 063506 | 140711 | 154670 |
| Arhgap22 | 063506 | 140166 | N/A |
| Arhgap22 | 063506 | 132659 | N/A |
| Arhgap23 | 049807 | 121799 | 112999 |
| Arhgap23 | 049807 | 152933 | N/A |
| Arhgap23 | 049807 | 142465 | 123191 |
| Arhgap23 | 049807 | 093940 | 091472 |
| Arhgap23 | 049807 | 107601 | 103227 |
| Arhgap24 | 057315 | 094559 | 092138 |
| Arhgap24 | 057315 | 126125 | N/A |
| Arhgap24 | 057315 | 112854 | 108475 |
| Arhgap24 | 057315 | 112853 | 108474 |
| Arhgap24 | 057315 | 112852 | 108473 |
| Arhgap24 | 057315 | 130222 | N/A |
| Arhgap24 | 057315 | 070000 | 070048 |
| Arhgap24 | 057315 | 073302 | 073028 |
| Arhgap25 | 030047 | 145128 | N/A |
| Arhgap25 | 030047 | 113637 | 109267 |
| Arhgap25 | 030047 | 101197 | 098758 |
| Arhgap25 | 030047 | 071024 | 068964 |
| Arhgap25 | 030047 | 203559 | N/A |
| Arhgef10l | 040964 | 069623 | 066249 |
| Arhgef10l | 040964 | 097820 | 095431 |
| Arhgef10l | 040964 | 105799 | 101425 |
| Arhgef10l | 040964 | 105798 | 101424 |
| Arhgef10l | 040964 | 105797 | 101423 |
| Arhgef10l | 040964 | 138493 | 119471 |
| Arhgef10l | 040964 | 039204 | 040531 |
| Arhgef10l | 040964 | 154979 | 122667 |

TABLE 2-continued

| ENSEMBL IDs for mice | | | |
|---|---|---|---|
| Symbol | MUSG | MUST | MUSP |
| Arhgef10l | 040964 | 147426 | 123642 |
| Arhgef10l | 040964 | 140403 | 117038 |
| Arhgef10l | 040964 | 125045 | N/A |
| Arhgef10l | 040964 | 143614 | 120437 |
| Arhgef2 | 028059 | 212392 | N/A |
| Arhgef2 | 028059 | 176226 | N/A |
| Arhgef2 | 028059 | 175749 | N/A |
| Arhgef2 | 028059 | 175903 | 135168 |
| Arhgef2 | 028059 | 176514 | N/A |
| Arhgef2 | 028059 | 177023 | 134859 |
| Arhgef2 | 028059 | 176539 | 135612 |
| Arhgef2 | 028059 | 177498 | 134840 |
| Arhgef2 | 028059 | 176500 | 134834 |
| Arhgef2 | 028059 | 175779 | 135177 |
| Arhgef2 | 028059 | 029694 | 029694 |
| Arhgef2 | 028059 | 176804 | 135397 |
| Arhgef2 | 028059 | 177418 | N/A |
| Arhgef2 | 028059 | 107510 | 103134 |
| Arhgef2 | 028059 | 170653 | 127843 |
| Arhgef2 | 028059 | 176401 | N/A |
| Arhgef2 | 028059 | 176400 | N/A |
| Arhgef2 | 028059 | 177303 | 135131 |
| Arhgef2 | 028059 | 176307 | 134843 |
| Arhgef2 | 028059 | 175911 | 135428 |
| Arhgef2 | 028059 | 176243 | 135771 |
| Arhgef2 | 028059 | 176316 | 135808 |
| Arhgef2 | 028059 | 177120 | N/A |
| Arhgef2 | 028059 | 176879 | 134766 |
| Arhgef2 | 028059 | 175745 | 135044 |
| Arhgef2 | 028059 | 176528 | N/A |
| Arhgef2 | 028059 | 176079 | N/A |
| Arhgef2 | 028059 | 176123 | N/A |
| Arhgef2 | 028059 | 177091 | N/A |
| Arhgef2 | 028059 | 176301 | N/A |
| Arhgef2 | 028059 | 177099 | N/A |
| Arhgef2 | 028059 | 176272 | N/A |
| Arhgef26 | 036885 | 079300 | 078281 |
| Arhgef26 | 036885 | 163008 | N/A |
| Arhgef26 | 036885 | 161493 | N/A |
| Arhgef26 | 036885 | 159746 | N/A |
| Arhgef26 | 036885 | 161057 | 124392 |
| Arhgef26 | 036885 | 192138 | N/A |
| Arhgef28 | 021662 | 109426 | 105053 |
| Arhgef28 | 021662 | 225884 | 153423 |
| Arhgef28 | 021662 | 225663 | N/A |
| Arhgef28 | 021662 | 225269 | N/A |
| Arhgef28 | 021662 | 223849 | 153000 |
| Arhgef28 | 021662 | 224926 | N/A |
| Arhgef28 | 021662 | 224866 | 153114 |
| Arhgef33 | 054901 | 223878 | 153224 |
| Arhgef33 | 054901 | 224391 | 153551 |
| Arhgef33 | 054901 | 225018 | N/A |
| Arhgef33 | 054901 | 224631 | N/A |
| Arhgef33 | 054901 | 224676 | N/A |
| Arhgef33 | 054901 | 224002 | N/A |
| Arhgef33 | 054901 | 225658 | 153062 |
| Arhgef33 | 054901 | 224966 | 153018 |
| Arhgef33 | 054901 | 225223 | 153484 |
| Arhgef33 | 054901 | 225548 | 153111 |
| Arhgef33 | 054901 | 226013 | N/A |
| Arhgef33 | 054901 | 068175 | 063284 |
| Arhgef37 | 045094 | 171629 | 130560 |
| Arhgef4 | 037509 | 159747 | 124213 |
| Arhgef4 | 037509 | 162599 | 124906 |
| Arhgef4 | 037509 | 159021 | 124467 |
| Arhgef4 | 037509 | 047664 | 035980 |
| Arhgef4 | 037509 | 162760 | N/A |
| Arhgef4 | 037509 | 159059 | N/A |
| Arhgef4 | 037509 | 160855 | 124207 |
| Arhgef4 | 037509 | 211073 | 148067 |
| Arl4a | 047446 | 101472 | 099013 |
| Arl4a | 047446 | 136441 | 122987 |
| Arl4a | 047446 | 144910 | 122126 |
| Arl4a | 047446 | 138572 | N/A |
| Arl4a | 047446 | 146905 | 114458 |
| Arnt2 | 015709 | 085077 | 082154 |

TABLE 2-continued

| ENSEMBL IDs for mice | | | |
|---|---|---|---|
| Symbol | MUSG | MUST | MUSP |
| Arnt2 | 015709 | 209133 | 147129 |
| Arnt2 | 015709 | 208232 | 146413 |
| Arnt2 | 015709 | 208564 | 146989 |
| Arnt2 | 015709 | 207459 | N/A |
| Arnt2 | 015709 | 208129 | 146614 |
| Arnt2 | 015709 | 208936 | N/A |
| Arnt2 | 015709 | 207759 | N/A |
| Arnt2 | 015709 | 208204 | 146781 |
| Arnt2 | 015709 | 208995 | 146599 |
| Arnt2 | 015709 | 207769 | 146414 |
| Arnt2 | 015709 | 208392 | 146776 |
| Arnt2 | 015709 | 208863 | 146868 |
| Arrb1 | 018909 | 098266 | 095866 |
| Arrb1 | 018909 | 032995 | 032995 |
| Arrb1 | 018909 | 162404 | 124351 |
| Arrb1 | 018909 | 161525 | 124483 |
| Arrb1 | 018909 | 161268 | N/A |
| Arrb1 | 018909 | 162043 | N/A |
| Arrb1 | 018909 | 159642 | N/A |
| Arrb1 | 018909 | 162933 | N/A |
| Arrb1 | 018909 | 162290 | 125056 |
| Arrb1 | 018909 | 179755 | 136963 |
| Arrdc3 | 074794 | 159090 | N/A |
| Arrdc3 | 074794 | 159690 | 124418 |
| Arrdc3 | 074794 | 099356 | 096957 |
| Arrdc3 | 074794 | 161441 | 125455 |
| Arrdc3 | 074794 | 159856 | N/A |
| Arrdc3 | 074794 | 162904 | N/A |
| Arsg | 020604 | 106697 | 102308 |
| Arsg | 020604 | 106696 | 102307 |
| Arsg | 020604 | 152252 | N/A |
| Arsg | 020604 | 136336 | N/A |
| Arsg | 020604 | 020928 | 020928 |
| Arx | 035277 | 187010 | N/A |
| Arx | 035277 | 046565 | 049039 |
| Arx | 035277 | 113947 | 109580 |
| Asap3 | 036995 | 047526 | 041899 |
| Ascl1 | 020052 | 020243 | 020243 |
| Asgr1 | 020884 | 146411 | 121842 |
| Asgr1 | 020884 | 108585 | 104226 |
| Asgr1 | 020884 | 018699 | 018699 |
| Asgr1 | 020884 | 092959 | 090637 |
| Asgr1 | 020884 | 123369 | 137469 |
| Asic1 | 023017 | 023758 | 023758 |
| Asic1 | 023017 | 226291 | N/A |
| Asic1 | 023017 | 228012 | N/A |
| Asic1 | 023017 | 228185 | 154379 |
| Asic1 | 023017 | 228610 | N/A |
| Asic1 | 023017 | 227670 | N/A |
| Asic2 | 020704 | 021045 | 021045 |
| Asic2 | 020704 | 066197 | 067095 |
| Asns | 029752 | 115542 | 111204 |
| Asns | 029752 | 031766 | 031766 |
| Asns | 029752 | 140097 | N/A |
| Asns | 029752 | 133972 | N/A |
| Asns | 029752 | 126303 | 115415 |
| Asns | 029752 | 139596 | 120489 |
| Asns | 029752 | 148349 | 118003 |
| Aspa | 020774 | 021119 | 021119 |
| Aspa | 020774 | 184572 | 139318 |
| Aspa | 020774 | 155630 | 139131 |
| Aspa | 020774 | 132774 | N/A |
| Aspa | 020774 | 134079 | 121135 |
| Aspa | 020774 | 141898 | 118109 |
| Astn2 | 028373 | 068214 | 065786 |
| Astn2 | 028373 | 084496 | 081540 |
| Atl2 | 059811 | 068282 | 064758 |
| Atl2 | 059811 | 223273 | N/A |
| Atl2 | 059811 | 221286 | N/A |
| Atl2 | 059811 | 222193 | 152340 |
| Atl2 | 059811 | 222415 | 152866 |
| Atl2 | 059811 | 221666 | N/A |
| Atl2 | 059811 | 222243 | N/A |
| Atl2 | 059811 | 112437 | 108056 |
| Atl3 | 024759 | 170373 | 132619 |
| Atl3 | 024759 | 025668 | 025668 |

TABLE 2-continued

| ENSEMBL IDs for mice | | | |
|---|---|---|---|
| Symbol | MUSG | MUST | MUSP |
| Atp13a4 | 038094 | 182573 | 138700 |
| Atp13a4 | 038094 | 182627 | 138479 |
| Atp13a4 | 038094 | 057018 | 060987 |
| Atp13a4 | 038094 | 182676 | N/A |
| Atp13a4 | 038094 | 182013 | 138583 |
| Atp13a4 | 038094 | 182094 | N/A |
| Atp13a4 | 038094 | 182357 | N/A |
| Atp13a4 | 038094 | 182168 | 138515 |
| Atp13a4 | 038094 | 039090 | 048753 |
| Atp13a4 | 038094 | 182824 | N/A |
| Atp13a4 | 038094 | 182694 | N/A |
| Atp1a1 | 033161 | 036493 | 039657 |
| Atp1a1 | 033161 | 130649 | N/A |
| Atp1a1 | 033161 | 136340 | N/A |
| Atp1a2 | 007097 | 085913 | 083077 |
| Atp1a2 | 007097 | 131751 | N/A |
| Atp1a2 | 007097 | 191781 | N/A |
| Atp1a2 | 007097 | 097464 | 095072 |
| Atp1a2 | 007097 | 137679 | N/A |
| Atp1a3 | 040907 | 102858 | 099922 |
| Atp1a3 | 040907 | 080882 | 079691 |
| Atp1a3 | 040907 | 196684 | 143735 |
| Atp1a3 | 040907 | 146595 | N/A |
| Atp1a3 | 040907 | 125444 | N/A |
| Atp1b1 | 026576 | 027863 | 027863 |
| Atp1b1 | 026576 | 193980 | N/A |
| Atp1b1 | 026576 | 193367 | 141777 |
| Atp1b1 | 026576 | 192522 | N/A |
| Atp1b2 | 041329 | 047889 | 047353 |
| Atp1b2 | 041329 | 130394 | N/A |
| Atp1b2 | 041329 | 138694 | 116290 |
| Atp1b2 | 041329 | 144425 | N/A |
| Atp1b2 | 041329 | 153198 | N/A |
| Atp2a3 | 020788 | 108486 | 104126 |
| Atp2a3 | 020788 | 108484 | 104124 |
| Atp2a3 | 020788 | 149493 | N/A |
| Atp2a3 | 020788 | 135234 | N/A |
| Atp2a3 | 020788 | 163326 | 127036 |
| Atp2a3 | 020788 | 108485 | 104125 |
| Atp2a3 | 020788 | 021142 | 021142 |
| Atp2b2 | 030302 | 101045 | 098606 |
| Atp2b2 | 030302 | 089003 | 086398 |
| Atp2b2 | 030302 | 152831 | 138165 |
| Atp2b2 | 030302 | 205052 | 145174 |
| Atp2b2 | 030302 | 101044 | 098605 |
| Atp2b2 | 030302 | 135199 | N/A |
| Atp2b2 | 030302 | 144507 | N/A |
| Atp2b2 | 030302 | 154738 | N/A |
| Atp2b3 | 031376 | 033744 | 033744 |
| Atp2b3 | 031376 | 088429 | 085775 |
| Atp2b3 | 031376 | 114479 | 110123 |
| Atp8a1 | 037685 | 135930 | 118379 |
| Atp8a1 | 037685 | 037380 | 042215 |
| Atp8a1 | 037685 | 072971 | 072738 |
| Atp8a1 | 037685 | 200955 | 144465 |
| Atp8a1 | 037685 | 149501 | N/A |
| Atp8a1 | 037685 | 155911 | N/A |
| Atp8a1 | 037685 | 152433 | N/A |
| Atp8a1 | 037685 | 130652 | N/A |
| Atp8a1 | 037685 | 113652 | 109282 |
| Atp8a1 | 037685 | 113651 | 109281 |
| Atp8a1 | 037685 | 143013 | N/A |
| Atp8a1 | 037685 | 202248 | N/A |
| Atp8a1 | 037685 | 128726 | N/A |
| Atp8a1 | 037685 | 141443 | 121630 |
| Atp8b1 | 039529 | 025482 | 025482 |
| Atrnl1 | 054843 | 077282 | 076514 |
| Atxn1 | 046876 | 091628 | 089217 |
| Atxn1 | 046876 | 167708 | 129890 |
| Atxn1 | 046876 | 180110 | 137439 |
| Atxn1 | 046876 | 221082 | N/A |
| Atxn1 | 046876 | 222943 | N/A |
| Atxn1 | 046876 | 222610 | N/A |
| Axl | 002602 | 002677 | 002677 |
| Axl | 002602 | 085948 | 083110 |
| Axl | 002602 | 124442 | N/A |

TABLE 2-continued

| ENSEMBL IDs for mice | | | |
|---|---|---|---|
| Symbol | MUSG | MUST | MUSP |
| Axl | 002602 | 137211 | N/A |
| Axl | 002602 | 132989 | N/A |
| Axl | 002602 | 132038 | 114907 |
| Axl | 002602 | 147680 | N/A |
| Axl | 002602 | 137383 | N/A |
| B230209E15Rik | 109006 | 209115 | N/A |
| B230209E15Rik | 109006 | 211785 | N/A |
| B3gat2 | 026156 | 144602 | 115870 |
| B3gat2 | 026156 | 063663 | 066582 |
| B3gat2 | 026156 | 140583 | 117089 |
| B3glct | 051950 | 100404 | 097972 |
| B3glct | 051950 | 202302 | N/A |
| B3glct | 051950 | 201088 | N/A |
| B3gnt5 | 022686 | 121344 | 112624 |
| B3gnt5 | 022686 | 079780 | 078712 |
| B3gnt5 | 022686 | 152845 | N/A |
| B3gnt5 | 022686 | 131557 | N/A |
| B3gnt5 | 022686 | 155780 | N/A |
| B3gnt5 | 022686 | 119468 | 113145 |
| B3gnt5 | 022686 | 164397 | 126157 |
| B3gnt7 | 079445 | 189618 | N/A |
| B3gnt7 | 079445 | 113306 | 108931 |
| B3gnt7 | 079445 | 188695 | 140392 |
| B4galt6 | 056124 | 070080 | 066515 |
| Bach2 | 040270 | 108180 | 103815 |
| Bach2 | 040270 | 037416 | 043693 |
| Bach2 | 040270 | 149201 | N/A |
| Bach2 | 040270 | 156430 | N/A |
| Bach2 | 040270 | 146748 | N/A |
| Bach2 | 040270 | 125263 | N/A |
| Bach2 | 040270 | 171600 | 131592 |
| Baiap2 | 025372 | 026436 | 026436 |
| Baiap2 | 025372 | 106231 | 101838 |
| Baiap2 | 025372 | 075180 | 074674 |
| Baiap2 | 025372 | 103021 | 099310 |
| Baiap2 | 025372 | 106233 | 101840 |
| Baiap2 | 025372 | 146566 | N/A |
| Baiap2 | 025372 | 146960 | N/A |
| Baiap2 | 025372 | 152523 | N/A |
| Baiap2 | 025372 | 131580 | N/A |
| Barhl2 | 034384 | 086795 | 084005 |
| Basp1 | 045763 | 058845 | 053943 |
| Basp1 | 045763 | 228597 | 154675 |
| Bbs2 | 031755 | 034206 | 034206 |
| Bbs2 | 031755 | 170208 | N/A |
| Bbs2 | 031755 | 172347 | N/A |
| BC052040 | 040282 | 110918 | 106543 |
| BC052040 | 040282 | 147968 | N/A |
| BC052040 | 040282 | 166472 | 126772 |
| Bcar1 | 031955 | 166232 | 129584 |
| Bcar1 | 031955 | 212349 | 148364 |
| Bcar1 | 031955 | 212147 | N/A |
| Bche | 027792 | 029367 | 029367 |
| Bche | 027792 | 133690 | N/A |
| Bche | 027792 | 138216 | 141329 |
| Bche | 027792 | 153917 | N/A |
| Bcl11a | 000861 | 118955 | 112948 |
| Bcl11a | 000861 | 127494 | N/A |
| Bcl11a | 000881 | 000881 | 000881 |
| Bcl11a | 000861 | 124148 | N/A |
| Bcl11a | 000861 | 109516 | 105142 |
| Bcl11a | 000861 | 109514 | 105140 |
| Bcl11b | 048251 | 066060 | 068258 |
| Bcl11b | 048251 | 109887 | 105513 |
| Bcl11b | 048251 | 109891 | 105517 |
| Bcl11b | 048251 | 066060 | 068258 |
| Bcl11b | 048251 | 109887 | 105513 |
| Bcl11b | 048251 | 109891 | 105517 |
| Bean1 | 031872 | 164076 | 132056 |
| Bean1 | 031872 | 093245 | 090931 |
| Bean1 | 031872 | 212979 | 148571 |
| Bean1 | 031872 | 213077 | 148283 |
| Bean1 | 031872 | 171018 | 129403 |
| Bean1 | 031872 | 167633 | 131530 |
| Bhlhe22 | 025128 | 026120 | 026120 |
| Bicd1 | 003452 | 203502 | N/A |

TABLE 2-continued

| ENSEMBL IDs for mice | | | |
|---|---|---|---|
| Symbol | MUSG | MUST | MUSP |
| Bicd1 | 003452 | 086829 | 084039 |
| Bicd1 | 003452 | 111513 | 107138 |
| Bicd1 | 003452 | 130270 | N/A |
| Bicd1 | 003452 | 003544 | 003544 |
| Bicd1 | 003452 | 173408 | 133727 |
| Bicd1 | 003452 | 174886 | N/A |
| Bicd1 | 003452 | 172926 | 133986 |
| Bicd1 | 003452 | 140759 | N/A |
| Bicd2 | 037933 | 048544 | 039394 |
| Bicd2 | 037933 | 110084 | 105711 |
| Bicd2 | 037933 | 110085 | 105712 |
| Bicd2 | 037933 | 220723 | 152090 |
| Blm | 030528 | 206901 | 146062 |
| Blm | 030528 | 081314 | 080062 |
| Blm | 030528 | 170315 | 127995 |
| Blm | 030528 | 206518 | N/A |
| Blm | 030528 | 206948 | N/A |
| Blm | 030528 | 206989 | 146098 |
| Blm | 030528 | 205730 | 145573 |
| Blm | 030528 | 205263 | N/A |
| Blm | 030528 | 205713 | N/A |
| Blm | 030528 | 205584 | N/A |
| Bmp2k | 034663 | 112974 | 108598 |
| Bmp2k | 034663 | 035635 | 037970 |
| Bnc2 | 028487 | 102820 | 099884 |
| Bnc2 | 028487 | 107198 | 102816 |
| Bnc2 | 028487 | 176612 | 135778 |
| Bnc2 | 028487 | 176971 | 135607 |
| Bnc2 | 028487 | 176691 | 135375 |
| Bnc2 | 028487 | 177277 | 135580 |
| Bnc2 | 028487 | 176702 | 134774 |
| Bnc2 | 028487 | 176998 | 135283 |
| Bnc2 | 028487 | 176601 | 135480 |
| Bnc2 | 028487 | 175800 | 134795 |
| Bnc2 | 028487 | 176418 | 135569 |
| Bnc2 | 028487 | 175757 | N/A |
| Bnc2 | 028487 | 176947 | 135411 |
| Bnc2 | 028487 | 175969 | 135656 |
| Bnc2 | 028487 | 176476 | N/A |
| Bnc2 | 028487 | 123276 | N/A |
| Bnc2 | 028487 | 176346 | 134942 |
| Bnc2 | 028487 | 177256 | N/A |
| Bnc2 | 028487 | 175756 | 135499 |
| Bnc2 | 028487 | 177040 | 135089 |
| Bnc2 | 028487 | 176264 | N/A |
| Bnc2 | 028487 | 176370 | 134953 |
| Boc | 022687 | 114634 | 110281 |
| Brinp2 | 004031 | 195271 | 141709 |
| Brinp2 | 004031 | 004133 | 004133 |
| Brinp2 | 004031 | 194578 | N/A |
| Brinp2 | 004031 | 192709 | N/A |
| Brinp3 | 035131 | 074622 | 074201 |
| Brinp3 | 035131 | 132847 | 118552 |
| Brinp3 | 035131 | 128345 | 116763 |
| Brinp3 | 035131 | 125331 | N/A |
| Brinp3 | 035131 | 166814 | 126074 |
| Bsg | 023175 | 179781 | 136487 |
| Bsg | 023175 | 067036 | 070751 |
| Bsg | 023175 | 179201 | N/A |
| Bsg | 023175 | 178383 | 137126 |
| Bsg | 023175 | 105381 | 101020 |
| Bsg | 023175 | 180235 | N/A |
| Bsn | 032589 | 035208 | 035208 |
| Bsn | 032589 | 124763 | 139053 |
| Btbd1 | 025103 | 026093 | 026093 |
| Btbd1 | 025103 | 208114 | N/A |
| Btbd1 | 025103 | 208178 | N/A |
| Btbd1 | 025103 | 208566 | N/A |
| Btbd11 | 020042 | 105307 | 100944 |
| Btbd11 | 020042 | 020231 | 020231 |
| Btbd11 | 020042 | 105306 | 100943 |
| Btbd11 | 020042 | 135235 | N/A |
| Btbd11 | 020042 | 145323 | N/A |
| Btbd11 | 020042 | 128338 | N/A |
| Btbd11 | 020042 | 156123 | N/A |
| Btbd11 | 020042 | 145433 | N/A |

TABLE 2-continued

ENSEMBL IDs for mice

| Symbol | MUSG | MUST | MUSP |
|---|---|---|---|
| Btbd17 | 000202 | 156053 | N/A |
| Btbd17 | 000202 | 000206 | 000206 |
| Btbd17 | 000202 | 156192 | N/A |
| Btbd17 | 000202 | 141481 | N/A |
| Btbd17 | 000202 | 146853 | N/A |
| Btbd17 | 000202 | 141386 | N/A |
| Btbd17 | 000202 | 137965 | N/A |
| 2410131K14Rik | 032840 | 049138 | 043410 |
| 3632451O06Rik | 036242 | 036972 | 036220 |
| 3632451O06Rik | 036242 | 118129 | 113609 |
| 3632451O06Rik | 036242 | 177321 | N/A |
| 1700025G04Rik | 032666 | 187603 | 140950 |
| 1700025G04Rik | 032666 | 044581 | 036406 |
| 1700025G04Rik | 032666 | 128433 | N/A |
| 1700025G04Rik | 032666 | 121533 | 113971 |
| C1ql1 | 045532 | 057849 | 050469 |
| C1ql2 | 036907 | 037286 | 037257 |
| C1qtnf4 | 040794 | 111466 | 107091 |
| C1qtnf4 | 110961 | 214937 | 150588 |
| 2810459M11Rik | 026227 | 027429 | 027429 |
| 2810459M11Rik | 026227 | 165824 | 131459 |
| C3 | 024164 | 024988 | 024988 |
| C3 | 024164 | 177425 | 135663 |
| C3 | 024164 | 177046 | 135560 |
| C3 | 024164 | 176457 | N/A |
| A830018L16Rik | 057715 | 048613 | 043857 |
| A830018L16Rik | 057715 | 150870 | N/A |
| A830018L16Rik | 057715 | 142117 | N/A |
| A830018L16Rik | 057715 | 141512 | 139635 |
| A830018L16Rik | 057715 | 135014 | 119143 |
| A830018L16Rik | 057715 | 137824 | 117421 |
| A830018L16Rik | 057715 | 179089 | 137287 |
| A830018L16Rik | 057715 | 141339 | 121311 |
| A830018L16Rik | 057715 | 191437 | N/A |
| A830018L16Rik | 057715 | 171690 | 132334 |
| 3110035E14Rik | 067879 | 088666 | 086041 |
| 3110043O21Rik | 028300 | 084724 | 081775 |
| 3110043O21Rik | 028300 | 108126 | 103761 |
| 3110043O21Rik | 028300 | 108127 | 103762 |
| 3110043O21Rik | 028300 | 142628 | N/A |
| 3110043O21Rik | 028300 | 156472 | N/A |
| 3110043O21Rik | 028300 | 130538 | N/A |
| 3110043O21Rik | 028300 | 149138 | N/A |
| Cab39l | 021981 | 225149 | N/A |
| Cab39l | 021981 | 224281 | N/A |
| Cab39l | 021981 | 022553 | 022553 |
| Cab39l | 021981 | 225595 | 153643 |
| Cab39l | 021981 | 223678 | 153281 |
| Cab39l | 021981 | 224893 | 153449 |
| Abl1 | 026842 | 146537 | N/A |
| Abl1 | 026842 | 156736 | N/A |
| Abl1 | 026842 | 075759 | 075167 |
| Abl1 | 026842 | 142554 | 142123 |
| Abl1 | 026842 | 123471 | 142297 |
| Abl1 | 026842 | 135233 | 141320 |
| Abl1 | 026842 | 028190 | 028190 |
| Abl1 | 026842 | 124089 | 117748 |
| Abl1 | 026842 | 127714 | N/A |
| Abl1 | 026842 | 124726 | N/A |
| Cables1 | 040957 | 171109 | 129463 |
| Cables1 | 040957 | 046948 | 040639 |
| Cables1 | 040957 | 225430 | N/A |
| Cabp1 | 029544 | 031519 | 031519 |
| Cabp1 | 029544 | 112113 | 107741 |
| Cabp1 | 029544 | 112109 | N/A |
| Cabp1 | 029544 | 112112 | 107740 |
| Cabp1 | 029544 | 145197 | 138183 |
| Cabp1 | 029544 | 151775 | N/A |
| Cabp1 | 029544 | 201900 | N/A |
| Cachd1 | 028532 | 030257 | 030257 |
| Cachd1 | 028532 | 097955 | 095568 |
| Cachd1 | 028532 | 123475 | N/A |
| Cachd1 | 028532 | 136430 | N/A |
| Cacna1a | 034656 | 135382 | N/A |
| Cacna1a | 034656 | 121390 | 112436 |
| Cacna1a | 034656 | 122053 | 114055 |

TABLE 2-continued

ENSEMBL IDs for mice

| Symbol | MUSG | MUST | MUSP |
|---|---|---|---|
| Cacna1a | 034656 | 215756 | 149242 |
| Cacna1a | 034656 | 129620 | N/A |
| Cacna1a | 034656 | 126302 | N/A |
| Cacna1a | 034656 | 143215 | N/A |
| Cacna1a | 034656 | 141981 | N/A |
| Cacna1a | 034656 | 144879 | N/A |
| Cacna1a | 034656 | 153691 | N/A |
| Cacna1a | 034656 | 130507 | N/A |
| Cacna1b | 004113 | 070864 | 063236 |
| Cacna1b | 004113 | 102939 | 100003 |
| Cacna1b | 004113 | 131861 | 141653 |
| Cacna1b | 004113 | 041342 | 037416 |
| Cacna1b | 004113 | 114447 | 110090 |
| Cacna1b | 004113 | 133892 | 115285 |
| Cacna1b | 004113 | 125798 | 141767 |
| Cacna1b | 004113 | 155356 | 116674 |
| Cacna1b | 004113 | 124183 | 114605 |
| Cacna1b | 004113 | 100348 | 097920 |
| Cacna1e | 004110 | 187541 | 140937 |
| Cacna1e | 004110 | 211821 | 148507 |
| Cacna1e | 004110 | 226546 | 153897 |
| Cacna1e | 004110 | 188384 | N/A |
| Cacna1e | 004110 | 188965 | N/A |
| Cacna1e | 004110 | 188321 | N/A |
| Cacna1e | 004110 | 186256 | N/A |
| Cacna1e | 004110 | 004214 | 004214 |
| Cacna1g | 020866 | 107786 | 103415 |
| Cacna1g | 020866 | 107791 | 103420 |
| Cacna1g | 020866 | 103166 | 099455 |
| Cacna1g | 020866 | 107792 | 103421 |
| Cacna1g | 020866 | 100561 | 098127 |
| Cacna1g | 020866 | 107793 | 103422 |
| Cacna1g | 020866 | 107788 | 103417 |
| Cacna1g | 020866 | 107790 | 103419 |
| Cacna1g | 020866 | 107789 | 103418 |
| Cacna1g | 020866 | 107785 | 103414 |
| Cacna1g | 020866 | 133331 | N/A |
| Cacna1g | 020866 | 146160 | N/A |
| Cacna1g | 020866 | 142190 | N/A |
| Cacna1g | 020866 | 133000 | N/A |
| Cacna1g | 020866 | 152811 | N/A |
| Cacna1g | 020866 | 021234 | 021234 |
| Cacna2d1 | 040118 | 101581 | 099117 |
| Cacna2d1 | 040118 | 039370 | 049457 |
| Cacna2d1 | 040118 | 199704 | 142881 |
| Cacna2d1 | 040118 | 180204 | 136260 |
| Cacna2d1 | 040118 | 078272 | 077391 |
| Cacna2d1 | 040118 | 196750 | 143082 |
| Cacna2d1 | 040118 | 200270 | N/A |
| Cacna2d1 | 040118 | 200158 | N/A |
| Cacna2d1 | 040118 | 200294 | N/A |
| Cacna2d1 | 040118 | 199236 | N/A |
| Cacna2d1 | 040118 | 115281 | 110936 |
| Cacna2d1 | 040118 | 167946 | 131507 |
| Cacna2d2 | 010066 | 010210 | 010210 |
| Cacna2d2 | 010066 | 168532 | 132512 |
| Cacna2d2 | 010066 | 085092 | 082173 |
| Cacna2d2 | 010066 | 166799 | 126029 |
| Cacna2d2 | 010066 | 170737 | 125943 |
| Cacna2d2 | 010066 | 169354 | N/A |
| Cacna2d2 | 010066 | 171809 | N/A |
| Cacna2d2 | 010066 | 194842 | N/A |
| Cacna2d2 | 010066 | 168959 | N/A |
| Cacna2d2 | 010066 | 164988 | 130451 |
| Cacna2d3 | 021991 | 022567 | 022567 |
| Cacna2d3 | 021991 | 225985 | 152967 |
| Cacna2d3 | 021991 | 225668 | 153037 |
| Cacna2d3 | 021991 | 225733 | 153143 |
| Cacna2d3 | 021991 | 225863 | 153444 |
| Cacna2d3 | 021991 | 224950 | N/A |
| Cacna2d3 | 021991 | 226048 | N/A |
| Cacna2d3 | 021991 | 225953 | N/A |
| Cacna2d3 | 021991 | 224128 | N/A |
| Cacnb4 | 017412 | 102760 | 099821 |
| Cacnb4 | 017412 | 102761 | 099822 |
| Cacnb4 | 017412 | 078324 | 077438 |

TABLE 2-continued

ENSEMBL IDs for mice

| Symbol | MUSG | MUST | MUSP |
|---|---|---|---|
| Cacnb4 | 017412 | 132322 | N/A |
| Cacnb4 | 017412 | 148837 | N/A |
| Cacnb4 | 017412 | 178799 | 136811 |
| Cacng3 | 066189 | 084615 | 081664 |
| Cacng3 | 066189 | 182563 | 138495 |
| Cacng3 | 066189 | 182095 | 138755 |
| Cacng4 | 020723 | 021066 | 021066 |
| Cacng4 | 020723 | 134076 | N/A |
| Cacng5 | 040373 | 039071 | 047888 |
| Cacng5 | 040373 | 106742 | 102353 |
| Cadm3 | 005338 | 111220 | 106851 |
| Cadm3 | 005338 | 005470 | 005470 |
| Cadm3 | 005338 | 136540 | N/A |
| Cadm3 | 005338 | 157032 | N/A |
| Cadm3 | 005338 | 126963 | N/A |
| Cadps2 | 017978 | 115358 | 111015 |
| Cadps2 | 017978 | 018122 | 018122 |
| Cadps2 | 017978 | 142913 | 138167 |
| Cadps2 | 017978 | 115361 | 111018 |
| Cadps2 | 017978 | 156986 | N/A |
| Cadps2 | 017978 | 125350 | 115866 |
| Cadps2 | 017978 | 069074 | 064876 |
| Cadps2 | 017978 | 152131 | N/A |
| Cadps2 | 017978 | 115356 | 111013 |
| Cadps2 | 017978 | 136279 | N/A |
| Cadps2 | 017978 | 115355 | N/A |
| Cadps2 | 017978 | 166458 | 125972 |
| Cadps2 | 017978 | 163871 | 128905 |
| Calb1 | 028222 | 029876 | 029876 |
| Calb1 | 028222 | 136266 | N/A |
| Calb1 | 028222 | 141336 | N/A |
| Calb2 | 003657 | 212297 | 148680 |
| Calb2 | 003657 | 003754 | 003754 |
| Caln1 | 060371 | 086029 | 083193 |
| Caln1 | 060371 | 202728 | 143823 |
| Caln1 | 060371 | 141131 | 144225 |
| Caln1 | 060371 | 111287 | 106918 |
| Caln1 | 060371 | 111288 | 106919 |
| Camk1g | 016179 | 169907 | 128143 |
| Camk1g | 016179 | 016323 | 016323 |
| Camk1g | 016179 | 163202 | 131451 |
| Camk1g | 016179 | 165718 | N/A |
| Camk2a | 024617 | 102888 | 099952 |
| Camk2a | 024617 | 134496 | N/A |
| Camk2a | 024617 | 025519 | 025519 |
| Camk2a | 024617 | 115297 | 110952 |
| Camk2a | 024617 | 137805 | 123480 |
| Camk2a | 024617 | 115295 | 110950 |
| Camk2a | 024617 | 039904 | 048325 |
| Camk2g | 021820 | 100837 | 098398 |
| Camk2g | 021820 | 071816 | 071720 |
| Camk2g | 021820 | 080440 | 079298 |
| Camk2g | 021820 | 223863 | 153007 |
| Camk2g | 021820 | 226630 | 154158 |
| Camk2g | 021820 | 225328 | 152992 |
| Camk2g | 021820 | 224887 | 153165 |
| Camk2g | 021820 | 223712 | 153471 |
| Camk2g | 021820 | 225609 | 152903 |
| Camk2g | 021820 | 225463 | 153453 |
| Camk2g | 021820 | 225660 | N/A |
| Camk2g | 021820 | 225958 | N/A |
| Camk2g | 021820 | 224245 | N/A |
| Camk2g | 021820 | 225800 | N/A |
| Camk2g | 021820 | 224566 | N/A |
| Camk2g | 021820 | 224804 | N/A |
| Camk2g | 021820 | 225635 | N/A |
| Camk4 | 038128 | 042868 | 046539 |
| Camkv | 032936 | 035700 | 040430 |
| Camkv | 032936 | 192318 | N/A |
| Camkv | 032936 | 193533 | 141347 |
| Camkv | 032936 | 195219 | 142005 |
| Camkv | 032936 | 194206 | 141444 |
| Cap2 | 021373 | 021802 | 021802 |
| Cap2 | 021373 | 119341 | 112952 |
| Cap2 | 021373 | 225824 | 153125 |
| Cap2 | 021373 | 225444 | N/A |

TABLE 2-continued

ENSEMBL IDs for mice

| Symbol | MUSG | MUST | MUSP |
|---|---|---|---|
| Cap2 | 021373 | 126687 | 153072 |
| Capn5 | 035547 | 040971 | 048183 |
| Capn5 | 035547 | 107112 | 102729 |
| Capn5 | 035547 | 134638 | N/A |
| Capn5 | 035547 | 155056 | 116697 |
| Capn5 | 035547 | 129430 | 121200 |
| Capzb | 028745 | 102508 | 099566 |
| Capzb | 028745 | 131912 | 114973 |
| Capzb | 028745 | 102507 | 099565 |
| Capzb | 028745 | 131793 | N/A |
| Capzb | 028745 | 150077 | N/A |
| Capzb | 028745 | 030518 | 030518 |
| Capzb | 028745 | 156760 | N/A |
| Capzb | 028745 | 145368 | 119252 |
| Capzb | 028745 | 138045 | 122077 |
| Capzb | 028745 | 042675 | 038011 |
| Capzb | 028745 | 132385 | N/A |
| Car12 | 032373 | 071889 | 071786 |
| Car12 | 032373 | 152011 | N/A |
| Car12 | 032373 | 123195 | N/A |
| Car12 | 032373 | 217394 | N/A |
| Car12 | 032373 | 085420 | 082541 |
| Car12 | 032373 | 134829 | 118030 |
| Car14 | 038526 | 036181 | 036983 |
| Car14 | 038526 | 147962 | 117464 |
| Car14 | 038526 | 149202 | N/A |
| Car14 | 038526 | 126722 | N/A |
| Car2 | 027562 | 192609 | 141876 |
| Car2 | 027562 | 029078 | 029078 |
| Car2 | 027562 | 195520 | N/A |
| Car4 | 000805 | 139416 | N/A |
| Car4 | 000805 | 103194 | 099483 |
| Car4 | 000805 | 138331 | N/A |
| Car4 | 000805 | 150596 | 121381 |
| Car4 | 000805 | 127827 | 115878 |
| Car4 | 000805 | 108076 | 103711 |
| Car7 | 031883 | 212942 | N/A |
| Car7 | 031883 | 159416 | 125112 |
| Car7 | 031883 | 056051 | 052136 |
| Car7 | 031883 | 162761 | 125404 |
| Car7 | 031883 | 162399 | N/A |
| Car8 | 041261 | 066674 | 063511 |
| Carmil1 | 021338 | 125901 | 126522 |
| Carmil1 | 021338 | 151566 | 120971 |
| Carmil1 | 021338 | 072889 | 072662 |
| Carmil1 | 021338 | 110398 | 106028 |
| Carmil1 | 021338 | 147261 | N/A |
| Carmil1 | 021338 | 142171 | N/A |
| Carmil1 | 021338 | 128416 | N/A |
| Carmil1 | 021338 | 125420 | N/A |
| Carmil1 | 021338 | 144159 | N/A |
| Carmil1 | 021338 | 140042 | 127121 |
| Carmil1 | 021338 | 123076 | 130100 |
| Carmil1 | 021338 | 136517 | N/A |
| Carns1 | 075289 | 167055 | 131624 |
| Casp12 | 025887 | 027009 | 027009 |
| Casp12 | 025887 | 151788 | 121565 |
| Casp12 | 025887 | 149520 | N/A |
| Casp12 | 025887 | 138308 | N/A |
| Casp12 | 025887 | 151332 | 122201 |
| Casq2 | 027861 | 029454 | 029454 |
| Casq2 | 027861 | 165540 | 130482 |
| Casq2 | 027861 | 164123 | 131232 |
| Casq2 | 027861 | 159521 | N/A |
| Casq2 | 027861 | 159833 | N/A |
| Cav1 | 007655 | 007799 | 007799 |
| Cav1 | 007655 | 115456 | 111116 |
| Cav1 | 007655 | 115455 | 111115 |
| Cav1 | 007655 | 130505 | N/A |
| Cav1 | 007655 | 177234 | 135875 |
| Cav1 | 007655 | 150901 | 135374 |
| Cav1 | 007655 | 123439 | 120252 |
| Cav1 | 007655 | 115454 | 111114 |
| Cav1 | 007655 | 115453 | 111113 |
| Cav1 | 007655 | 133065 | N/A |
| Cav2 | 000058 | 000058 | 000058 |

TABLE 2-continued

ENSEMBL IDs for mice

| Symbol | MUSG | MUST | MUSP |
|---|---|---|---|
| Cav2 | 000058 | 115459 | 111119 |
| Cav2 | 000058 | 115462 | 111122 |
| Cbfb | 031885 | 052209 | 059382 |
| Cbfb | 031885 | 109392 | 105019 |
| Cbfb | 031885 | 109395 | 105022 |
| Cbfb | 031885 | 109394 | 105021 |
| Cbfb | 031885 | 186070 | N/A |
| Cbfb | 031885 | 190915 | N/A |
| Cbfb | 031885 | 187323 | N/A |
| Cbln1 | 031654 | 034076 | 034076 |
| Cbln1 | 031654 | 211279 | N/A |
| Cbln1 | 031654 | 169693 | 126575 |
| Cbln2 | 024647 | 068423 | 068863 |
| Cbln2 | 024647 | 122464 | 113996 |
| Cbln2 | 024647 | 122079 | 113695 |
| Cbln2 | 024647 | 169470 | 126810 |
| Cbln3 | 040380 | 063871 | 070494 |
| Cbln3 | 040380 | 172378 | 127798 |
| Ccdc13 | 079235 | 135986 | 114787 |
| Ccdc13 | 079235 | 155511 | 128061 |
| Ccdc13 | 079235 | 126851 | N/A |
| Ccdc13 | 079235 | 142783 | 130887 |
| Ccdc13 | 079235 | 140929 | N/A |
| Ccdc13 | 079235 | 146716 | N/A |
| Ccdc152 | 091119 | 226261 | 153730 |
| Ccdc152 | 091119 | 228405 | 153740 |
| Ccdc152 | 091119 | 165386 | 129305 |
| Ccdc175 | 021086 | 021494 | 021494 |
| Ccdc180 | 035539 | 127261 | N/A |
| Ccdc180 | 035539 | 149903 | 119784 |
| Ccdc180 | 035539 | 151024 | 122332 |
| Ccdc180 | 035539 | 178561 | 136714 |
| Ccdc80 | 022665 | 139509 | N/A |
| Ccdc80 | 022665 | 138048 | N/A |
| Ccdc80 | 022665 | 155800 | N/A |
| Ccdc80 | 022665 | 099498 | 097097 |
| Ccdc80 | 022665 | 134924 | N/A |
| Ccdc80 | 022665 | 061050 | 058752 |
| Ccdc85a | 032878 | 160016 | 125648 |
| Ccdc85a | 032878 | 140601 | 124184 |
| Ccdc85a | 032878 | 093253 | 090941 |
| Ccdc85a | 032878 | 146385 | 124972 |
| Ccdc85a | 032878 | 042534 | 044649 |
| Ccdc85a | 032878 | 109501 | N/A |
| Ccdc85a | 032878 | 109502 | 105128 |
| Ccdc88a | 032740 | 040182 | 048978 |
| Ccdc88a | 032740 | 123561 | 119173 |
| Ccdc88a | 032740 | 155854 | 115117 |
| Ccdc88a | 032740 | 140194 | 114942 |
| Ccdc88a | 032740 | 137227 | N/A |
| Ccdc88a | 032740 | 144450 | N/A |
| Ccdc88a | 032740 | 109477 | 105103 |
| Cck | 032532 | 216176 | 149163 |
| Cck | 032532 | 216138 | 150080 |
| Cck | 032532 | 035120 | 035120 |
| Cck | 032532 | 215228 | 149679 |
| Cck | 032532 | 213106 | 149410 |
| Cck | 032532 | 217581 | 150557 |
| Cckbr | 030898 | 033189 | 033189 |
| Cckbr | 030898 | 181339 | 138052 |
| Ccnd1 | 070348 | 093962 | 091495 |
| Ccnd1 | 070348 | 208193 | N/A |
| Ccnd1 | 070348 | 135985 | N/A |
| Ccnd2 | 000184 | 000188 | 000188 |
| Ccnd2 | 000184 | 201564 | N/A |
| Ccnd2 | 000184 | 201985 | N/A |
| Ccnd2 | 000184 | 201902 | 144006 |
| Ccnd2 | 000184 | 202363 | N/A |
| Ccnd2 | 000184 | 201066 | 144095 |
| Ccnd2 | 000184 | 201637 | 144245 |
| Ccnd2 | 000184 | 201857 | N/A |
| Cd70 | 019489 | 019633 | 019633 |
| Cd82 | 027215 | 099696 | 097287 |
| Cd82 | 027215 | 028644 | 028644 |
| Cd82 | 027215 | 126772 | N/A |
| Cd82 | 027215 | 111257 | 106888 |
| Cd82 | 027215 | 123565 | 114762 |
| Cd82 | 027215 | 145553 | 115310 |
| Cd82 | 027215 | 150508 | 120183 |
| Cd82 | 027215 | 111256 | 106887 |
| Cd82 | 027215 | 144168 | N/A |
| Cd82 | 027215 | 124804 | 115349 |
| Cd82 | 027215 | 116457 | 112158 |
| Cd9 | 030342 | 032492 | 032492 |
| Cd9 | 030342 | 130132 | N/A |
| Cd9 | 030342 | 140024 | N/A |
| Cdc14b | 033102 | 221634 | 152388 |
| Cdc14b | 033102 | 039318 | 046003 |
| Cdc14b | 033102 | 221139 | 152843 |
| Cdc14b | 033102 | 109769 | 105391 |
| Cdc14b | 033102 | 221788 | N/A |
| Cdc14b | 033102 | 222713 | 152246 |
| Cdc14b | 033102 | 221217 | 152736 |
| Cdc14b | 033102 | 222766 | 152870 |
| Cdc14b | 033102 | 223116 | N/A |
| Cdc14b | 033102 | 221437 | N/A |
| Cdc14b | 033102 | 109770 | 105392 |
| Cdc42ep1 | 049521 | 059619 | 060930 |
| Cdc42ep4 | 041598 | 106616 | 102227 |
| Cdc42ep4 | 041598 | 053536 | 060227 |
| Cdc42ep4 | 041598 | 131488 | 114599 |
| Cdc42ep4 | 041598 | 153453 | 120316 |
| Cdh1 | 000303 | 000312 | 000312 |
| Cdh1 | 000303 | 136580 | N/A |
| Cdh1 | 000303 | 167688 | 132112 |
| Cdh10 | 022321 | 166873 | 128782 |
| Cdh10 | 022321 | 176801 | N/A |
| Cdh10 | 022321 | 176593 | N/A |
| Cdh10 | 022321 | 040562 | 042199 |
| Cdh10 | 022321 | 176146 | 135546 |
| Cdh10 | 022321 | 176409 | N/A |
| Cdh11 | 031673 | 075190 | 074681 |
| Cdh11 | 031673 | 210578 | N/A |
| Cdh11 | 031673 | 210425 | N/A |
| Cdh13 | 031841 | 117160 | 113527 |
| Cdh13 | 031841 | 145849 | N/A |
| Cdh13 | 031841 | 142551 | N/A |
| Cdh13 | 031841 | 129548 | N/A |
| Cdh13 | 031841 | 148836 | N/A |
| Cdh13 | 031841 | 123567 | N/A |
| Cdh13 | 031841 | 212476 | N/A |
| Cdh13 | 031841 | 151842 | N/A |
| Cdh15 | 031962 | 034443 | 034443 |
| Cdh19 | 047216 | 094626 | 092210 |
| Cdh19 | 047216 | 187555 | N/A |
| Cdh2 | 024304 | 025166 | 025166 |
| Cdh2 | 024304 | 152779 | N/A |
| Cdh2 | 024304 | 115850 | 111516 |
| Cdh4 | 000305 | 000314 | 000314 |
| Cdh4 | 000305 | 108911 | 104539 |
| Cdh4 | 000305 | 124708 | N/A |
| Cdh4 | 000305 | 136411 | N/A |
| Cdh4 | 000305 | 129659 | N/A |
| Cdh4 | 000305 | 098996 | 096594 |
| Cdh8 | 036510 | 155527 | 123619 |
| Cdh8 | 036510 | 142129 | 114507 |
| Cdh8 | 036510 | 093249 | 090935 |
| Cdh8 | 036510 | 145601 | 122493 |
| Cdh8 | 036510 | 128860 | 117326 |
| Cdh8 | 036510 | 126895 | N/A |
| Cdh8 | 036510 | 142475 | 115977 |
| Cdhr1 | 021803 | 022337 | 022337 |
| Cdk14 | 028926 | 115451 | 111111 |
| Cdk14 | 028926 | 030763 | 030763 |
| Cdk14 | 028926 | 115450 | 111110 |
| Cdk14 | 028926 | 115452 | 111112 |
| Cdk14 | 028926 | 199623 | N/A |
| Cdk14 | 028926 | 133465 | N/A |
| Cdk14 | 028926 | 156660 | N/A |
| Cdk14 | 028926 | 134867 | N/A |
| Cdk14 | 028926 | 132390 | N/A |
| Cdk14 | 028926 | 153331 | N/A |

TABLE 2-continued

ENSEMBL IDs for mice

| Symbol | MUSG | MUST | MUSP |
|---|---|---|---|
| Cdk14 | 028926 | 171119 | N/A |
| Cdk14 | 028926 | 131392 | 114741 |
| Cdk14 | 028926 | 167567 | 130895 |
| Cdk14 | 028926 | 137554 | N/A |
| Cdk14 | 028926 | 200637 | N/A |
| Cdk18 | 026437 | 027697 | 027697 |
| Cdk18 | 026437 | 188387 | N/A |
| Cdk18 | 026437 | 185601 | 140034 |
| Cdk18 | 026437 | 189733 | N/A |
| Cdk18 | 026437 | 112362 | 107981 |
| Cdk5rap2 | 039298 | 124251 | N/A |
| Cdk5rap2 | 039298 | 144099 | 119891 |
| Cdk5rap2 | 039298 | 076541 | 075856 |
| Cdk5rap2 | 039298 | 126416 | N/A |
| Cdk5rap2 | 039298 | 138561 | 116928 |
| Cdk5rap2 | 039298 | 140108 | 119151 |
| Cdkl1 | 020990 | 021377 | 021377 |
| Cdkl1 | 020990 | 221646 | 152086 |
| Cdo1 | 033022 | 035804 | 046517 |
| Cdyl | 059288 | 075220 | 074707 |
| Cdyl | 059288 | 225602 | 153274 |
| Cdyl | 059288 | 163595 | 131784 |
| Cdyl | 059288 | 226071 | N/A |
| Cebpb | 056501 | 070642 | 069850 |
| Cep126 | 040729 | 037397 | 042904 |
| Cep126 | 040729 | 217241 | N/A |
| Cep126 | 040729 | 214150 | N/A |
| Cep76 | 073542 | 097542 | 095149 |
| Cept1 | 040774 | 068301 | 065743 |
| Cept1 | 040774 | 121231 | 112509 |
| Cept1 | 040774 | 039153 | 037277 |
| Cept1 | 040774 | 192438 | 142097 |
| Cept1 | 040774 | 148269 | 118343 |
| Cept1 | 040774 | 137530 | 115898 |
| Cept1 | 040774 | 141525 | 122460 |
| Cercam | 039787 | 154464 | 119476 |
| Cercam | 039787 | 047521 | 041622 |
| Cercam | 039787 | 134152 | 115902 |
| Cercam | 039787 | 153863 | N/A |
| Cercam | 039787 | 155355 | N/A |
| Cerkl | 075256 | 156731 | 121353 |
| Cerkl | 075256 | 099974 | N/A |
| Cerkl | 075256 | 147402 | N/A |
| Cerkl | 075256 | 143974 | 114325 |
| Cerkl | 075256 | 152549 | N/A |
| Cerkl | 075256 | 143602 | N/A |
| Cerkl | 075256 | 123859 | N/A |
| Cerkl | 075256 | 153602 | N/A |
| Cerkl | 075256 | 156830 | N/A |
| Cerkl | 075256 | 130499 | N/A |
| Cerkl | 075256 | 145766 | N/A |
| Cerkl | 075256 | 152413 | N/A |
| Cers4 | 008206 | 177010 | N/A |
| Cers4 | 008206 | 176042 | 135594 |
| Cers4 | 008206 | 008350 | 008350 |
| Cers4 | 008206 | 176267 | N/A |
| Cers4 | 008206 | 175781 | N/A |
| Cers4 | 008206 | 176837 | N/A |
| Cers4 | 008206 | 176932 | N/A |
| Cers4 | 008206 | 176705 | N/A |
| Cers4 | 008206 | 176130 | 135652 |
| Cfap161 | 011154 | 119134 | 114051 |
| Cfap161 | 011154 | 011298 | 011298 |
| Cfap161 | 011154 | 208785 | N/A |
| Cfap161 | 011154 | 149671 | 115281 |
| Cfap20 | 031796 | 212731 | N/A |
| Cfap20 | 031796 | 034249 | 034249 |
| Cfap20 | 031796 | 213086 | 148651 |
| Cfap20 | 031796 | 212579 | N/A |
| Cfap20 | 031796 | 212684 | 148527 |
| Cfap20 | 031796 | 211908 | 148668 |
| Cfap20 | 031796 | 212807 | N/A |
| Cfap20 | 031796 | 212131 | 148415 |
| Cgn | 068876 | 107272 | 102893 |
| Cgn | 068876 | 107273 | 102894 |
| Cgn | 068876 | 153263 | 143156 |
| Cgn | 068876 | 155485 | 142809 |
| Cgnl1 | 032232 | 121322 | 113917 |
| Cgnl1 | 032232 | 152224 | N/A |
| Cgnl1 | 032232 | 122065 | 112479 |
| Cgnl1 | 032232 | 136044 | N/A |
| Cgnl1 | 032232 | 146567 | N/A |
| Cgnl1 | 032232 | 072899 | 072672 |
| Chac1 | 027313 | 028780 | 028780 |
| Chd7 | 041235 | 170457 | N/A |
| Chd7 | 041235 | 127476 | 118711 |
| Chd7 | 041235 | 051558 | 059079 |
| Chd7 | 041235 | 129655 | 123241 |
| Chd7 | 041235 | 170391 | 127007 |
| Chd7 | 041235 | 130709 | N/A |
| Chd7 | 041235 | 222546 | 152166 |
| Chd7 | 041235 | 039267 | 043903 |
| Chdh | 015970 | 067620 | 065542 |
| Chdh | 015970 | 125796 | N/A |
| Chdh | 015970 | 118917 | 112916 |
| Chgb | 027350 | 028826 | 028826 |
| Chid1 | 025512 | 153191 | 114693 |
| Chid1 | 025512 | 118694 | 112891 |
| Chid1 | 025512 | 209452 | 147938 |
| Chid1 | 025512 | 147610 | N/A |
| Chid1 | 025512 | 064642 | 065953 |
| Chid1 | 025512 | 155305 | N/A |
| Chid1 | 025512 | 143561 | 115174 |
| Chid1 | 025512 | 133359 | N/A |
| Chid1 | 025512 | 166082 | 130360 |
| Chid1 | 025512 | 026586 | 026586 |
| Chl1 | 030077 | 203912 | 145026 |
| Chl1 | 030077 | 203489 | N/A |
| Chl1 | 030077 | 066905 | 063933 |
| Chl1 | 030077 | 203830 | 144758 |
| Chl1 | 030077 | 204321 | 144725 |
| Chl1 | 030077 | 205098 | 144739 |
| Chn2 | 004633 | 138930 | N/A |
| Chn2 | 004633 | 046856 | 035908 |
| Chn2 | 004633 | 133315 | 145072 |
| Chn2 | 004633 | 114403 | N/A |
| Chn2 | 004633 | 127323 | 118990 |
| Chn2 | 004633 | 204410 | N/A |
| Chn2 | 004633 | 146114 | 114476 |
| Chn2 | 004633 | 114402 | 110044 |
| Chn2 | 004633 | 114401 | 110043 |
| Chn2 | 004633 | 067741 | 066078 |
| Chn2 | 004633 | 204921 | 145231 |
| Chn2 | 004633 | 203091 | 145008 |
| Chn2 | 004633 | 204115 | 145507 |
| Chn2 | 004633 | 203941 | 145314 |
| Chn2 | 004633 | 204746 | 144983 |
| Chodl | 022860 | 023568 | 023568 |
| Chodl | 022860 | 069148 | 063961 |
| Chodl | 022860 | 114216 | 109854 |
| Chrm1 | 032773 | 177197 | 135356 |
| Chrm1 | 032773 | 035444 | 042632 |
| Chrm1 | 032773 | 163785 | 126103 |
| Chrm3 | 046159 | 187510 | 140131 |
| Chrm3 | 046159 | 223242 | N/A |
| Chrm3 | 046159 | 190395 | N/A |
| Chrm3 | 046159 | 063093 | 055579 |
| Chst1 | 027221 | 065797 | 064246 |
| Chst10 | 026080 | 027249 | 027249 |
| Chst10 | 026080 | 193441 | 142028 |
| Chst10 | 026080 | 192948 | 141470 |
| Chst10 | 026080 | 194361 | 141295 |
| Chst10 | 026080 | 194657 | 141481 |
| Chst10 | 026080 | 193435 | 141604 |
| Chst10 | 026080 | 192175 | N/A |
| Chst10 | 026080 | 195731 | N/A |
| Chst11 | 034612 | 040110 | 045349 |
| Chst15 | 030930 | 077472 | 076682 |
| Chst15 | 030930 | 080215 | 079105 |
| Chst15 | 030930 | 132508 | N/A |
| Chst15 | 030930 | 207068 | N/A |
| Chst8 | 060402 | 078686 | 077752 |

TABLE 2-continued

ENSEMBL IDs for mice

| Symbol | MUSG | MUST | MUSP |
|---|---|---|---|
| Chst8 | 060402 | 205259 | 145646 |
| Chst8 | 060402 | 154629 | 123498 |
| Chst8 | 060402 | 135295 | N/A |
| Chst8 | 060402 | 206207 | N/A |
| Chst8 | 060402 | 205390 | N/A |
| Chst9 | 047161 | 053017 | 049975 |
| Chst9 | 047161 | 130553 | 121484 |
| Chsy1 | 032640 | 036372 | 047487 |
| Chsy3 | 058152 | 080721 | 079546 |
| Chtf18 | 019214 | 170575 | 131366 |
| Chtf18 | 019214 | 048054 | 043896 |
| Chtf18 | 019214 | 168914 | N/A |
| Chtf18 | 019214 | 167940 | 131349 |
| Chtf18 | 019214 | 169767 | 129694 |
| Chtf18 | 019214 | 168060 | N/A |
| Chtf18 | 019214 | 170070 | 131768 |
| Cipc | 034157 | 189246 | 140266 |
| Cipc | 034157 | 185434 | 140769 |
| Cipc | 034157 | 191032 | 140097 |
| Cipc | 034157 | 187814 | 141049 |
| Cipc | 034157 | 188901 | N/A |
| Cipc | 034157 | 188046 | 139742 |
| Cipc | 034157 | 185783 | 140830 |
| Cipc | 034157 | 186499 | 139553 |
| Cipc | 034157 | 190588 | 140595 |
| Cipc | 034157 | 191463 | 140683 |
| Cipc | 034157 | 038369 | 038630 |
| Cit | 029516 | 147330 | N/A |
| Cit | 029516 | 137952 | 122745 |
| Cit | 029516 | 148245 | 119769 |
| Cit | 029516 | 146387 | N/A |
| Cit | 029516 | 141101 | 115802 |
| Cit | 029516 | 051704 | 062049 |
| Cit | 029516 | 112008 | 107639 |
| Cit | 029516 | 102560 | 099620 |
| Cit | 029516 | 153407 | N/A |
| Cit | 029516 | 127976 | N/A |
| Cit | 029516 | 202734 | N/A |
| Cit | 029516 | 128702 | N/A |
| Cit | 029516 | 145363 | N/A |
| Cit | 029516 | 147479 | N/A |
| Cit | 029516 | 139881 | N/A |
| Cit | 029516 | 122877 | N/A |
| Cit | 029516 | 136780 | N/A |
| Cit | 029516 | 123736 | 134875 |
| Cit | 029516 | 134609 | N/A |
| Clasrp | 061028 | 086041 | 083205 |
| Clasrp | 061028 | 208427 | N/A |
| Clasrp | 061028 | 208464 | N/A |
| Clasrp | 061028 | 208716 | N/A |
| Clasrp | 061028 | 207253 | N/A |
| Clasrp | 061028 | 207907 | 146982 |
| Clasrp | 061028 | 207663 | 147069 |
| Clasrp | 061028 | 208068 | 147103 |
| Clasrp | 061028 | 207447 | N/A |
| Clasrp | 061028 | 207524 | 146794 |
| Clasrp | 061028 | 207264 | N/A |
| Clasrp | 061028 | 209059 | N/A |
| Clasrp | 061028 | 207325 | N/A |
| Clcn1 | 029862 | 031894 | 031894 |
| Clcn1 | 029862 | 164091 | 131354 |
| Clcn1 | 029862 | 170028 | 132154 |
| Clcn1 | 029862 | 163936 | 130148 |
| Clcn1 | 029862 | 165780 | 130550 |
| Clcn1 | 029862 | 169024 | 130968 |
| Clcn1 | 029862 | 168660 | 126045 |
| Clcn1 | 029862 | 114684 | N/A |
| Clcn1 | 029862 | 163235 | 132387 |
| Clcn1 | 029862 | 169902 | N/A |
| Clcn5 | 004317 | 004428 | 004428 |
| Clcn5 | 004317 | 154382 | N/A |
| Clcn5 | 004317 | 128319 | 122555 |
| Clcn5 | 004317 | 115746 | 111412 |
| Clcn5 | 004317 | 132126 | N/A |
| Cldn11 | 037625 | 046174 | 042181 |
| Clec21 | 079598 | 114874 | 110524 |

TABLE 2-continued

ENSEMBL IDs for mice

| Symbol | MUSG | MUST | MUSP |
|---|---|---|---|
| Clec7a | 079293 | 195589 | 141234 |
| Clec7a | 079293 | 184581 | 139167 |
| Clec7a | 079293 | 184861 | N/A |
| Clec7a | 079293 | 112076 | 107707 |
| Clic6 | 022949 | 023670 | 023670 |
| Clic6 | 022949 | 162181 | 124498 |
| Clmn | 021097 | 109936 | 105562 |
| Clmn | 021097 | 109937 | 105563 |
| Clmn | 021097 | 223103 | 152228 |
| Clmn | 021097 | 223342 | 152070 |
| Clmn | 021097 | 223177 | 152097 |
| Clmn | 021097 | 222323 | 152467 |
| Clmn | 021097 | 222412 | N/A |
| Clmp | 032024 | 139577 | N/A |
| Clmp | 032024 | 034522 | 034522 |
| Clmp | 032024 | 141759 | N/A |
| Clmp | 032024 | 134153 | N/A |
| Clstn2 | 032452 | 035027 | 035027 |
| Clstn2 | 032452 | 162295 | 124081 |
| Clvs2 | 019785 | 019920 | 019920 |
| Clvs2 | 019785 | 159533 | N/A |
| Clvs2 | 019785 | 161692 | 151805 |
| Clvs2 | 019785 | 160299 | 125100 |
| Nat8f5 | 079494 | 032074 | 032074 |
| Cmtm5 | 040759 | 037814 | 036138 |
| Cmtm5 | 040759 | 227441 | 153874 |
| Cmtm5 | 040759 | 226807 | N/A |
| Cnih3 | 026514 | 161880 | 124611 |
| Cnih3 | 026514 | 027795 | 027795 |
| Cnih3 | 026514 | 162685 | 124247 |
| Cnih3 | 026514 | 209607 | 148015 |
| Cnksr3 | 015202 | 015346 | 015346 |
| Cnksr3 | 015202 | 150282 | 115863 |
| Cnp | 006782 | 103120 | 099409 |
| Cnp | 006782 | 148034 | N/A |
| Cnp | 006782 | 150414 | N/A |
| Cnp | 006782 | 147403 | N/A |
| Cnpy1 | 044681 | 141601 | 122171 |
| Cnpy1 | 044681 | 118882 | 113944 |
| Cnpy1 | 044681 | 120068 | 112773 |
| Cnpy1 | 044681 | 117098 | 113956 |
| Cnpy1 | 044681 | 141196 | 116024 |
| Cnr1 | 044288 | 057188 | 055797 |
| Cnr1 | 044288 | 133462 | N/A |
| Cnr1 | 044288 | 084736 | 081787 |
| Cntfr | 028444 | 102961 | 100026 |
| Cntfr | 028444 | 102962 | 100027 |
| Cntfr | 028444 | 151181 | N/A |
| Cntfr | 028444 | 064443 | N/A |
| Cntfr | 028444 | 084701 | N/A |
| Cntfr | 028444 | 145379 | 115631 |
| Cntn3 | 030075 | 204990 | N/A |
| Cntn3 | 030075 | 203619 | 145176 |
| Cntn3 | 030075 | 032159 | 032159 |
| Cntn4 | 064293 | 132044 | N/A |
| Cntn4 | 064293 | 113261 | 108886 |
| Cntn4 | 064293 | 089208 | 086616 |
| Cntn4 | 064293 | 113260 | 108885 |
| Cntn4 | 064293 | 113258 | 108883 |
| Cntn4 | 064293 | 125904 | N/A |
| Cntn4 | 064293 | 079416 | 078385 |
| Cntn4 | 064293 | 130040 | N/A |
| Cntn4 | 064293 | 132395 | N/A |
| Cntn4 | 064293 | 204621 | N/A |
| Cntn4 | 064293 | 123596 | N/A |
| Cntn4 | 064293 | 142626 | N/A |
| Cntn4 | 064293 | 113264 | 108889 |
| Cntn5 | 039488 | 160216 | 124327 |
| Cntn5 | 039488 | 162484 | 124214 |
| Cntn5 | 039488 | 160358 | N/A |
| Cntn5 | 039488 | 074133 | 073769 |
| Cntn5 | 039488 | 179049 | 135903 |
| Cntnap4 | 031772 | 125976 | N/A |
| Cntnap4 | 031772 | 118171 | 112511 |
| Cntnap4 | 031772 | 125196 | N/A |
| Cntnap4 | 031772 | 127636 | N/A |

| Symbol | MUSG | MUST | MUSP |
|---|---|---|---|
| Cntnap4 | 031772 | 140753 | N/A |
| Cntnap4 | 031772 | 034225 | 034225 |
| Cntnap5a | 070695 | 043725 | 035732 |
| Cobl | 020173 | 172919 | 133669 |
| Cobl | 020173 | 109650 | 105277 |
| Cobl | 020173 | 046755 | 045693 |
| Cobl | 020173 | 174874 | 133470 |
| Cobl | 020173 | 109651 | 105278 |
| Cobl | 020173 | 172956 | 134372 |
| Cobl | 020173 | 172827 | 133368 |
| Cobl | 020173 | 136549 | 114779 |
| Cobl | 020173 | 130572 | N/A |
| Cobl | 020173 | 146067 | 119008 |
| Col11a1 | 027966 | 092155 | 089793 |
| Col11a1 | 027966 | 196345 | N/A |
| Col11a1 | 027966 | 196654 | N/A |
| Col11a1 | 027966 | 211802 | 148798 |
| Col11a1 | 027966 | 138680 | N/A |
| Col11a1 | 027966 | 184978 | 138879 |
| Col11a1 | 027966 | 123619 | 121027 |
| Col11a2 | 024330 | 131134 | 122082 |
| Col11a2 | 024330 | 087497 | 084772 |
| Col11a2 | 024330 | 143354 | 115026 |
| Col11a2 | 024330 | 173749 | N/A |
| Col11a2 | 024330 | 137374 | N/A |
| Col11a2 | 024330 | 144927 | N/A |
| Col11a2 | 024330 | 114252 | 109890 |
| Col11a2 | 024330 | 114255 | 109893 |
| Col13a1 | 058806 | 145469 | 117248 |
| Col13a1 | 058806 | 105451 | N/A |
| Col13a1 | 058806 | 105453 | 101093 |
| Col13a1 | 058806 | 105452 | 101092 |
| Col13a1 | 058806 | 105454 | 101094 |
| Col13a1 | 058806 | 051826 | N/A |
| Col13a1 | 058806 | 153120 | N/A |
| Col15a1 | 028339 | 082303 | 080921 |
| Col15a1 | 028339 | 102917 | 099981 |
| Col15a1 | 028339 | 124105 | N/A |
| Col15a1 | 028339 | 148103 | N/A |
| Col15a1 | 028339 | 140094 | N/A |
| Col15a1 | 028339 | 140413 | 119292 |
| Col15a1 | 028339 | 107731 | 103359 |
| Col15a1 | 028339 | 146967 | 118637 |
| Col15a1 | 028339 | 107730 | 103358 |
| Col1a2 | 029661 | 141483 | 125275 |
| Col1a2 | 029661 | 031668 | 031668 |
| Col1a2 | 029661 | 138511 | N/A |
| Col1a2 | 029661 | 132029 | N/A |
| Col1a2 | 029661 | 148864 | N/A |
| Col1a2 | 029661 | 155687 | N/A |
| Col1a2 | 029661 | 124686 | N/A |
| Col1a2 | 029661 | 203346 | N/A |
| Col20a1 | 016356 | 149179 | 115291 |
| Col20a1 | 016356 | 108856 | 104484 |
| Col20a1 | 016356 | 228434 | 153871 |
| Col20a1 | 016356 | 152473 | 117514 |
| Col20a1 | 016356 | 155425 | 114654 |
| Col22a1 | 079022 | 159410 | 124182 |
| Col22a1 | 079022 | 162081 | N/A |
| Col22a1 | 079022 | 159993 | 125069 |
| Col22a1 | 079022 | 160513 | 124270 |
| Col23a1 | 063564 | 102765 | 099826 |
| Col23a1 | 063564 | 151098 | 119825 |
| Col4a5 | 031274 | 112931 | 108553 |
| Col4a5 | 031274 | 112930 | 108552 |
| Col4a5 | 031274 | 130732 | 116610 |
| Col4a5 | 031274 | 128669 | N/A |
| Col5a1 | 026837 | 028280 | 028280 |
| Col5a1 | 026837 | 145423 | 123532 |
| Col5a3 | 004098 | 004201 | 004201 |
| Col5a3 | 004098 | 145974 | N/A |
| Col6a1 | 001119 | 001147 | 001147 |
| Col6a1 | 001119 | 137599 | N/A |
| Colgalt2 | 032649 | 127586 | 119210 |
| Colgalt2 | 032649 | 044311 | 037532 |
| Colgalt2 | 032649 | 127586 | 119210 |
| Colgalt2 | 032649 | 044311 | 037532 |
| Corin | 005220 | 167460 | 127389 |
| Corin | 005220 | 005352 | 005352 |
| Corin | 005220 | 175766 | 135889 |
| Corin | 005220 | 177290 | 135511 |
| Corin | 005220 | 176974 | 135722 |
| Corin | 005220 | 176320 | N/A |
| Corin | 005220 | 176439 | N/A |
| Coro1c | 004530 | 164980 | 129314 |
| Coro1c | 004530 | 004646 | 004646 |
| Coro1c | 004530 | 163995 | N/A |
| Coro1c | 004530 | 168634 | N/A |
| Coro1c | 004530 | 172016 | N/A |
| Coro1c | 004530 | 111283 | N/A |
| Coro1c | 004530 | 166647 | N/A |
| Coro1c | 004530 | 168493 | N/A |
| Coro1c | 004530 | 163264 | 129457 |
| Coro1c | 004530 | 168399 | 132504 |
| Coro1c | 004530 | 171630 | N/A |
| Coro2b | 041729 | 048043 | 041826 |
| Coro2b | 041729 | 131981 | 133481 |
| Coro2b | 041729 | 164246 | 128441 |
| Coro2b | 041729 | 151604 | N/A |
| Coro2b | 041729 | 174439 | 134079 |
| Coro2b | 041729 | 173171 | 134709 |
| Coro2b | 041729 | 123379 | N/A |
| Coro6 | 020836 | 102493 | 099551 |
| Coro6 | 020836 | 130255 | 120232 |
| Coro6 | 020836 | 021190 | 021190 |
| Coro6 | 020836 | 079770 | 078703 |
| Coro6 | 020836 | 108391 | 104028 |
| Coro6 | 020836 | 052515 | 056862 |
| Cotl1 | 031827 | 034285 | 034285 |
| Cotl1 | 031827 | 211873 | 148448 |
| Cotl1 | 031827 | 212676 | N/A |
| Cotl1 | 031827 | 168698 | 126329 |
| Cpe | 037852 | 048967 | 048555 |
| Cpe | 037852 | 210783 | N/A |
| Cpe | 037852 | 210680 | N/A |
| Cpe | 037852 | 211312 | N/A |
| Cpm | 020183 | 138020 | N/A |
| Cpm | 020183 | 123374 | N/A |
| Cpm | 020183 | 020399 | 020399 |
| Cpm | 020183 | 141991 | N/A |
| Cpne4 | 032564 | 098443 | 096042 |
| Cpne4 | 032564 | 157006 | 117155 |
| Cpne4 | 032564 | 057742 | 049663 |
| Cpne4 | 032564 | 077190 | 076432 |
| Cpne4 | 032564 | 213120 | 150096 |
| Cpne4 | 032564 | 213452 | 150551 |
| Cpne7 | 034796 | 134235 | N/A |
| Cpne7 | 034796 | 037900 | 042159 |
| Cpne7 | 034796 | 131659 | N/A |
| Cpne7 | 034796 | 123191 | N/A |
| Cpne7 | 034796 | 127431 | N/A |
| Cpne9 | 030270 | 041203 | 044416 |
| Cpne9 | 030270 | 132372 | N/A |
| Cpne9 | 030270 | 130191 | 138786 |
| Cpne9 | 030270 | 124574 | N/A |
| Cpne9 | 030270 | 204050 | N/A |
| Cpne9 | 030270 | 128148 | N/A |
| Cpne9 | 030270 | 155779 | N/A |
| Cpne9 | 030270 | 138388 | N/A |
| Cpne9 | 030270 | 134523 | N/A |
| Cpne9 | 030270 | 136728 | N/A |
| Creb3l1 | 027230 | 028663 | 028663 |
| Crim1 | 024074 | 112498 | 108117 |
| Crispld1 | 025776 | 159958 | 124095 |
| Crispld1 | 025776 | 160305 | 123800 |
| Crispld1 | 025776 | 095075 | 092686 |
| Cryab | 032060 | 217475 | 149803 |
| Cryab | 032060 | 214609 | 149454 |
| Cryab | 032060 | 034562 | 034562 |
| Cryab | 032060 | 214962 | 149759 |
| Cryab | 032060 | 216755 | 150669 |
| Cryab | 032060 | 216393 | N/A |

TABLE 2-continued

ENSEMBL IDs for mice

| Symbol | MUSG | MUST | MUSP |
| --- | --- | --- | --- |
| Cryba2 | 006546 | 133833 | 140298 |
| Cryba2 | 006546 | 006721 | 006721 |
| Cryl1 | 021947 | 022517 | 022517 |
| Cryl1 | 021947 | 223986 | N/A |
| Cryl1 | 021947 | 224292 | N/A |
| Cryl1 | 021947 | 225765 | N/A |
| Crym | 030905 | 134067 | N/A |
| Crym | 030905 | 033198 | 033198 |
| Csmd1 | 060924 | 082104 | 080751 |
| Csmd1 | 060924 | 125551 | N/A |
| Csmd1 | 060924 | 131778 | N/A |
| Csmd1 | 060924 | 138348 | N/A |
| Csmd1 | 060924 | 137947 | N/A |
| Csmd1 | 060924 | 133933 | N/A |
| Csmd1 | 060924 | 122983 | N/A |
| Csmd2 | 028804 | 129619 | N/A |
| Csmd2 | 028804 | 144298 | N/A |
| Csmd2 | 028804 | 184063 | 138958 |
| Csmd2 | 028804 | 148247 | N/A |
| Csmd2 | 028804 | 139561 | N/A |
| Csmd2 | 028804 | 221199 | 152795 |
| Cspg4 | 032911 | 214057 | N/A |
| Cspg4 | 032911 | 035661 | 038909 |
| Cspg4 | 032911 | 215666 | N/A |
| Cspg4 | 032911 | 217052 | N/A |
| Cspg5 | 032482 | 035058 | 035058 |
| Cspg5 | 032482 | 196060 | 143164 |
| Cspg5 | 032482 | 196176 | N/A |
| Cspg5 | 032482 | 197850 | 143005 |
| Cspg5 | 032482 | 199736 | 142845 |
| Csrnp3 | 044647 | 122912 | 117533 |
| Csrnp3 | 044647 | 053910 | 055719 |
| Csrnp3 | 044647 | 139896 | N/A |
| Csrnp3 | 044647 | 112397 | 135151 |
| Csrnp3 | 044647 | 129133 | N/A |
| Csrnp3 | 044647 | 176109 | 135019 |
| Csrnp3 | 044647 | 145598 | 135605 |
| Csrnp3 | 044647 | 112394 | 108013 |
| Csrp1 | 026421 | 097561 | 095169 |
| Csrp1 | 026421 | 027677 | 027677 |
| Csta1 | 034362 | 096090 | 093795 |
| Csta1 | 034362 | 161638 | 125577 |
| Ctnna3 | 060843 | 105441 | 101081 |
| Ctnna3 | 060843 | 105440 | 101080 |
| Ctnna3 | 060843 | 133190 | N/A |
| Ctnna3 | 060843 | 135474 | N/A |
| Ctnna3 | 060843 | 075099 | 074606 |
| Cttnbp2 | 000416 | 152499 | N/A |
| Cttnbp2 | 000416 | 146775 | 119383 |
| Cttnbp2 | 000416 | 148602 | 118432 |
| Cttnbp2 | 000416 | 090601 | 088089 |
| Cttnbp2 | 000416 | 141581 | 123162 |
| Cttnbp2 | 000416 | 139557 | N/A |
| Cttnbp2 | 000416 | 129669 | 116878 |
| Cttnbp2 | 000416 | 142963 | 122590 |
| Cttnbp2 | 000416 | 140416 | N/A |
| Ctxn1 | 048644 | 053252 | 057115 |
| Ctxn3 | 069372 | 091892 | 089507 |
| Ctxn3 | 069372 | 209782 | 147740 |
| Ctxn3 | 069372 | 209786 | 147982 |
| Cxcl14 | 021508 | 224801 | 153440 |
| Cxcl14 | 021508 | 021970 | 021970 |
| Cxcl5 | 029371 | 202380 | N/A |
| Cxcl5 | 029371 | 031318 | 031318 |
| Cxcr4 | 045382 | 052172 | 053489 |
| Cxcr4 | 045382 | 142893 | 120153 |
| 4930578C19Rik | 037358 | 044188 | 046567 |
| 4930578C19Rik | 037358 | 147039 | N/A |
| Cxxc4 | 044365 | 197151 | N/A |
| Cxxc4 | 044365 | 181904 | 138000 |
| Cxxc4 | 044365 | 181597 | N/A |
| Cxxc4 | 044365 | 199134 | N/A |
| Cxxc4 | 044365 | 166288 | 128574 |
| Cyb5a | 024646 | 160180 | 124480 |
| Cyb5a | 024646 | 025549 | 025549 |
| Cyb5a | 024646 | 159846 | N/A |

TABLE 2-continued

ENSEMBL IDs for mice

| Symbol | MUSG | MUST | MUSP |
| --- | --- | --- | --- |
| Cyb5a | 024646 | 163083 | 124412 |
| Cyb5a | 024646 | 159837 | N/A |
| Cyfip2 | 020340 | 093166 | 090854 |
| Cyfip2 | 020340 | 142017 | 119801 |
| Cyfip2 | 020340 | 129474 | 116715 |
| Cyfip2 | 020340 | 165599 | 127586 |
| Cyfip2 | 020340 | 093165 | 090853 |
| Cyp27a1 | 026170 | 027356 | 027356 |
| Cyp27a1 | 026170 | 190781 | N/A |
| Cyp27a1 | 026170 | 189083 | N/A |
| Cyp2j9 | 015224 | 055693 | 050464 |
| Cyp2j9 | 015224 | 126509 | N/A |
| Cyp7b1 | 039519 | 035625 | 037487 |
| D430019H16Rik | 094910 | 178224 | 137376 |
| D430041D05Rik | 068373 | 136156 | N/A |
| D430041D05Rik | 068373 | 141159 | 117041 |
| D430041D05Rik | 068373 | 156278 | N/A |
| D430041D05Rik | 068373 | 149165 | N/A |
| D430041D05Rik | 068373 | 155458 | N/A |
| D430041D05Rik | 068373 | 139015 | 124519 |
| D430041D05Rik | 068373 | 149466 | 124980 |
| D430041D05Rik | 068373 | 089726 | 106756 |
| D430042O09Rik | 032743 | 124223 | 118668 |
| D430042O09Rik | 032743 | 069660 | 065744 |
| D430042O09Rik | 032743 | 205723 | N/A |
| D430042O09Rik | 032743 | 148701 | 119527 |
| D430042O09Rik | 032743 | 122337 | N/A |
| D430042O09Rik | 032743 | 205462 | N/A |
| D430042O09Rik | 032743 | 132204 | 115955 |
| D430042O09Rik | 032743 | 155059 | N/A |
| D630003M21Rik | 037813 | 103121 | 099410 |
| D630003M21Rik | 037813 | 046944 | 040546 |
| D630003M21Rik | 037813 | 169335 | 130623 |
| D7Ertd443e | 030994 | 094002 | 091539 |
| D7Ertd443e | 030994 | 172947 | 134479 |
| D7Ertd443e | 030994 | 106129 | 101735 |
| D7Ertd443e | 030994 | 206005 | N/A |
| D7Ertd443e | 030994 | 174700 | 134411 |
| D7Ertd443e | 030994 | 173195 | 134585 |
| D7Ertd443e | 030994 | 173754 | 133963 |
| D7Ertd443e | 030994 | 174271 | N/A |
| Tmem131 | 026116 | 194563 | 142307 |
| Tmem131 | 026116 | 191381 | N/A |
| Tmem131 | 026116 | 187917 | N/A |
| Tmem131 | 026116 | 189470 | 140620 |
| Tmem131 | 026116 | 190442 | 140187 |
| Tmem131 | 026116 | 186486 | 142080 |
| Tmem131 | 026116 | 185964 | 141413 |
| Tmem131 | 026116 | 027290 | 027290 |
| Dagla | 035735 | 039327 | 046358 |
| Dagla | 035735 | 125567 | 138702 |
| Dagla | 035735 | 156361 | N/A |
| Dao | 042096 | 112292 | 107911 |
| Dao | 042096 | 086599 | 083792 |
| Dao | 042096 | 161610 | 125588 |
| Dao | 042096 | 199175 | 143337 |
| Dao | 042096 | 162214 | N/A |
| Dapk1 | 021559 | 226059 | 153607 |
| Dapk1 | 021559 | 077453 | 076666 |
| Dapk1 | 021559 | 224340 | N/A |
| Dapk1 | 021559 | 044083 | 040825 |
| Dapk1 | 021559 | 225632 | N/A |
| Dapk1 | 021559 | 224789 | 153205 |
| Dapk1 | 021559 | 225952 | N/A |
| Slc6a3 | 021609 | 022100 | 022100 |
| Dcc | 060534 | 114943 | 110593 |
| Dcc | 060534 | 073379 | 073094 |
| Dcc | 060534 | 126030 | N/A |
| Ddhd1 | 037697 | 111828 | 107459 |
| Ddhd1 | 037697 | 087320 | 084577 |
| Ddhd1 | 037697 | 051310 | 050088 |
| Ddhd1 | 037697 | 152110 | N/A |
| Ddhd1 | 037697 | 129599 | N/A |
| Ddhd1 | 037697 | 149286 | 118848 |
| Ddhd1 | 037697 | 156758 | 121837 |
| Ddhd1 | 037697 | 141487 | 133358 |

TABLE 2-continued

| ENSEMBL IDs for mice | | | |
|---|---|---|---|
| Symbol | MUSG | MUST | MUSP |
| Ddhd1 | 037697 | 126428 | N/A |
| Ddhd1 | 037697 | 226301 | 154065 |
| Ddhd1 | 037697 | 147551 | N/A |
| Ddhd1 | 037697 | 153547 | N/A |
| Ddhd1 | 037697 | 226559 | N/A |
| Ddn | 059213 | 075444 | 074895 |
| Ddr2 | 026674 | 194690 | 141443 |
| Ddr2 | 026674 | 192312 | 142191 |
| Ddr2 | 026674 | 195867 | N/A |
| Ddr2 | 026674 | 194619 | N/A |
| Ddr2 | 026674 | 027985 | 027985 |
| Ddr2 | 026674 | 170800 | 129624 |
| Ddx3y | 069045 | 091190 | 088729 |
| Ddx3y | 069045 | 188182 | N/A |
| Ddx3y | 069045 | 188484 | 140361 |
| Ddx3y | 069045 | 187596 | N/A |
| Depdc1b | 021697 | 051594 | 059291 |
| Depdc1b | 021697 | 168037 | N/A |
| Depdc1b | 021697 | 163307 | 131707 |
| Depdc1b | 021697 | 171178 | 132972 |
| Depdc1b | 021697 | 167413 | N/A |
| Depdc1b | 021697 | 172402 | N/A |
| Depdc7 | 027173 | 028595 | 028595 |
| Depdc7 | 027173 | 144133 | N/A |
| Des | 026208 | 027409 | 027409 |
| Des | 026208 | 144894 | N/A |
| Des | 026208 | 125948 | N/A |
| Gsdme | 029821 | 204417 | N/A |
| Gsdme | 029821 | 165099 | 130522 |
| Gsdme | 029821 | 101405 | 098952 |
| Gsdme | 029821 | 031845 | 031845 |
| Gsdme | 029821 | 167893 | 132062 |
| Gsdme | 029821 | 204700 | N/A |
| Gsdme | 029821 | 170142 | 126759 |
| Dgkb | 036095 | 222337 | 152460 |
| Dgkb | 036095 | 221176 | 152446 |
| Dgkb | 036095 | 220990 | 152378 |
| Dgkb | 036095 | 221540 | N/A |
| Dgkb | 036095 | 040500 | 037900 |
| Dgkb | 036095 | 221098 | N/A |
| Dgkb | 036095 | 221686 | N/A |
| Dgkb | 036095 | 220606 | N/A |
| Dgkh | 034731 | 226342 | 154036 |
| Dgkh | 034731 | 227537 | 154107 |
| Dgkh | 034731 | 228362 | 154554 |
| Dgkh | 034731 | 227767 | 154031 |
| Dgkh | 034731 | 227820 | N/A |
| Dgkh | 034731 | 074729 | 074290 |
| Dgki | 038665 | 101532 | 099071 |
| Dgki | 038665 | 150300 | 138457 |
| Dgki | 038665 | 138286 | 138628 |
| Dgki | 038665 | 090314 | 087788 |
| Dgki | 038665 | 042075 | 047858 |
| Dgki | 038665 | 143046 | N/A |
| Dgki | 038665 | 146656 | N/A |
| Dgki | 038665 | 136457 | N/A |
| Disp3 | 041544 | 047720 | 038490 |
| Disp3 | 041544 | 143851 | N/A |
| Disp3 | 041544 | 129734 | N/A |
| Dixdc1 | 032064 | 034566 | 034566 |
| Dixdc1 | 032064 | 141919 | N/A |
| Dixdc1 | 032064 | 117646 | 112431 |
| Dixdc1 | 032064 | 119449 | N/A |
| Dixdc1 | 032064 | 121634 | 113089 |
| Dixdc1 | 032064 | 124424 | N/A |
| Dixdc1 | 032064 | 120622 | 113934 |
| Dixdc1 | 032064 | 151109 | N/A |
| Dixdc1 | 032064 | 149717 | N/A |
| Dixdc1 | 032064 | 154315 | N/A |
| Dixdc1 | 032064 | 117093 | 112654 |
| Dixdc1 | 032064 | 118707 | 113907 |
| Dlc1 | 031523 | 033923 | 033923 |
| Dlc1 | 031523 | 098826 | 096425 |
| Dlc1 | 031523 | 163663 | 132812 |
| Dlc1 | 031523 | 156312 | N/A |
| Dlc1 | 031523 | 145245 | N/A |

TABLE 2-continued

| ENSEMBL IDs for mice | | | |
|---|---|---|---|
| Symbol | MUSG | MUST | MUSP |
| Dlc1 | 031523 | 036104 | N/A |
| Dlc1 | 031523 | 178717 | N/A |
| Dlc1 | 031523 | 179652 | N/A |
| Dlc1 | 031523 | 179501 | 137498 |
| Dlgap2 | 047495 | 152652 | 123078 |
| Dlgap2 | 047495 | 133298 | 119613 |
| Dlgap2 | 047495 | 150247 | 123104 |
| Dlgap2 | 047495 | 141155 | N/A |
| Dlgap2 | 047495 | 136000 | N/A |
| Dlgap2 | 047495 | 141214 | N/A |
| Dlgap2 | 047495 | 137130 | N/A |
| Dlgap2 | 047495 | 129119 | N/A |
| Dlgap2 | 047495 | 043279 | 039647 |
| Dlgap4 | 061689 | 169464 | 126980 |
| Dlgap4 | 061689 | 109568 | 105196 |
| Dlgap4 | 061689 | 070782 | 068745 |
| Dlgap4 | 061689 | 137356 | 135698 |
| Dlgap4 | 061689 | 131157 | 134941 |
| Dlgap4 | 061689 | 109566 | 105194 |
| Dlgap4 | 061689 | 127944 | N/A |
| Dlgap4 | 061689 | 146412 | 135156 |
| Dlgap4 | 061689 | 177013 | 135409 |
| Dlgap4 | 061689 | 171030 | 129756 |
| Dlgap4 | 061689 | 000094 | 000094 |
| Dlgap4 | 061689 | 099145 | 096749 |
| Dlgap4 | 061689 | 123730 | N/A |
| Dlgap4 | 061689 | 109567 | 105195 |
| Dlx4os | 086552 | 156477 | N/A |
| Dlx6os1 | 098326 | 184182 | N/A |
| Dlx6os1 | 090063 | 159827 | N/A |
| Dlx6os1 | 090063 | 159568 | N/A |
| Dlx6os1 | 090063 | 210702 | N/A |
| Dmd | 045103 | 114000 | 109633 |
| Dmd | 045103 | 128983 | N/A |
| Dmd | 045103 | 113991 | 109624 |
| Dmd | 045103 | 132333 | N/A |
| Dmd | 045103 | 146331 | N/A |
| Dmd | 045103 | 149433 | N/A |
| Dmd | 045103 | 113992 | 109625 |
| Dmd | 045103 | 156107 | N/A |
| Dmd | 045103 | 147740 | N/A |
| Dmd | 045103 | 141778 | N/A |
| Dmd | 045103 | 141261 | N/A |
| Dmd | 045103 | 139998 | N/A |
| Dmd | 045103 | 123308 | N/A |
| Dmd | 045103 | 127295 | N/A |
| Dmp1 | 029307 | 066708 | 068053 |
| Dnah5 | 022262 | 067048 | 069751 |
| Dnah6 | 052861 | 114040 | 109674 |
| Dnah6 | 052861 | 204053 | 144791 |
| Dnah6 | 052861 | 114038 | N/A |
| Dnah6 | 052861 | 064948 | 068758 |
| Dner | 036766 | 049126 | 042927 |
| Dner | 036766 | 191306 | N/A |
| Dner | 036766 | 185606 | 140986 |
| Dner | 036766 | 191546 | 140662 |
| Dnmbp | 025195 | 212396 | 148582 |
| Dnmbp | 025195 | 212592 | 148421 |
| Dnmbp | 025195 | 212048 | 148546 |
| Dnmbp | 025195 | 212032 | 148708 |
| Dnmbp | 025195 | 212157 | N/A |
| Dnmbp | 025195 | 026209 | 026209 |
| Doc2b | 020848 | 021209 | 021209 |
| Dock1 | 058325 | 211570 | N/A |
| Dock1 | 058325 | 211593 | 147945 |
| Dock1 | 058325 | 084488 | 081531 |
| Dock1 | 058325 | 210617 | N/A |
| Dock1 | 058325 | 210464 | N/A |
| Dock1 | 058325 | 210121 | 147797 |
| Dock5 | 044447 | 039135 | 036674 |
| Dock5 | 044447 | 226033 | N/A |
| Dock5 | 044447 | 224823 | N/A |
| Dock6 | 032198 | 217336 | 149156 |
| Dock6 | 032198 | 215729 | 150250 |
| Dock6 | 032198 | 034728 | 034728 |
| Dock6 | 032198 | 217310 | N/A |

TABLE 2-continued | | TABLE 2-continued

ENSEMBL IDs for mice

| Symbol | MUSG | MUST | MUSP |
| --- | --- | --- | --- |
| Dock6 | 032198 | 216626 | 150347 |
| Dock6 | 032198 | 217515 | N/A |
| Dock6 | 032198 | 213296 | N/A |
| Dock6 | 032198 | 213775 | N/A |
| Dock7 | 028556 | 030286 | 030286 |
| Dock7 | 028556 | 206128 | N/A |
| Dock7 | 028556 | 127417 | 117797 |
| Dock7 | 028556 | 124466 | 145749 |
| Dock7 | 028556 | 075836 | 075233 |
| Dock7 | 028556 | 205650 | 145604 |
| Dock7 | 028556 | 140225 | N/A |
| Dock7 | 028556 | 205484 | N/A |
| Dock7 | 028556 | 124040 | N/A |
| Dock7 | 028556 | 205652 | 145833 |
| Dock7 | 028556 | 139152 | N/A |
| Dock7 | 028556 | 140848 | N/A |
| Dock7 | 028556 | 150254 | 114204 |
| Dock7 | 028556 | 127946 | 119103 |
| Dock7 | 028556 | 205783 | N/A |
| Dock7 | 028556 | 153362 | N/A |
| Dock7 | 028556 | 131386 | 145985 |
| Dock7 | 028556 | 206604 | N/A |
| Dock8 | 052085 | 025831 | 025831 |
| Dok6 | 073514 | 097495 | 095103 |
| Dok6 | 073514 | 160328 | N/A |
| Dopey2 | 022946 | 045004 | 044437 |
| Dopey2 | 022946 | 226335 | N/A |
| Dopey2 | 022946 | 226418 | N/A |
| Dopey2 | 022846 | 228846 | 154446 |
| Dopey2 | 022946 | 227156 | 154771 |
| Dopey2 | 022946 | 226836 | 154636 |
| Dopey2 | 022946 | 226215 | 154229 |
| Dopey2 | 022946 | 226535 | N/A |
| Dopey2 | 022946 | 227939 | N/A |
| Dopey2 | 022946 | 228261 | N/A |
| Dopey2 | 022946 | 227278 | N/A |
| Dopey2 | 022946 | 228423 | N/A |
| Dpf3 | 021221 | 147469 | 122598 |
| Dpf3 | 021221 | 144237 | 122004 |
| Dpf3 | 021221 | 133282 | 121199 |
| Dpf3 | 021221 | 140327 | 120700 |
| Dpf3 | 021221 | 178756 | 136280 |
| Dpf3 | 021221 | 177959 | 137477 |
| Dpf3 | 021221 | 177801 | 136740 |
| Dpp10 | 036815 | 112606 | 108225 |
| Dpp10 | 036815 | 112603 | 108222 |
| Dpp10 | 036815 | 187202 | N/A |
| Dpp10 | 036815 | 140361 | N/A |
| Dpy19l1 | 043067 | 115277 | 110932 |
| Dpy19l1 | 043067 | 142064 | 119986 |
| Dpy19l1 | 043067 | 152480 | N/A |
| Dpy19l1 | 043067 | 149001 | N/A |
| Dpy19l1 | 043067 | 129048 | N/A |
| Dpy19l1 | 043067 | 170356 | 129575 |
| Dpy19l2 | 085576 | 133010 | 132092 |
| Dpyd | 033308 | 039177 | 039429 |
| Dpyd | 033308 | 126254 | N/A |
| Dpyd | 033308 | 150950 | N/A |
| Dpyd | 033308 | 149101 | 143022 |
| Dpyd | 033308 | 200178 | N/A |
| Dpyd | 033308 | 129148 | N/A |
| Dpysl3 | 024501 | 121805 | 112928 |
| Dpysl3 | 024501 | 135547 | N/A |
| Dpysl3 | 024501 | 118043 | 113711 |
| Dpysl3 | 024501 | 025379 | 025379 |
| Dpysl3 | 024501 | 124207 | 114981 |
| Dpysl3 | 024501 | 118071 | 113604 |
| Dpysl4 | 025478 | 026551 | 026551 |
| Dpysl4 | 025478 | 139364 | N/A |
| Dpysl4 | 025478 | 154273 | N/A |
| Dpysl4 | 025478 | 122844 | N/A |
| Dpysl4 | 025478 | 145499 | 117764 |
| Dpysl4 | 025478 | 121184 | 112896 |
| Drd1 | 021478 | 221470 | 152768 |
| Drd1 | 021478 | 222706 | N/A |
| Drd1 | 021478 | 021932 | 021932 |
| Drd2 | 032259 | 075764 | 075170 |
| Dscaml1 | 032087 | 217335 | N/A |
| Dscaml1 | 032087 | 217538 | 149771 |
| Dscaml1 | 032087 | 213919 | 150245 |
| Dscaml1 | 032087 | 216340 | N/A |
| Dscaml1 | 032087 | 034592 | 034592 |
| Dscaml1 | 032087 | 216078 | 148905 |
| Dscaml1 | 032087 | 216685 | 149247 |
| Dscaml1 | 032087 | 215027 | N/A |
| Dscaml1 | 032087 | 214151 | N/A |
| Dusp16 | 030203 | 129433 | 115925 |
| Dusp16 | 030203 | 100857 | 098419 |
| Dusp16 | 030203 | 204083 | 144834 |
| Dusp16 | 030203 | 203651 | N/A |
| Dusp16 | 030203 | 203452 | N/A |
| Dusp16 | 030203 | 148926 | 144917 |
| Dusp16 | 030203 | 149776 | 144784 |
| Dusp22 | 069255 | 091672 | 089260 |
| Dusp22 | 069255 | 110310 | 105939 |
| Dusp22 | 069255 | 220748 | N/A |
| Dusp22 | 069255 | 221725 | 152283 |
| Dusp22 | 069255 | 095914 | 093603 |
| Dusp26 | 039661 | 036631 | 046794 |
| Dusp26 | 039661 | 170204 | 126397 |
| Dusp26 | 039661 | 162551 | N/A |
| Dusp26 | 039661 | 161713 | 124949 |
| Dusp26 | 039661 | 160700 | N/A |
| Dusp5 | 034765 | 038287 | 047900 |
| Dzank1 | 037259 | 081982 | 080643 |
| Dzank1 | 037259 | 124823 | N/A |
| Dzank1 | 037259 | 150816 | N/A |
| Dzank1 | 037259 | 163701 | 133177 |
| Dzip1l | 037784 | 131095 | 116647 |
| Dzip1l | 037784 | 078367 | 077475 |
| Dzip1l | 037784 | 112885 | 108506 |
| Dzip1l | 037784 | 112886 | 108507 |
| Dzip1l | 037784 | 112884 | 108505 |
| Dzip1l | 037784 | 134969 | N/A |
| Dzip1l | 037784 | 190893 | N/A |
| Ebf1 | 057098 | 081265 | 080020 |
| Ebf1 | 057098 | 101326 | 099857 |
| Ebf1 | 057098 | 109268 | 104891 |
| Ebf1 | 057098 | 140822 | N/A |
| Ebf1 | 057098 | 149997 | N/A |
| Ebf1 | 057098 | 135993 | N/A |
| Ebf1 | 057098 | 138452 | N/A |
| Ebf2 | 022053 | 022637 | 022637 |
| Ebf2 | 022053 | 176161 | 135500 |
| Ebf2 | 022053 | 177231 | N/A |
| Ebf2 | 022053 | 176029 | 135782 |
| Ebf3 | 010476 | 033378 | 033378 |
| Ebf3 | 010476 | 106118 | 101724 |
| Ebf3 | 010476 | 210774 | 147829 |
| Ebf3 | 010476 | 209578 | 147512 |
| Ebf3 | 010476 | 209905 | N/A |
| Ebf3 | 010476 | 209864 | N/A |
| Ebf3 | 010476 | 168203 | 130334 |
| Ebf3 | 010476 | 169486 | 132563 |
| Ebf4 | 053552 | 110288 | 105917 |
| Ebf4 | 053552 | 110286 | 105915 |
| Ebf4 | 053552 | 134728 | N/A |
| Ebf4 | 053552 | 126740 | 133528 |
| Ebf4 | 053552 | 140169 | 134520 |
| Ebf4 | 053552 | 110287 | 105916 |
| Ece1 | 057530 | 102518 | 099576 |
| Ece1 | 057530 | 130407 | 125529 |
| Ece1 | 057530 | 151110 | 114671 |
| Ece1 | 057530 | 129607 | N/A |
| Echdc2 | 028601 | 052999 | 051268 |
| Echdc2 | 028601 | 130942 | 124746 |
| Echdc2 | 028601 | 125647 | 123913 |
| Echdc2 | 028601 | 116307 | 112009 |
| Echdc2 | 028601 | 135718 | 114371 |
| Echdc2 | 028601 | 138701 | N/A |
| Echdc2 | 028601 | 133049 | N/A |
| Echdc2 | 028601 | 123280 | N/A |

TABLE 2-continued

| ENSEMBL IDs for mice | | | |
|---|---|---|---|
| Symbol | MUSG | MUST | MUSP |
| Echdc2 | 028601 | 126900 | 123734 |
| Echdc2 | 028601 | 150487 | N/A |
| Echdc2 | 028601 | 127392 | N/A |
| Echdc2 | 028601 | 106691 | 102302 |
| Echdc2 | 028601 | 116309 | 112011 |
| Edem1 | 030104 | 204804 | 144901 |
| Edem1 | 030104 | 089162 | 086565 |
| Edem1 | 030104 | 203469 | N/A |
| Edem1 | 030104 | 204524 | N/A |
| Edem1 | 030104 | 203302 | N/A |
| Edil3 | 034488 | 118731 | 112829 |
| Edil3 | 034488 | 153974 | N/A |
| Edil3 | 034488 | 081769 | 080462 |
| Edil3 | 034488 | 134241 | N/A |
| Edil3 | 034488 | 133761 | N/A |
| Edil3 | 034488 | 137921 | N/A |
| Edil3 | 034488 | 140625 | N/A |
| Edil3 | 034488 | 043111 | 044652 |
| Ednrb | 022122 | 022718 | 022718 |
| Ednrb | 022122 | 227824 | 154806 |
| Ednrb | 022122 | 172237 | 126057 |
| Slc13a1 | 029700 | 031713 | 031713 |
| Slc13a1 | 029700 | 174594 | N/A |
| Slc13a1 | 029700 | 177412 | N/A |
| Slc13a1 | 029700 | 176692 | N/A |
| Efemp1 | 020467 | 020759 | 020759 |
| Efemp1 | 020467 | 139713 | 114757 |
| Efemp1 | 020467 | 124103 | N/A |
| Efhc2 | 025038 | 026014 | 026014 |
| Efhd1 | 026255 | 118687 | 112980 |
| Efhd1 | 026255 | 027472 | 027472 |
| Efhd1 | 026255 | 150831 | N/A |
| Efhd2 | 040659 | 036854 | 044502 |
| Efha5 | 048915 | 076840 | 076115 |
| Efha5 | 048915 | 078839 | 077883 |
| Efhb3 | 003934 | 004036 | 004036 |
| Egfr | 020122 | 020329 | 020329 |
| Egfr | 020122 | 102884 | 099948 |
| Egfr | 020122 | 125984 | 122632 |
| Egfr | 020122 | 138518 | N/A |
| Egfr | 020122 | 139722 | N/A |
| Egln3 | 035105 | 039516 | 041874 |
| Egr3 | 033730 | 035908 | 037042 |
| Egr3 | 033730 | 225200 | 153491 |
| Egr3 | 033730 | 223809 | N/A |
| Egr3 | 033730 | 223747 | N/A |
| Ehd3 | 024065 | 024860 | 024860 |
| Eif2s3y | 069049 | 091197 | 088736 |
| Eif2s3y | 069049 | 137006 | N/A |
| Eif2s3v | 069049 | 148961 | N/A |
| Eif2s3y | 069049 | 154556 | N/A |
| Eif2s3v | 069049 | 139083 | N/A |
| Eif2s3y | 069049 | 134820 | N/A |
| Elavl2 | 008489 | 107110 | 102727 |
| Elavl2 | 008489 | 008633 | 008633 |
| Elavl2 | 008489 | 107118 | 102735 |
| Elavl2 | 008489 | 107120 | 102737 |
| Elavl2 | 008489 | 102799 | 099863 |
| Elavl2 | 008489 | 128599 | N/A |
| Elavl2 | 008489 | 107116 | 102733 |
| Elavl2 | 008489 | 107109 | 102726 |
| Elavl2 | 008489 | 107111 | 102728 |
| Elavl2 | 008489 | 176469 | N/A |
| Elavl2 | 008489 | 177109 | 135780 |
| Elavl2 | 008489 | 147611 | 117770 |
| Elavl2 | 008489 | 176362 | 135038 |
| Elavl2 | 008489 | 144769 | N/A |
| Elavl2 | 008489 | 176151 | N/A |
| Elavl2 | 008489 | 107124 | 102741 |
| Elavl4 | 028546 | 106603 | 102214 |
| Elavl4 | 028546 | 102723 | 099784 |
| Elavl4 | 028546 | 106598 | 102208 |
| Elavl4 | 028546 | 106597 | 102207 |
| Elavl4 | 028546 | 102722 | 099783 |
| Elavl4 | 028546 | 106600 | 102210 |
| Elavl4 | 028546 | 106601 | 102212 |

TABLE 2-continued

| ENSEMBL IDs for mice | | | |
|---|---|---|---|
| Symbol | MUSG | MUST | MUSP |
| Elavl4 | 028546 | 142722 | 121828 |
| Elavl4 | 028546 | 153200 | N/A |
| Elavl4 | 028546 | 144554 | N/A |
| Elavl4 | 028546 | 153906 | 120942 |
| Elavl4 | 028546 | 138972 | 123014 |
| Elf2 | 037174 | 194641 | 141197 |
| Elf2 | 037174 | 183463 | 139360 |
| Elf2 | 037174 | 062009 | 061076 |
| Elf2 | 037174 | 091144 | 088678 |
| Elf2 | 037174 | 108051 | 103686 |
| Elf2 | 037174 | 108053 | 103688 |
| Elf2 | 037174 | 193909 | N/A |
| Elf2 | 037174 | 195432 | 142300 |
| Elf2 | 037174 | 183338 | 139358 |
| Elf2 | 037174 | 184677 | 139199 |
| Elf2 | 037174 | 194209 | N/A |
| Elf2 | 037174 | 156983 | 141525 |
| Elf2 | 037174 | 163748 | 126871 |
| Elfn1 | 048988 | 050519 | 053869 |
| Elfn1 | 048988 | 198608 | N/A |
| Elmo2 | 017670 | 103091 | 099380 |
| Elmo2 | 017670 | 148643 | 117124 |
| Elmo2 | 017670 | 074046 | 073691 |
| Elmo2 | 017670 | 094329 | 091887 |
| Elmo2 | 017670 | 103088 | 099377 |
| Elmo2 | 017670 | 071699 | 071619 |
| Elmo2 | 017670 | 127496 | N/A |
| Elmo2 | 017670 | 137188 | 123232 |
| Elmo2 | 017670 | 149844 | N/A |
| Elmo2 | 017670 | 126318 | 116124 |
| Elmo2 | 017670 | 133205 | 119682 |
| Elmo2 | 017670 | 128690 | 114303 |
| Elmod1 | 041986 | 215313 | N/A |
| Elmod1 | 041986 | 048409 | 046191 |
| Elmod1 | 041986 | 216880 | N/A |
| Elmod1 | 041986 | 213111 | N/A |
| Elmod1 | 041986 | 166580 | 129082 |
| Elovl2 | 021364 | 021793 | 021793 |
| Elovl2 | 021364 | 117096 | 114112 |
| Elovl7 | 021696 | 022207 | 022207 |
| Elovl7 | 021696 | 225550 | 152997 |
| Emilin2 | 024053 | 024849 | 024849 |
| Eml5 | 051166 | 065716 | 065643 |
| Eml5 | 051166 | 223282 | 152709 |
| Eml5 | 051166 | 222717 | N/A |
| Eml5 | 051166 | 220848 | N/A |
| Eml5 | 051166 | 221107 | N/A |
| Eml5 | 051166 | 222097 | 152624 |
| Eml5 | 051166 | 222593 | N/A |
| Eml5 | 051166 | 221511 | N/A |
| Eml5 | 051166 | 220676 | N/A |
| Eml5 | 051166 | 222128 | 152401 |
| Emp2 | 022505 | 078357 | 077466 |
| En2 | 039095 | 036177 | 036761 |
| Enah | 022995 | 193703 | 141462 |
| Enah | 022995 | 111024 | 106653 |
| Enah | 022995 | 195703 | N/A |
| Enah | 022995 | 191649 | N/A |
| Enah | 022995 | 193074 | 141936 |
| Enah | 022995 | 078719 | 077781 |
| Enah | 022995 | 195059 | 141344 |
| Enah | 022995 | 111030 | 106659 |
| Enah | 022995 | 195788 | N/A |
| Enah | 022995 | 192768 | N/A |
| Enah | 022995 | 192967 | 141330 |
| Enah | 022995 | 195840 | N/A |
| Enah | 022995 | 195461 | N/A |
| Enah | 022995 | 192497 | N/A |
| Enah | 022995 | 177811 | 136863 |
| Enah | 022995 | 111025 | 106654 |
| Encl | 041773 | 041623 | 038783 |
| Enox1 | 022012 | 022589 | 022589 |
| Enox1 | 022012 | 226576 | N/A |
| Enox1 | 022012 | 228148 | N/A |
| Enox1 | 022012 | 228102 | N/A |
| Enox1 | 022012 | 227831 | 154296 |

TABLE 2-continued

ENSEMBL IDs for mice

| Symbol | MUSG | MUST | MUSP | | Symbol | MUSG | MUST | MUSP |
|---|---|---|---|---|---|---|---|---|
| Enox1 | 022012 | 227662 | 154512 | | Etl4 | 036617 | 146881 | 119778 |
| Enox1 | 022012 | 228845 | N/A | | Etl4 | 036617 | 131714 | 116637 |
| Enpp1 | 037370 | 105520 | 101159 | | Etl4 | 036617 | 045555 | 041431 |
| Enpp1 | 037370 | 039882 | 046090 | | Etl4 | 036617 | 114614 | 110261 |
| Enpp1 | 037370 | 135846 | 114273 | | Etl4 | 036617 | 114604 | 110251 |
| Enpp1 | 037370 | 150570 | N/A | | Etl4 | 036617 | 146613 | N/A |
| Enpp1 | 037370 | 142974 | N/A | | Etl4 | 036617 | 066509 | 066170 |
| Enpp2 | 022425 | 041591 | 036180 | | Etl4 | 036617 | 129278 | N/A |
| Enpp2 | 022425 | 173516 | 133877 | | Etl4 | 036617 | 123383 | N/A |
| Enpp2 | 022425 | 167541 | 132640 | | Etl4 | 036617 | 136870 | N/A |
| Enpp2 | 022425 | 171545 | 128941 | | Etl4 | 036617 | 125556 | N/A |
| Enpp2 | 022425 | 228823 | N/A | | Etl4 | 036617 | 146488 | N/A |
| Enpp2 | 022425 | 227483 | N/A | | Etl4 | 036617 | 125772 | N/A |
| Enpp2 | 022425 | 228222 | 154470 | | Etl4 | 036617 | 114607 | 110254 |
| Enpp2 | 022425 | 227057 | N/A | | Etl4 | 036617 | 114606 | 110253 |
| Enpp2 | 022425 | 226339 | 154729 | | Etl4 | 036617 | 114608 | 110255 |
| Enpp4 | 023961 | 024757 | 024757 | | Etl4 | 036617 | 139531 | N/A |
| Enpp4 | 023961 | 143137 | 114429 | | Etl4 | 036617 | 156587 | N/A |
| Enpp6 | 038173 | 039840 | 044608 | | Etl4 | 036617 | 114627 | 110274 |
| Enpp6 | 038173 | 140149 | N/A | | Etnppl | 019232 | 166187 | 131294 |
| Enpp6 | 038173 | 123066 | 147811 | | Etnppl | 019232 | 072271 | 072121 |
| Enpp6 | 038173 | 119686 | 112633 | | Etnppl | 019232 | 199940 | N/A |
| Enpp6 | 038173 | 149593 | 121470 | | Etnppl | 019232 | 172432 | N/A |
| Enpp6 | 038173 | 210466 | N/A | | Etnppl | 019232 | 163620 | 129120 |
| Epb41l4b | 028434 | 030142 | 030142 | | Etnppl | 019232 | 170664 | 128425 |
| Epb41l4b | 028434 | 095076 | 092687 | | Etv1 | 004151 | 160244 | 125733 |
| Epb41l4b | 028434 | 044022 | 037625 | | Etv1 | 004151 | 095767 | 093442 |
| Epb41l4b | 028434 | 136337 | N/A | | Etv1 | 004151 | 162563 | 125157 |
| Epb41l4b | 028434 | 133859 | N/A | | Etv1 | 004151 | 161164 | 124650 |
| Epb41l4b | 028434 | 149109 | N/A | | Etv1 | 004151 | 160996 | 124705 |
| Epb41l4b | 028434 | 150665 | N/A | | Etv1 | 004151 | 160856 | 125692 |
| Epha3 | 052504 | 064405 | 066554 | | Etv1 | 004151 | 162730 | N/A |
| Epha4 | 026235 | 188952 | 139640 | | Etv1 | 004151 | 161513 | 124166 |
| Epha4 | 026235 | 188797 | 140954 | | Etv1 | 004151 | 161980 | 124736 |
| Epha4 | 026235 | 187346 | 140631 | | Etv1 | 004151 | 160701 | 124019 |
| Epha4 | 026235 | 190149 | 140408 | | Etv1 | 004151 | 159334 | 125676 |
| Epha4 | 026235 | 189934 | N/A | | Etv1 | 004151 | 220492 | N/A |
| Epha4 | 026235 | 186930 | 140370 | | Etv1 | 004151 | 161591 | N/A |
| Epha4 | 026235 | 027451 | 027451 | | Etv4 | 017724 | 107176 | 102794 |
| Ephb1 | 032537 | 035129 | 035129 | | Etv4 | 017724 | 017868 | 017868 |
| Ephb1 | 032537 | 085169 | 082261 | | Etv4 | 017724 | 132040 | N/A |
| Ephb1 | 032537 | 217014 | N/A | | Etv4 | 017724 | 129160 | N/A |
| Ephb1 | 032537 | 217184 | N/A | | Etv4 | 017724 | 131862 | N/A |
| Ephb1 | 032537 | 215514 | N/A | | Etv4 | 017724 | 129995 | N/A |
| Ephb1 | 032537 | 149800 | 139470 | | Etv4 | 017724 | 140970 | N/A |
| Eps15 | 028552 | 102729 | 099790 | | Etv4 | 017724 | 131117 | N/A |
| Eps15 | 028552 | 176251 | 135034 | | Etv4 | 017724 | 149099 | N/A |
| Eps15 | 028552 | 177089 | 134922 | | Etv4 | 017724 | 137179 | N/A |
| Eps15 | 028552 | 175776 | 135270 | | Etv4 | 017724 | 154512 | N/A |
| Eps15 | 028552 | 132165 | 118949 | | Etv4 | 017724 | 164750 | 129261 |
| Eps15 | 028552 | 150755 | N/A | | Etv5 | 013089 | 079601 | 078551 |
| Eps15 | 028552 | 141751 | N/A | | Etv5 | 013089 | 168774 | 131791 |
| Eps15 | 028552 | 030281 | 030281 | | Etv5 | 013089 | 170803 | 128338 |
| Eps15 | 028552 | 126015 | N/A | | Etv5 | 013089 | 165506 | N/A |
| Eps15 | 028552 | 177192 | 135755 | | Etv5 | 013089 | 170393 | 132210 |
| Eps15 | 028552 | 177140 | N/A | | Eva1a | 035104 | 150976 | 122674 |
| Erbb3 | 018166 | 082059 | 080716 | | Eva1a | 035104 | 042974 | 037422 |
| Erbb4 | 062209 | 119142 | 112713 | | Eva1a | 035104 | 150691 | N/A |
| Erbb4 | 062209 | 121473 | 114123 | | Eva1a | 035104 | 149023 | 117345 |
| Erbb4 | 062209 | 153432 | 115373 | | Exph5 | 034584 | 051014 | 062632 |
| Erbb4 | 062209 | 131148 | N/A | | Exph5 | 034584 | 139096 | N/A |
| Erbb4 | 062209 | 126682 | N/A | | Exph5 | 034584 | 132410 | N/A |
| Erich5 | 044726 | 060894 | 058182 | | Extl2 | 027963 | 029575 | 029575 |
| Ermn | 026830 | 090940 | 088458 | | Extl2 | 027963 | 106501 | 102110 |
| Esrrb | 021255 | 116402 | 112103 | | Extl2 | 027963 | 128228 | N/A |
| Esrrb | 021255 | 110203 | 105832 | | Extl2 | 027963 | 145945 | N/A |
| Esrrb | 021255 | 110204 | 105833 | | Extl2 | 027963 | 149920 | N/A |
| Esrrb | 021255 | 021680 | 021680 | | Extl2 | 027963 | 106502 | 102111 |
| Esrrb | 021255 | 167891 | 131335 | | Eya1 | 025932 | 168081 | 126383 |
| Esrrb | 021255 | 136464 | N/A | | Eya1 | 025932 | 080664 | 079493 |
| Esrrg | 026610 | 127489 | 119286 | | Eya1 | 025932 | 190337 | 141112 |
| Esrrg | 026610 | 110939 | 106564 | | Eya1 | 025932 | 189526 | 140619 |
| Esrrg | 026610 | 152927 | N/A | | Eya1 | 025932 | 188857 | 140171 |
| Esrrg | 026610 | 027906 | 027906 | | Eya1 | 025932 | 185453 | 141072 |
| Esrrg | 026610 | 110938 | 106563 | | Eya1 | 025932 | 187790 | 139542 |
| Etl4 | 036617 | 114610 | 110257 | | Eya1 | 025932 | 185329 | N/A |

TABLE 2-continued

| ENSEMBL IDs for mice | | | |
| --- | --- | --- | --- |
| Symbol | MUSG | MUST | MUSP |
| Eya1 | 025932 | 027066 | 027066 |
| F3 | 028128 | 029771 | 029771 |
| F3 | 028128 | 196746 | N/A |
| F3 | 028128 | 197731 | N/A |
| F3 | 028128 | 199997 | 143678 |
| Fa2h | 033579 | 038475 | 043597 |
| Fa2h | 033579 | 162463 | N/A |
| Fa2h | 033579 | 159336 | N/A |
| Fa2h | 033579 | 162216 | N/A |
| Fam102a | 039157 | 136816 | N/A |
| Fam102a | 039157 | 133512 | 116809 |
| Fam102a | 039157 | 048375 | 044731 |
| Fam102a | 039157 | 133366 | 118624 |
| Fam102a | 039157 | 147723 | N/A |
| Fam107b | 026655 | 226435 | 154419 |
| Fam107b | 026655 | 115052 | 110704 |
| Fam107b | 026655 | 115055 | 110707 |
| Fam107b | 026655 | 115054 | 110706 |
| Fam107b | 026655 | 027965 | 027965 |
| Fam107b | 026655 | 115053 | 110705 |
| Fam107b | 026655 | 177125 | 135757 |
| Fam107b | 026655 | 177037 | 135325 |
| Fam107b | 026655 | 176254 | 135846 |
| Fam114a1 | 029185 | 031080 | 031080 |
| Fam114a1 | 029185 | 139366 | 119284 |
| Fam117a | 038893 | 037502 | 049162 |
| Fam117a | 038893 | 129553 | N/A |
| Fam117a | 038893 | 143482 | N/A |
| Fam117a | 038893 | 129290 | N/A |
| Fam117a | 038893 | 155999 | N/A |
| Fam117a | 038893 | 132357 | N/A |
| Fam124a | 035184 | 162987 | N/A |
| Fam124a | 035184 | 161899 | N/A |
| Fam124a | 035184 | 039064 | 047681 |
| Fam124a | 035184 | 160745 | N/A |
| Retreg1 | 022270 | 022881 | 022881 |
| Retreg1 | 022270 | 228600 | 154407 |
| Retreg1 | 022270 | 228327 | 154377 |
| Retreg1 | 022270 | 227275 | 154471 |
| Retreg1 | 022270 | 226750 | 154791 |
| Retreg1 | 022270 | 226438 | 154765 |
| Retreg1 | 022270 | 110438 | 106068 |
| Retreg1 | 022270 | 228306 | 154070 |
| Fam171b | 048388 | 051454 | 062702 |
| Fam171b | 048388 | 148184 | N/A |
| Fam196a | 073805 | 210055 | N/A |
| Fam196a | 073805 | 171394 | 129222 |
| Fam196a | 073805 | 210826 | N/A |
| Fam198b | 027955 | 118853 | 114093 |
| Fam198b | 027955 | 145992 | 120603 |
| Fam198b | 027955 | 135021 | 117199 |
| Fam198b | 027955 | 193204 | N/A |
| Fam198b | 027955 | 029567 | 029567 |
| Fam19a1 | 059187 | 122120 | 113152 |
| Fam19a1 | 059187 | 075080 | 074589 |
| Fam19a1 | 059187 | 129844 | N/A |
| Fam19a1 | 059187 | 125951 | N/A |
| Fam19a4 | 046500 | 089295 | 086710 |
| Fam19a4 | 046500 | 203930 | N/A |
| Fam20a | 020614 | 155559 | 116687 |
| Fam20a | 020614 | 020938 | 020938 |
| Fam20a | 020614 | 146408 | N/A |
| Fam20a | 020614 | 144972 | N/A |
| Fam222b | 037750 | 073705 | 073384 |
| Fam222b | 037750 | 100782 | 126620 |
| Fam222b | 037750 | 155571 | 121832 |
| Fam46a | 032265 | 034802 | 034802 |
| Fam46a | 032265 | 187711 | 140869 |
| Fam49b | 022378 | 063838 | 066359 |
| Fam49b | 022378 | 164532 | 132486 |
| Fam49b | 022378 | 228226 | 154320 |
| Fam49b | 022378 | 228908 | 154547 |
| Fam49b | 022378 | 227024 | 153790 |
| Fam49b | 022378 | 226675 | 154205 |
| Fam49b | 022378 | 227118 | N/A |
| Fam49b | 022378 | 226129 | N/A |

TABLE 2-continued

| ENSEMBL IDs for mice | | | |
| --- | --- | --- | --- |
| Symbol | MUSG | MUST | MUSP |
| Fam69a | 029270 | 031198 | 031198 |
| Fam69a | 029270 | 145239 | 117801 |
| Fam69a | 029270 | 153172 | 114892 |
| Fam84a | 020607 | 020926 | 020926 |
| Fam84a | 020607 | 221405 | 152642 |
| Fam89a | 043068 | 055257 | 058156 |
| Fam92b | 042269 | 048786 | 038825 |
| Fam92b | 042269 | 153177 | N/A |
| Fam92b | 042269 | 135567 | 134033 |
| Fam92b | 042269 | 142478 | N/A |
| Fat1 | 070047 | 191428 | 140596 |
| Fat1 | 070047 | 189017 | 140765 |
| Fat1 | 070047 | 215588 | 149194 |
| Fat1 | 070047 | 186342 | 139921 |
| Fat1 | 070047 | 189367 | N/A |
| Fat1 | 070047 | 098796 | 096394 |
| Fat2 | 055333 | 068853 | 067556 |
| Fat2 | 055333 | 108864 | 104492 |
| Fbln2 | 064080 | 113498 | 109126 |
| Fbln2 | 064080 | 041544 | 048334 |
| Fbln2 | 064080 | 153364 | 120101 |
| Fbln2 | 064080 | 132021 | 116456 |
| Fbln2 | 064080 | 203406 | N/A |
| Fbln2 | 064080 | 134974 | 116302 |
| Fbln2 | 064080 | 147371 | N/A |
| Fbln2 | 064080 | 134286 | N/A |
| Fbln2 | 064080 | 137029 | N/A |
| Fbn1 | 027204 | 028633 | 028633 |
| Fbn1 | 027204 | 148272 | N/A |
| Fbn1 | 027204 | 103234 | 099524 |
| Fbn2 | 024598 | 025497 | 025497 |
| Fchsd2 | 030691 | 208439 | 146962 |
| Fchsd2 | 030691 | 032931 | 032931 |
| Fchsd2 | 030691 | 098250 | 095850 |
| Fchsd2 | 030691 | 137196 | N/A |
| Fchsd2 | 030691 | 145802 | N/A |
| Fchsd2 | 030691 | 142727 | N/A |
| Fchsd2 | 030691 | 130426 | N/A |
| Fchsd2 | 030691 | 208063 | N/A |
| Fchsd2 | 030691 | 151693 | N/A |
| Fchsd2 | 030691 | 208638 | N/A |
| Fchsd2 | 030691 | 208917 | N/A |
| Fezf2 | 021743 | 224714 | 153090 |
| Fezf2 | 021743 | 022262 | 022262 |
| Fezf2 | 021743 | 224023 | 153647 |
| Fgd3 | 037946 | 110087 | 105714 |
| Fgd3 | 037946 | 048716 | 048692 |
| Fgd3 | 037946 | 110086 | 105713 |
| Fgd4 | 022788 | 161861 | 125174 |
| Fgd4 | 022788 | 162671 | 125736 |
| Fgd4 | 022788 | 069284 | 069573 |
| Fgd4 | 022788 | 172181 | N/A |
| Fgd4 | 022788 | 162045 | N/A |
| Fgd4 | 022788 | 162124 | N/A |
| Fgd4 | 022788 | 159542 | 125649 |
| Fgd4 | 022788 | 159058 | N/A |
| Fgd4 | 022788 | 162414 | N/A |
| Fgd4 | 022788 | 162542 | N/A |
| Fgd4 | 022788 | 161624 | N/A |
| Fgd4 | 022788 | 161188 | 123763 |
| Fgd6 | 020021 | 020208 | 020208 |
| Fgd6 | 020021 | 141143 | N/A |
| Fgd6 | 020021 | 125535 | N/A |
| Fgf13 | 031137 | 033473 | 033473 |
| Fgf13 | 031137 | 138503 | N/A |
| Fgf13 | 031137 | 123660 | N/A |
| Fgf13 | 031137 | 124402 | 114905 |
| Fgf13 | 031137 | 145767 | 119897 |
| Fgf13 | 031137 | 119833 | 113639 |
| Fgf13 | 031137 | 131319 | 115765 |
| Fgf13 | 031137 | 119306 | 113206 |
| Fgf13 | 031137 | 150413 | N/A |
| Fgfr1 | 031565 | 155564 | 117884 |
| Fgfr1 | 031565 | 084027 | 081041 |
| Fgfr1 | 031565 | 119398 | 113855 |
| Fgfr1 | 031565 | 117179 | 113909 |

TABLE 2-continued

ENSEMBL IDs for mice

| Symbol | MUSG | MUST | MUSP |
|---|---|---|---|
| Fgfr1 | 031565 | 148322 | N/A |
| Fgfr1 | 031565 | 210778 | N/A |
| Fgfr1 | 031565 | 124228 | 116564 |
| Fgfr1 | 031565 | 210846 | 148032 |
| Fgfr1 | 031565 | 167764 | 131343 |
| Fgfr1 | 031565 | 138104 | 148135 |
| Fgfr1 | 031565 | 138455 | 147898 |
| Fgfr1 | 031565 | 126118 | N/A |
| Fgfr1 | 031565 | 210504 | N/A |
| Fgfr1 | 031565 | 120106 | N/A |
| Fgfr1 | 031565 | 211419 | N/A |
| Fgfr1 | 031565 | 145218 | N/A |
| Fgfr1 | 031565 | 133936 | N/A |
| Fgfr1 | 031565 | 179592 | 136640 |
| Fgfr1 | 031565 | 178276 | 137515 |
| Fgfr2 | 030849 | 120187 | 113248 |
| Fgfr2 | 030849 | 124096 | 130971 |
| Fgfr2 | 030849 | 153166 | 120100 |
| Fgfr2 | 030849 | 117872 | 113994 |
| Fgfr2 | 030849 | 130557 | N/A |
| Fgfr2 | 030849 | 122054 | 112430 |
| Fgfr2 | 030849 | 136264 | N/A |
| Fgfr2 | 030849 | 121064 | 113452 |
| Fgfr2 | 030849 | 117754 | 113187 |
| Fgfr2 | 030849 | 120715 | 113474 |
| Fgfr2 | 030849 | 119260 | 113010 |
| Fgfr2 | 030849 | 117089 | 112992 |
| Fgfr2 | 030849 | 117691 | 113180 |
| Fgfr2 | 030849 | 117858 | 112623 |
| Fgfr2 | 030849 | 120141 | 113415 |
| Fgfr2 | 030849 | 117357 | 112580 |
| Fgfr2 | 030849 | 122448 | 113993 |
| Fgfr2 | 030849 | 118296 | 112471 |
| Fgfr2 | 030849 | 121080 | 112585 |
| Fgfr2 | 030849 | 117073 | 112672 |
| Fgfr2 | 030849 | 129542 | N/A |
| Fgfr2 | 030849 | 147859 | N/A |
| Fgfr2 | 030849 | 133806 | N/A |
| Fgfr2 | 030849 | 148675 | N/A |
| Fgfr2 | 030849 | 127091 | 122856 |
| Fgfr2 | 030849 | 129103 | N/A |
| Fgfr2 | 030849 | 208844 | N/A |
| Fgfr3 | 054252 | 201437 | 144379 |
| Fgfr3 | 054252 | 067150 | 070998 |
| Fgfr3 | 054252 | 164207 | 133064 |
| Fgfr3 | 054252 | 087820 | 085122 |
| Fgfr3 | 054252 | 202182 | 143936 |
| Fgfr3 | 054252 | 134610 | N/A |
| Fgfr3 | 054252 | 155002 | 119941 |
| Fgfr3 | 054252 | 181298 | 143963 |
| Fgfr3 | 054252 | 132724 | N/A |
| Fgfr3 | 054252 | 201295 | 144104 |
| Fgfr3 | 054252 | 202791 | 143797 |
| Fgfr3 | 054252 | 152661 | N/A |
| Fgfr3 | 054252 | 142860 | N/A |
| Fgfr3 | 054252 | 202138 | 143945 |
| Fgfr3 | 054252 | 169212 | 130856 |
| Fgfr3 | 054252 | 114411 | 110053 |
| Fgfr3 | 054252 | 171509 | 131845 |
| Fggy | 028573 | 079223 | 078216 |
| Fggy | 028573 | 176162 | N/A |
| Fggy | 028573 | 141248 | N/A |
| Fggy | 028573 | 177394 | 134881 |
| Fggy | 028573 | 043335 | 043460 |
| Fggy | 028573 | 147783 | N/A |
| Fggy | 028573 | 150830 | 115546 |
| Fggy | 028573 | 134012 | 115859 |
| Fggy | 028573 | 131654 | 116264 |
| Fggy | 028573 | 107091 | 102706 |
| Fggy | 028573 | 176840 | N/A |
| Fggy | 028573 | 147766 | N/A |
| Fggy | 028573 | 143742 | 117386 |
| Fggy | 028573 | 125742 | N/A |
| Fggy | 028573 | 153119 | N/A |
| Fggy | 028573 | 130541 | 115688 |
| Fggy | 028573 | 156223 | 118147 |

TABLE 2-continued

ENSEMBL IDs for mice

| Symbol | MUSG | MUST | MUSP |
|---|---|---|---|
| Fggy | 028573 | 142384 | 123407 |
| Fhl3 | 032643 | 106199 | 101805 |
| Fhl3 | 032643 | 145942 | 121702 |
| Fhl3 | 032643 | 038684 | 040150 |
| Fhl5 | 028259 | 029922 | 029922 |
| Fhl5 | 028259 | 108204 | 103839 |
| Fign | 075324 | 131615 | 122855 |
| Fign | 075324 | 102728 | 124338 |
| Fign | 075324 | 153538 | N/A |
| Fign | 075324 | 126042 | N/A |
| Filip1l | 043336 | 159816 | 124179 |
| Filip1l | 043336 | 099667 | 133252 |
| Filip1l | 043336 | 159414 | 124069 |
| Fli1 | 016087 | 016231 | 016231 |
| Fli1 | 016087 | 183767 | 138984 |
| Flrt2 | 047414 | 057324 | 062171 |
| Flrt2 | 047414 | 110117 | 105744 |
| Flt3 | 042817 | 049324 | 039041 |
| Flt3 | 042817 | 110549 | N/A |
| Fmnl1 | 055805 | 042286 | 046296 |
| Fmnl1 | 055805 | 218163 | 151439 |
| Fmnl1 | 055805 | 107027 | 102642 |
| Fmnl1 | 055805 | 126425 | N/A |
| Fmnl1 | 055805 | 154871 | N/A |
| Fmnl1 | 055805 | 021322 | N/A |
| Fmnl1 | 055805 | 129726 | 133299 |
| Fmo3 | 026691 | 028010 | 028010 |
| Fmo3 | 026691 | 142759 | N/A |
| Fndc3b | 039286 | 195008 | 141620 |
| Fndc3b | 039286 | 046157 | 041495 |
| Fndc3b | 039286 | 191684 | N/A |
| Fndc3b | 039286 | 193779 | 141888 |
| Folh1 | 001773 | 001824 | 001824 |
| Folh1 | 001773 | 107271 | 102892 |
| Folh1 | 001773 | 209082 | N/A |
| Fosb | 003545 | 003640 | 003640 |
| Fosb | 003545 | 207334 | 147210 |
| Fosb | 003545 | 208505 | 146525 |
| Fosb | 003545 | 207716 | 146949 |
| Fosb | 003545 | 208326 | 146569 |
| Fosb | 003545 | 208446 | 146789 |
| Fosb | 003545 | 208230 | N/A |
| Foxa1 | 035451 | 044380 | 041118 |
| Foxa1 | 035451 | 218398 | N/A |
| Foxa2 | 037025 | 109964 | 105590 |
| Foxa2 | 037025 | 047315 | 045918 |
| Foxa2 | 037025 | 172928 | 134081 |
| Foxa2 | 037025 | 146242 | N/A |
| Foxg1 | 020950 | 135006 | N/A |
| Foxg1 | 020950 | 154930 | N/A |
| Foxg1 | 020950 | 179669 | 136372 |
| Foxg1 | 020950 | 021333 | 021333 |
| Foxh1 | 033837 | 037824 | 036591 |
| Foxp4 | 023991 | 113265 | 108890 |
| Foxp4 | 023991 | 113263 | 108888 |
| Foxp4 | 023991 | 097311 | 094916 |
| Foxp4 | 023991 | 113262 | 108887 |
| Foxp4 | 023991 | 136314 | N/A |
| Foxp4 | 023991 | 154108 | N/A |
| Foxp4 | 023991 | 137039 | N/A |
| Foxp4 | 023991 | 153752 | N/A |
| Frem1 | 059049 | 107230 | 102849 |
| Frem1 | 059049 | 127886 | 122467 |
| Frem1 | 059049 | 131102 | N/A |
| Frem1 | 059049 | 130889 | N/A |
| Frem1 | 059049 | 141841 | N/A |
| Frem1 | 059049 | 133610 | N/A |
| Frem1 | 059049 | 071708 | 071627 |
| Frem1 | 059049 | 170248 | 125809 |
| Frmd3 | 049122 | 084474 | 081514 |
| Frmd3 | 049122 | 098006 | 095615 |
| Frmd3 | 049122 | 154134 | N/A |
| Frmd4a | 026657 | 138735 | N/A |
| Frmd4a | 026657 | 137809 | N/A |
| Frmd4a | 026657 | 177457 | 134788 |
| Frmd4a | 026657 | 132710 | N/A |

TABLE 2-continued

| ENSEMBL IDs for mice | | | |
|---|---|---|---|
| Symbol | MUSG | MUST | MUSP |
| Frmd4a | 026657 | 091497 | 089079 |
| Frmd4a | 026657 | 175669 | 135306 |
| Frmd4a | 026657 | 147156 | N/A |
| Frmd4a | 026657 | 176803 | 135432 |
| Frmd4a | 026657 | 175944 | 135686 |
| Frmd4a | 026657 | 115037 | 110689 |
| Frmd4a | 026657 | 141746 | N/A |
| Frmd4a | 026657 | 075767 | 075172 |
| Frmd4a | 026657 | 176962 | N/A |
| Frmd4a | 026657 | 115039 | N/A |
| Frmd4a | 026657 | 123919 | N/A |
| Frmd4a | 026657 | 153160 | N/A |
| Frmd4a | 026657 | 176828 | 134803 |
| Frmd4a | 026657 | 142452 | N/A |
| Frmd4a | 026657 | 176864 | 135057 |
| Frmd4b | 030064 | 113355 | 108982 |
| Frmd4b | 030064 | 203486 | N/A |
| Frmd4b | 030064 | 143698 | N/A |
| Frmd4b | 030064 | 113359 | 108986 |
| Frmd4b | 030064 | 032146 | 032146 |
| Frmd4b | 030064 | 146191 | N/A |
| Frmd4b | 030064 | 155326 | N/A |
| Frmd4b | 030064 | 138301 | N/A |
| Frmd4b | 030064 | 152385 | N/A |
| Frmd4b | 030064 | 113353 | N/A |
| Frmd4b | 030064 | 142589 | N/A |
| Frmd4b | 030064 | 126899 | N/A |
| Frmd4b | 030064 | 124050 | 145240 |
| Frnipd1 | 035615 | 107804 | 103434 |
| Frnipd1 | 035615 | 134280 | 118757 |
| Frnipd1 | 035615 | 044773 | 047232 |
| Frmpd2 | 108841 | 208853 | 146522 |
| Frmpd2 | 108841 | 208577 | 146693 |
| Frmpd2 | 108841 | 207581 | N/A |
| Frmpd2 | 108841 | 208380 | N/A |
| Frmpd4 | 049176 | 112149 | 107777 |
| Frmpd4 | 049176 | 112146 | 107774 |
| Frmpd4 | 049176 | 112147 | 107775 |
| Frmpd4 | 049176 | 112145 | 107773 |
| Frrs1 | 033386 | 040260 | 039487 |
| Frrs1 | 033386 | 199626 | 143546 |
| Frrs1 | 033386 | 195905 | 143255 |
| Frrs1 | 033386 | 199584 | N/A |
| Frrs1 | 033386 | 197323 | N/A |
| Frrs1 | 033386 | 199030 | 142793 |
| Frrs1l | 045589 | 053681 | 052507 |
| Frrs1l | 045589 | 128276 | 121657 |
| Fry | 056602 | 200960 | 144674 |
| Fry | 056602 | 202530 | 144277 |
| Fry | 056602 | 203000 | N/A |
| Fry | 056602 | 202600 | 144317 |
| Fry | 056602 | 201854 | N/A |
| Fry | 056602 | 087204 | 084454 |
| Fry | 056602 | 202841 | N/A |
| Fry | 056602 | 200964 | N/A |
| Fry | 056602 | 202630 | N/A |
| Fry | 056602 | 201634 | N/A |
| Fry | 056602 | 202566 | 144657 |
| Fry | 056602 | 200863 | 143845 |
| Fry | 056602 | 201196 | N/A |
| Fry | 056602 | 202070 | N/A |
| Fry | 056602 | 200750 | N/A |
| Fry | 056602 | 202571 | N/A |
| Fry | 056602 | 201628 | N/A |
| Fsip2 | 075249 | 143764 | 120314 |
| Fsip2 | 075249 | 136202 | 114196 |
| Fsip2 | 075249 | 132967 | 122350 |
| Fstl5 | 034098 | 038364 | 038506 |
| Fstl5 | 034098 | 159686 | N/A |
| Fstl5 | 034098 | 160261 | 125393 |
| Fstl5 | 034098 | 191664 | N/A |
| Fstl5 | 034098 | 162471 | 125688 |
| Fth1 | 024661 | 025563 | 025563 |
| Fxyd1 | 036570 | 206328 | 145712 |
| Fxyd1 | 036570 | 205807 | 145990 |
| Fxyd1 | 036570 | 205917 | N/A |

TABLE 2-continued

| ENSEMBL IDs for mice | | | |
|---|---|---|---|
| Symbol | MUSG | MUST | MUSP |
| Fxyd1 | 036570 | 206012 | 146295 |
| Fxyd1 | 036570 | 206305 | 145589 |
| Fxyd1 | 036570 | 206030 | 146129 |
| Fxyd1 | 036570 | 206317 | N/A |
| Fxyd1 | 036570 | 205778 | 145818 |
| Fxyd1 | 036570 | 108110 | 103745 |
| Fxyd1 | 036570 | 206860 | 146288 |
| Fxyd1 | 036570 | 206474 | 145920 |
| Fxyd1 | 036570 | 071697 | 071617 |
| Fxyd1 | 036570 | 205439 | 146064 |
| Fxyd1 | 036570 | 205542 | N/A |
| Fxyd1 | 036570 | 206522 | N/A |
| Fxyd1 | 036570 | 205392 | N/A |
| Fxyd1 | 036570 | 039909 | 048460 |
| Fxyd7 | 036578 | 206341 | 146171 |
| Fxyd7 | 036578 | 073892 | 073555 |
| Fzd9 | 049551 | 062572 | 053551 |
| Gab2 | 004508 | 004622 | 004622 |
| Gab2 | 004508 | 206791 | 146200 |
| Gabra2 | 000560 | 197284 | 142892 |
| Gabra2 | 000560 | 198625 | 143645 |
| Gabra2 | 000560 | 197124 | N/A |
| Gabra2 | 000560 | 000572 | 000572 |
| Gabra2 | 000560 | 199861 | N/A |
| Gabra2 | 000560 | 199012 | N/A |
| Gabra4 | 029211 | 031121 | 031121 |
| Gabra4 | 029211 | 199357 | 143675 |
| Gabra4 | 029211 | 197994 | 143063 |
| Gabra4 | 029211 | 198138 | 142466 |
| Gabra4 | 029211 | 199150 | N/A |
| Gabra6 | 020428 | 020703 | 020703 |
| Gabra6 | 020428 | 155218 | 126114 |
| Gabra6 | 020428 | 109286 | 104909 |
| Gabrb1 | 029212 | 199967 | 143682 |
| Gabrb1 | 029212 | 031122 | 031122 |
| Gabrd | 029054 | 150423 | N/A |
| Gabrd | 029054 | 030925 | 030925 |
| Gabrd | 029054 | 129892 | N/A |
| Gabrg2 | 020436 | 070725 | 064739 |
| Gabrg2 | 020436 | 070735 | 063812 |
| Gabrg2 | 020436 | 146198 | N/A |
| Gabrg2 | 020436 | 109290 | 104913 |
| Gabrg3 | 055026 | 068911 | 067632 |
| Gabrg3 | 055026 | 068394 | 065255 |
| Gabrg3 | 055026 | 171965 | N/A |
| Gad1 | 070880 | 094934 | 092539 |
| Gad1 | 070880 | 130604 | 117721 |
| Gad1 | 070880 | 148210 | 119733 |
| Gad1 | 070880 | 130998 | 119379 |
| Gad1 | 070880 | 155979 | N/A |
| Gad1 | 070880 | 140478 | N/A |
| Gad1 | 070880 | 130618 | 117521 |
| Gad1 | 070880 | 123330 | 116301 |
| Gad2 | 026787 | 028123 | 028123 |
| Gad2 | 026787 | 156728 | N/A |
| Gal3st1 | 049721 | 078757 | 077815 |
| Gal3st1 | 049721 | 063004 | 058348 |
| Gal3st1 | 049721 | 109981 | 105608 |
| Galnt14 | 024064 | 024858 | 024858 |
| Galnt14 | 024064 | 146565 | N/A |
| Galnt14 | 024064 | 112591 | 108210 |
| Galnt15 | 021903 | 022460 | 022460 |
| Galnt15 | 021903 | 164208 | 131978 |
| Galnt16 | 021130 | 219993 | 151829 |
| Galnt16 | 021130 | 218943 | 151619 |
| Galnt16 | 021130 | 021558 | 021558 |
| Galnt16 | 021130 | 218648 | N/A |
| Galnt16 | 021130 | 217926 | 151370 |
| Galnt16 | 021130 | 219267 | 151800 |
| Galnt18 | 038296 | 049430 | 043636 |
| Galnt18 | 038296 | 106663 | 102274 |
| Galnt3 | 026994 | 028378 | 028378 |
| Galnt3 | 026994 | 153563 | N/A |
| Galnt3 | 026994 | 150793 | N/A |
| Galnt3 | 026994 | 155453 | N/A |
| Galnt5 | 026828 | 112616 | 108235 |

TABLE 2-continued

ENSEMBL IDs for mice

| Symbol | MUSG | MUST | MUSP |
|---|---|---|---|
| Galnt5 | 026828 | 144671 | N/A |
| Galnt5 | 026828 | 166729 | 131362 |
| Galnt6 | 037280 | 159715 | 123848 |
| Galnt6 | 037280 | 052069 | 056705 |
| Galnt6 | 037280 | 161514 | 124793 |
| Galntl6 | 096914 | 204128 | 145321 |
| Galntl6 | 096914 | 204067 | 145016 |
| Galntl6 | 096914 | 204937 | N/A |
| Galntl6 | 096914 | 077447 | N/A |
| Galntl6 | 096914 | 146513 | 118306 |
| Galntl6 | 096914 | 125865 | N/A |
| Galntl6 | 096914 | 203398 | 145298 |
| Galntl6 | 096914 | 188531 | 139677 |
| Galntl6 | 096914 | 098757 | 096353 |
| Galr1 | 024553 | 065224 | 066381 |
| Gapdh | 057666 | 192506 | N/A |
| Gapdh | 057666 | 147954 | N/A |
| Gapdh | 057666 | 117757 | 113942 |
| Gapdh | 057666 | 118875 | 113213 |
| Gapdh | 057666 | 183272 | 138508 |
| Gapdh | 057666 | 182464 | N/A |
| Gapdh | 057666 | 144205 | N/A |
| Gapdh | 057666 | 182115 | N/A |
| Gapdh | 057666 | 182052 | 138403 |
| Gapdh | 057666 | 182277 | 138295 |
| Gapdh | 057666 | 182670 | N/A |
| Gapdh | 057666 | 144588 | N/A |
| Gapdh | 057666 | 073605 | 073289 |
| Garem2 | 044576 | 058045 | 054208 |
| Garnl3 | 038860 | 102810 | 099874 |
| Garnl3 | 038860 | 049618 | 057582 |
| Garnl3 | 038860 | 137381 | 122576 |
| Garnl3 | 038860 | 153717 | N/A |
| Garnl3 | 038860 | 139778 | N/A |
| Garnl3 | 038860 | 193171 | 142077 |
| Garnl3 | 038860 | 150242 | N/A |
| Garnl3 | 038860 | 135296 | N/A |
| Garnl3 | 038860 | 148043 | N/A |
| Garnl3 | 038860 | 133135 | 119973 |
| Garnl3 | 038860 | 127509 | 141523 |
| Garnl3 | 038860 | 124000 | 123601 |
| Gas1 | 052957 | 065086 | 064555 |
| Gas1 | 052957 | 223933 | 153311 |
| Gatm | 027199 | 028624 | 028624 |
| Gatm | 027199 | 154598 | N/A |
| Gatm | 027199 | 140808 | N/A |
| Gatm | 111138 | 215775 | 150264 |
| Gatm | 111138 | 214872 | N/A |
| Gatm | 111138 | 214402 | N/A |
| Gatsl2 | 015944 | 016088 | 016088 |
| Gatsl2 | 015944 | 201013 | N/A |
| Gatsl2 | 015944 | 140240 | N/A |
| Gca | 026893 | 028257 | 028257 |
| Gca | 026893 | 148083 | N/A |
| Gda | 058624 | 087600 | 084882 |
| Gda | 058624 | 136258 | N/A |
| Gda | 058624 | 121725 | 112758 |
| Gdf10 | 021943 | 168727 | 128621 |
| Gfap | 020932 | 067444 | 064691 |
| Gfap | 020932 | 127909 | N/A |
| Gfap | 020932 | 077902 | 077061 |
| Gfra2 | 022103 | 022699 | 022699 |
| Gfra2 | 022103 | 227697 | 154391 |
| Gfra2 | 022103 | 227633 | 153937 |
| Ghitm | 041028 | 165649 | 129712 |
| Ghitm | 041028 | 042564 | 046212 |
| Ghitm | 041028 | 224769 | 153458 |
| Ghitm | 041028 | 223921 | N/A |
| Ghr | 055737 | 069451 | 069457 |
| Ghr | 055737 | 161561 | 124064 |
| Ghr | 055737 | 110698 | 106326 |
| Ghr | 055737 | 110697 | 106325 |
| Ghr | 055737 | 161770 | 125044 |
| Ghr | 055737 | 160343 | N/A |
| Ghr | 055737 | 162993 | N/A |
| Ghr | 055737 | 159508 | N/A |

TABLE 2-continued

ENSEMBL IDs for mice

| Symbol | MUSG | MUST | MUSP |
|---|---|---|---|
| Ghr | 055737 | 161180 | N/A |
| Ghr | 055737 | 159912 | N/A |
| Gipc2 | 039131 | 152283 | N/A |
| Gipc2 | 039131 | 046614 | 037328 |
| Gipc2 | 039131 | 128741 | N/A |
| Gipc2 | 039131 | 130196 | N/A |
| Gipc2 | 039131 | 152680 | N/A |
| Gipc2 | 039131 | 200501 | N/A |
| Gipc2 | 039131 | 133672 | N/A |
| Gipc2 | 039131 | 197813 | N/A |
| Gipc2 | 039131 | 133102 | N/A |
| Gipr | 030406 | 094790 | 092384 |
| Gipr | 030406 | 206857 | N/A |
| Gipr | 030406 | 206971 | 145860 |
| Gipr | 030406 | 206137 | N/A |
| Gja1 | 050953 | 068581 | 064536 |
| Gja1 | 050953 | 218760 | N/A |
| Gja1 | 050953 | 217789 | 151596 |
| Gja1 | 050953 | 220204 | N/A |
| Gja1 | 050953 | 220194 | 151603 |
| Gja1 | 050953 | 218834 | 151647 |
| Gja1 | 050953 | 218444 | 151974 |
| Gja1 | 050953 | 220069 | 151620 |
| Gjb1 | 047797 | 119080 | 113904 |
| Gjb1 | 047797 | 052130 | 062723 |
| Gjb1 | 047797 | 119190 | 113516 |
| Gjb6 | 040055 | 039380 | 035630 |
| Gjb6 | 040055 | 224544 | N/A |
| Gjb6 | 040055 | 160703 | 124927 |
| Gjb6 | 040055 | 162931 | N/A |
| Gjc2 | 043448 | 108793 | 104421 |
| Gjc2 | 043448 | 108790 | 104418 |
| Gjc3 | 056966 | 077119 | 076367 |
| Gjc3 | 056966 | 199083 | N/A |
| Gjd2 | 068615 | 090275 | 087742 |
| Slc1a3 | 005360 | 005493 | 005493 |
| Slc1a3 | 005360 | 125997 | N/A |
| Slc1a3 | 005360 | 128879 | N/A |
| Slc1a3 | 005360 | 153455 | N/A |
| Slc1a3 | 005360 | 157065 | 118902 |
| Slc1a3 | 005360 | 129325 | N/A |
| Slc1a3 | 005360 | 133309 | N/A |
| Slc1a3 | 005360 | 126747 | N/A |
| Slc1a3 | 005360 | 005493 | 005493 |
| Slc1a3 | 005360 | 125997 | N/A |
| Slc1a3 | 005360 | 128879 | N/A |
| Slc1a3 | 005360 | 153455 | N/A |
| Slc1a3 | 005360 | 157065 | 118902 |
| Slc1a3 | 005360 | 129325 | N/A |
| Slc1a3 | 005360 | 133309 | N/A |
| Slc1a3 | 005360 | 126747 | N/A |
| Gldc | 024827 | 025778 | 025778 |
| Gldn | 046167 | 056740 | 056080 |
| Gli1 | 025407 | 026474 | 026474 |
| Gli1 | 025407 | 219808 | N/A |
| Gli1 | 025407 | 218236 | 151718 |
| Gli1 | 025407 | 219671 | 151749 |
| Gli1 | 025407 | 218451 | N/A |
| Gli2 | 048402 | 062483 | 054837 |
| Gli2 | 048402 | 161301 | 125342 |
| Gli2 | 048402 | 162552 | 125059 |
| Gli2 | 048402 | 161056 | 124768 |
| Gli2 | 048402 | 160991 | 125634 |
| Gli2 | 048402 | 159839 | 125661 |
| Gli2 | 048402 | 161451 | 124132 |
| Gli2 | 048402 | 162607 | 123808 |
| Gli2 | 048402 | 159678 | N/A |
| Gli3 | 021318 | 130065 | 115989 |
| Gli3 | 021318 | 141194 | 152092 |
| Gli3 | 021318 | 130535 | N/A |
| Gli3 | 021318 | 110510 | 106137 |
| Glipr2 | 028480 | 030202 | 030202 |
| Glipr2 | 028480 | 107855 | 103487 |
| Glis1 | 034762 | 046005 | 035650 |
| Glis1 | 034762 | 106738 | 102349 |
| Glis1 | 034762 | 130573 | N/A |

TABLE 2-continued

| ENSEMBL IDs for mice | | | |
| --- | --- | --- | --- |
| Symbol | MUSG | MUST | MUSP |
| Glis1 | 034762 | 135835 | 118600 |
| Glis1 | 034762 | 138211 | N/A |
| Glis1 | 034762 | 125573 | N/A |
| Glp2r | 049928 | 021289 | 021289 |
| Glp2r | 049928 | 051765 | 061560 |
| Glul | 026473 | 086199 | 083375 |
| Glul | 026473 | 139476 | 114377 |
| Glul | 026473 | 140685 | 123157 |
| Glul | 026473 | 153134 | N/A |
| Glul | 026473 | 154576 | N/A |
| Gm11549 | 085007 | 124606 | 153318 |
| Gm136 | 071015 | 095129 | 092748 |
| Gm20425 | 090639 | 166836 | 127808 |
| Gm266 | 010529 | 010673 | 010673 |
| Gm5083 | 089815 | 163056 | N/A |
| Gm5083 | 089815 | 159595 | N/A |
| Gm5089 | 064052 | 081580 | 080290 |
| Gm5468 | 056089 | 227851 | N/A |
| Gm5468 | 056089 | 069992 | N/A |
| Sox1ot | 047935 | 186174 | N/A |
| Sox1ot | 047935 | 080795 | N/A |
| Gm8179 | N/A | N/A | N/A |
| Gna12 | 000149 | 000153 | 000153 |
| Gna12 | 000149 | 198447 | 143414 |
| Gnal | 024524 | 025402 | 025402 |
| Gnal | 024524 | 076605 | 075908 |
| Gnb3 | 023439 | 024206 | 024206 |
| Gnb3 | 023439 | 129251 | N/A |
| Gnb3 | 023439 | 140233 | N/A |
| Gnb3 | 023439 | 135996 | N/A |
| Gng11 | 032766 | 031670 | 031670 |
| Gng13 | 025739 | 172002 | 131648 |
| Gng13 | 025739 | 115108 | 110760 |
| Gng2 | 043004 | 161247 | 124725 |
| Gng2 | 043004 | 162425 | 124153 |
| Gng2 | 043004 | 159028 | 125141 |
| Gng2 | 043004 | 159073 | 125000 |
| Gng2 | 043004 | 160013 | 125697 |
| Gng2 | 043004 | 055100 | 055256 |
| Gpc6 | 058571 | 123239 | N/A |
| Gpc6 | 058571 | 088483 | 085835 |
| Gpc6 | 058571 | 125435 | 120362 |
| Gpc6 | 058571 | 078849 | 077893 |
| Gpcpd1 | 027346 | 127712 | N/A |
| Gpcpd1 | 027346 | 148833 | 116156 |
| Gpcpd1 | 027346 | 110136 | 105763 |
| Gpcpd1 | 027346 | 060955 | 062221 |
| Gpcpd1 | 027346 | 149854 | 116949 |
| Gpcpd1 | 027346 | 145694 | 116457 |
| Gpcpd1 | 027346 | 028822 | 028822 |
| Gpcpd1 | 027346 | 124632 | 117217 |
| Gpcpd1 | 027346 | 124107 | 122751 |
| Gpcpd1 | 027346 | 110135 | 105762 |
| Gpcpd1 | 027346 | 140867 | N/A |
| Gpcpd1 | 027346 | 131617 | N/A |
| Gpcpd1 | 027346 | 110142 | 105769 |
| Gphn | 047454 | 052472 | 054064 |
| Gphn | 047454 | 110388 | 106018 |
| Gphn | 047454 | 219629 | N/A |
| Gpr135 | 043398 | 050649 | 058762 |
| Gpr153 | 042804 | 105650 | 101275 |
| Gpr153 | 042804 | 055754 | 052742 |
| Gpr153 | 042804 | 144035 | N/A |
| Gpr153 | 042804 | 105651 | 101276 |
| Gpr22 | 044067 | 057783 | 056125 |
| Gpr22 | 044067 | 176710 | 134839 |
| Gpr22 | 044067 | 174480 | 134674 |
| Gpr37 | 039904 | 200812 | 144683 |
| Gpr37 | 039904 | 054867 | 052185 |
| Gpr37l1 | 026424 | 027682 | 027682 |
| Gpr63 | 040372 | 151006 | N/A |
| Gpr63 | 040372 | 038920 | 039312 |
| Gprasp2 | 072966 | 134986 | N/A |
| Gprasp2 | 072966 | 113136 | 108761 |
| Gprasp2 | 072966 | 150797 | N/A |
| Gprasp2 | 072966 | 132798 | N/A |

TABLE 2-continued

| ENSEMBL IDs for mice | | | |
| --- | --- | --- | --- |
| Symbol | MUSG | MUST | MUSP |
| Gprasp2 | 072966 | 141953 | N/A |
| Gprasp2 | 072966 | 142034 | N/A |
| Gprasp2 | 072966 | 137392 | N/A |
| Gprasp2 | 072966 | 130034 | N/A |
| Gprasp2 | 072966 | 148658 | N/A |
| Gprasp2 | 072966 | 138251 | N/A |
| Gprasp2 | 072966 | 173804 | 134666 |
| Gprc5c | 051043 | 133245 | 121572 |
| Gprc5c | 051043 | 122967 | 114335 |
| Gprc5c | 051043 | 053361 | 061760 |
| Gprc5c | 051043 | 021071 | 021071 |
| Gprc5c | 051043 | 136785 | 116786 |
| Gprc5c | 051043 | 142262 | 121524 |
| Gprc5c | 051043 | 152314 | 118667 |
| Gprc5c | 051043 | 177952 | 136702 |
| Gpx2 | 042808 | 221421 | N/A |
| Gpx2 | 042808 | 220569 | N/A |
| Gpx2 | 042808 | 082431 | 081012 |
| Gramd3 | 001700 | 070166 | 068453 |
| Grb14 | 026888 | 134020 | N/A |
| Grb14 | 026888 | 149193 | 118115 |
| Grb14 | 026888 | 150643 | 121571 |
| Grb14 | 026888 | 028252 | 028252 |
| Grb14 | 026888 | 137085 | N/A |
| Grb14 | 026888 | 156765 | 121001 |
| Grb14 | 026888 | 145603 | N/A |
| Grb14 | 026888 | 146807 | N/A |
| Greb1l | 042942 | 173356 | N/A |
| Greb1l | 042942 | 048977 | 049003 |
| Greb1l | 042942 | 172532 | 134090 |
| Greb1l | 042942 | 224958 | N/A |
| Greb1l | 042942 | 174553 | N/A |
| Greb1l | 042942 | 172680 | 134314 |
| Greb1l | 042942 | 173261 | N/A |
| Grhl1 | 020656 | 085553 | 082689 |
| Grhl1 | 020656 | 221426 | N/A |
| Grhl1 | 020656 | 223442 | N/A |
| Grhl1 | 020656 | 020985 | 020985 |
| Gria1 | 020524 | 125292 | 133439 |
| Gria1 | 020524 | 036315 | 044494 |
| Gria1 | 020524 | 094179 | 091731 |
| Gria1 | 020524 | 151045 | 117746 |
| Gria1 | 020524 | 173531 | N/A |
| Gria3 | 001986 | 128197 | N/A |
| Gria3 | 001986 | 115103 | 110755 |
| Gria3 | 001986 | 076349 | 075687 |
| Gria3 | 001986 | 156721 | N/A |
| Gria3 | 001986 | 139965 | 116381 |
| Gria3 | 001986 | 148212 | N/A |
| Gria3 | 001986 | 124169 | 117766 |
| Gria3 | 001986 | 126843 | N/A |
| Gria3 | 001986 | 165288 | 131523 |
| Grid1 | 041078 | 043349 | 044009 |
| Grid1 | 041078 | 227253 | N/A |
| Grid1 | 041078 | 173307 | N/A |
| Grid2 | 071424 | 159319 | N/A |
| Grid2 | 071424 | 159561 | N/A |
| Grid2 | 071424 | 095852 | 093536 |
| Grid2 | 071424 | 160408 | N/A |
| Grid2 | 071424 | 161105 | N/A |
| Grid2 | 071424 | 162968 | N/A |
| Grid2 | 071424 | 210324 | 147707 |
| Grid2ip | 010825 | 110733 | 106361 |
| Grid2ip | 010825 | 010969 | 010969 |
| Grid2ip | 010825 | 120825 | 113443 |
| Grid2ip | 010825 | 196148 | N/A |
| Grid2ip | 010825 | 138948 | N/A |
| Grik1 | 022935 | 228188 | 154130 |
| Grik1 | 022935 | 023652 | 023652 |
| Grik1 | 022935 | 072256 | 072107 |
| Grik1 | 022935 | 227986 | 153786 |
| Grik1 | 022935 | 228034 | 154596 |
| Grik1 | 022935 | 211444 | 147948 |
| Grik1 | 022935 | 210700 | N/A |
| Grik1 | 022935 | 211635 | N/A |
| Grik1 | 022935 | 226447 | N/A |

TABLE 2-continued

ENSEMBL IDs for mice

| Symbol | MUSG | MUST | MUSP |
|---|---|---|---|
| Grik1 | 022935 | 210910 | N/A |
| Grik1 | 022935 | 114137 | 109773 |
| Grik2 | 056073 | 218823 | 151921 |
| Grik2 | 056073 | 217673 | N/A |
| Grik2 | 056073 | 218598 | 151389 |
| Grik2 | 056073 | 219509 | 151982 |
| Grik2 | 056073 | 218441 | 151671 |
| Grik2 | 056073 | 220330 | N/A |
| Grik2 | 056073 | 219051 | N/A |
| Grik2 | 056073 | 218669 | 152029 |
| Grik2 | 056073 | 220263 | 151372 |
| Grik2 | 056073 | 079751 | 078687 |
| Grik2 | 056073 | 105484 | 101124 |
| Grik3 | 001985 | 030676 | 030676 |
| Grin2a | 059003 | 199708 | 142900 |
| Grin2a | 059003 | 115835 | 111501 |
| Grin2a | 059003 | 199267 | N/A |
| Grin2a | 059003 | 156482 | N/A |
| Grin2a | 059003 | 197242 | N/A |
| Grin2a | 059003 | 032331 | 032331 |
| Grin2b | 030209 | 053880 | 062284 |
| Grin2b | 030209 | 152012 | 142696 |
| Grin2b | 030209 | 188999 | 140452 |
| Grin2b | 030209 | 143943 | 140710 |
| Grin2b | 030209 | 125905 | 139706 |
| Grin2b | 030209 | 198283 | N/A |
| Grin2b | 030209 | 111905 | 107536 |
| Grin2c | 020734 | 003351 | 003351 |
| Grin2c | 020734 | 106554 | 102164 |
| Grin2d | 002771 | 002848 | 002848 |
| Grin2d | 002771 | 211713 | 147663 |
| Grin2d | 002771 | 211250 | 147506 |
| Grip1 | 034813 | 077871 | 077033 |
| Grip1 | 034813 | 041962 | 042436 |
| Grip1 | 034813 | 147356 | 115478 |
| Grip1 | 034813 | 105262 | 100897 |
| Grip1 | 034813 | 147454 | 118073 |
| Grip1 | 034813 | 147598 | N/A |
| Grip1 | 034813 | 138410 | 123234 |
| Grip1 | 034813 | 144825 | 121670 |
| Grip1 | 034813 | 148954 | 118397 |
| Grip1 | 034813 | 144959 | 122323 |
| Grip1 | 034813 | 139352 | N/A |
| Grip1 | 034813 | 127787 | N/A |
| Grip1 | 034813 | 130387 | 123288 |
| Grip1 | 034813 | 105261 | 100896 |
| Grip1 | 034813 | 154238 | 122349 |
| Grip1 | 034813 | 081260 | 080016 |
| Grk4 | 052783 | 074651 | 074223 |
| Grk4 | 052783 | 001112 | 001112 |
| Grk4 | 052783 | 148588 | 122826 |
| Grk4 | 052783 | 153323 | N/A |
| Grk4 | 052783 | 134217 | N/A |
| Grm1 | 019828 | 105561 | 101190 |
| Grm1 | 019828 | 044306 | 037255 |
| Grm1 | 019828 | 135120 | N/A |
| Grm1 | 019828 | 155772 | N/A |
| Grm1 | 019828 | 156826 | N/A |
| Grm1 | 019828 | 105560 | 101189 |
| Grm5 | 049583 | 208791 | N/A |
| Grm5 | 049583 | 208878 | N/A |
| Grm5 | 049583 | 125009 | 118393 |
| Grm5 | 049583 | 208776 | N/A |
| Grm5 | 049583 | 155358 | 114927 |
| Grm5 | 049583 | 138732 | N/A |
| Grm5 | 049583 | 107263 | 102884 |
| Grm7 | 056755 | 174018 | 134635 |
| Grm7 | 056755 | 071076 | 064404 |
| Grm7 | 056755 | 172951 | 133957 |
| Grm7 | 056755 | 173001 | 134233 |
| Grm7 | 056755 | 174310 | 133897 |
| Grm8 | 024211 | 115323 | 110978 |
| Grm8 | 024211 | 090512 | 087998 |
| Grm8 | 024211 | 131897 | 120394 |
| Grm8 | 024211 | 146727 | N/A |
| Grm8 | 024211 | 132755 | 118098 |
| Grm8 | 024211 | 202861 | N/A |
| Grm8 | 024211 | 115324 | 110979 |
| Gsap | 039934 | 197522 | N/A |
| Gsap | 039934 | 198014 | 143739 |
| Gsap | 039934 | 036031 | 043679 |
| Gsap | 039934 | 197404 | N/A |
| Gsap | 039934 | 198071 | 142407 |
| Gsap | 039934 | 195969 | 142560 |
| Gsap | 039934 | 198937 | 142986 |
| Gsap | 039934 | 196035 | N/A |
| Gsap | 039934 | 198930 | 142596 |
| Gsap | 039934 | 199553 | N/A |
| Gsn | 026879 | 201185 | 144561 |
| Gsn | 026879 | 202990 | 144296 |
| Gsn | 026879 | 202899 | 144470 |
| Gsn | 026879 | 142324 | 118120 |
| Gsn | 026879 | 139867 | 144217 |
| Gsn | 026879 | 028239 | 028239 |
| Gsn | 026879 | 124323 | N/A |
| Gstm1 | 058135 | 004140 | 004140 |
| Gstm1 | 058135 | 198532 | N/A |
| Gstm1 | 058135 | 153314 | 123481 |
| Gstm1 | 058135 | 126593 | 118874 |
| Gsx1 | 053129 | 065382 | 069728 |
| Gtf2a1l | 024154 | 024970 | 024970 |
| Gtf2a1l | 024154 | 161481 | 124286 |
| Gucy1a3 | 033910 | 193924 | 142138 |
| Gucy1a3 | 033910 | 048976 | 048918 |
| Gucy1a3 | 033910 | 192289 | 141478 |
| Gucy1a3 | 033910 | 191942 | N/A |
| Gucy1a3 | 033910 | 194788 | N/A |
| N/A | N/A | N/A | N/A |
| Hapln2 | 004894 | 160737 | N/A |
| Hapln2 | 004894 | 005014 | 005014 |
| Hapln2 | 004894 | 162352 | N/A |
| Hapln2 | 004894 | 160150 | 125271 |
| Has2 | 022367 | 050544 | 062212 |
| Hcn1 | 021730 | 207599 | N/A |
| Hcn1 | 021730 | 006991 | 006991 |
| Hcn2 | 020331 | 099513 | 097113 |
| Hcn2 | 020331 | 020581 | 020581 |
| Hdac8 | 067567 | 087916 | 085226 |
| Hdac8 | 067567 | 154872 | 138805 |
| Hdac8 | 067567 | 148481 | N/A |
| Hdac8 | 067567 | 137785 | N/A |
| Hdac8 | 067567 | 154024 | N/A |
| Hebp1 | 042770 | 045855 | 042232 |
| Hebp1 | 042770 | 204000 | N/A |
| Hebp1 | 042770 | 204730 | N/A |
| Hebp1 | 042770 | 205232 | N/A |
| Heg1 | 075254 | 152832 | N/A |
| Heg1 | 075254 | 152782 | 123686 |
| Heg1 | 075254 | 132797 | N/A |
| Heg1 | 075254 | 128105 | N/A |
| Heg1 | 075254 | 146518 | N/A |
| Heg1 | 075254 | 126532 | 119790 |
| Heg1 | 075254 | 154863 | N/A |
| Hepacam | 046240 | 051839 | 054105 |
| Hepacam | 046240 | 215951 | 150856 |
| Hes3 | 028946 | 094438 | 092006 |
| Hes3 | 028946 | 218045 | 151815 |
| Hhatl | 032523 | 035110 | 035110 |
| Hhatl | 032523 | 163981 | 131971 |
| Hhatl | 032523 | 214768 | 149486 |
| Hhatl | 032523 | 215910 | 149350 |
| Hhatl | 032523 | 215477 | 150866 |
| Hhatl | 032523 | 217652 | 150721 |
| Hif3a | 004328 | 108492 | 104132 |
| Hif3a | 004328 | 037762 | 048248 |
| Hif3a | 004328 | 139224 | 146258 |
| Hif3a | 004328 | 153833 | 117728 |
| Hip1 | 039959 | 060311 | 059033 |
| Hip1 | 039959 | 202643 | 144086 |
| Hip1 | 039959 | 201479 | N/A |
| Hip1 | 039959 | 200808 | 144429 |
| Hip1 | 039959 | 200898 | N/A |

TABLE 2-continued

ENSEMBL IDs for mice

| Symbol | MUSG | MUST | MUSP |
|---|---|---|---|
| Hip1 | 039959 | 212301 | 148842 |
| Hip1 | 039959 | 202236 | N/A |
| Hip1 | 039959 | 201998 | 144392 |
| Hip1 | 039959 | 202095 | N/A |
| Hip1 | 039959 | 202044 | N/A |
| Hip1r | 000915 | 000939 | 000939 |
| Hip1r | 000915 | 167879 | 127361 |
| Hip1r | 000915 | 166258 | 130766 |
| Hip1r | 000915 | 171407 | N/A |
| Hip1r | 000915 | 198664 | 143309 |
| Hip1r | 000915 | 167325 | N/A |
| Hip1r | 000915 | 166684 | N/A |
| Hk2 | 000628 | 000642 | 000642 |
| Hk2 | 000628 | 168725 | N/A |
| Hk2 | 000628 | 170833 | 125986 |
| Hk2 | 000628 | 169270 | 128572 |
| Hmgcll1 | 007908 | 008052 | 008052 |
| Hmgcll1 | 007908 | 183425 | 139094 |
| Hmgcll1 | 007908 | 183979 | 138914 |
| Hmgcll1 | 007908 | 121592 | N/A |
| Hmgcll1 | 007908 | 183505 | N/A |
| Hmgcll1 | 007908 | 126321 | N/A |
| Hmgcll1 | 007908 | 117981 | 114045 |
| Hmgn1 | 040681 | 050884 | 061012 |
| Hmgn1 | 040681 | 145713 | N/A |
| Hmgn1 | 040681 | 133885 | 122427 |
| Hmgn1 | 040681 | 142179 | N/A |
| Homer3 | 003573 | 087467 | 084735 |
| Homer3 | 003573 | 140212 | 117033 |
| Homer3 | 003573 | 155711 | N/A |
| Homer3 | 003573 | 003669 | 003669 |
| Homer3 | 003573 | 143528 | N/A |
| Homer3 | 003573 | 135692 | N/A |
| Homer3 | 003573 | 135368 | 137560 |
| Homer3 | 003573 | 110124 | 105751 |
| Hpcal4 | 046093 | 059667 | 051487 |
| Hpcal4 | 046093 | 106246 | 101853 |
| Hpcal4 | 046093 | 126995 | 122104 |
| Hpcal4 | 046093 | 136619 | N/A |
| Hpcal4 | 046093 | 152194 | 120066 |
| Hpse2 | 074852 | 099428 | 097026 |
| Hrh2 | 034987 | 038101 | 038170 |
| Hrh2 | 034987 | 209846 | 148117 |
| Hrh2 | 034987 | 211742 | 147413 |
| Hs3st1 | 051022 | 117944 | 113919 |
| Hs3st1 | 051022 | 053116 | 051055 |
| Hs3st1 | 051022 | 137142 | 114997 |
| Hs3st1 | 051022 | 152057 | 118060 |
| Hs3st2 | 046321 | 206880 | 146027 |
| Hs3st2 | 046321 | 084628 | 081678 |
| Hs3st4 | 078591 | 106437 | 102045 |
| Hs6st2 | 062184 | 088172 | 085497 |
| Hs6st2 | 062184 | 114871 | 110521 |
| Hs6st2 | 062184 | 142738 | N/A |
| Hs6st2 | 062184 | 140145 | N/A |
| Hs6st2 | 062184 | 142983 | N/A |
| Hsd17b11 | 029311 | 031251 | 031251 |
| Hsd17b11 | 029311 | 119025 | 113455 |
| Hspa1b | 090877 | 172753 | 133815 |
| Htr1b | 049511 | 183482 | 139389 |
| Htr1b | 049511 | 051005 | 050898 |
| Htr2a | 034997 | 036653 | 047774 |
| Htr2c | 041380 | 149260 | N/A |
| Htr2c | 041380 | 131999 | N/A |
| Htr2c | 041380 | 036303 | 043936 |
| Htr2c | 041380 | 096299 | 094021 |
| Htr2c | 041380 | 156697 | 138772 |
| Htr2c | 041380 | 134368 | N/A |
| Htr2c | 041380 | 112831 | 108450 |
| Htra1 | 006205 | 150717 | N/A |
| Htra1 | 006205 | 006367 | 006367 |
| Htra1 | 006205 | 153290 | N/A |
| Htra1 | 006205 | 140741 | N/A |
| Htra1 | 006205 | 150905 | N/A |
| Hunk | 053414 | 065856 | 068007 |
| Icam5 | 032174 | 019616 | 019616 |
| Icosl | 000732 | 105393 | 101032 |
| Icosl | 000732 | 217675 | N/A |
| Icosl | 000732 | 219038 | 151346 |
| Icosl | 000732 | 219633 | N/A |
| Id4 | 021379 | 021810 | 021810 |
| Ift43 | 007867 | 221194 | N/A |
| Ift43 | 007867 | 054565 | 061891 |
| Ift43 | 007867 | 222821 | 152079 |
| Ift43 | 007867 | 222905 | 152281 |
| Ift43 | 007867 | 223269 | N/A |
| Ift43 | 007867 | 221161 | N/A |
| Ift43 | 007867 | 220711 | N/A |
| Igdcc3 | 032394 | 034961 | 034961 |
| Igdcc3 | 032394 | 217371 | 149084 |
| Igdcc3 | 032394 | 217135 | N/A |
| Igdcc4 | 032816 | 213533 | 150272 |
| Igdcc4 | 032816 | 035499 | 045387 |
| Igdcc4 | 032816 | 216542 | N/A |
| Igdcc4 | 032816 | 213423 | N/A |
| Igdcc4 | 032816 | 214978 | N/A |
| Igdcc4 | 032816 | 077696 | 076878 |
| Igdcc4 | 032816 | 166273 | 132576 |
| Igfbp3 | 020427 | 020702 | 020702 |
| Igfbp3 | 020427 | 135887 | 131670 |
| Igfbp5 | 026185 | 027377 | 027377 |
| Igfbp5 | 026185 | 137339 | N/A |
| Igsf11 | 022790 | 210186 | N/A |
| Igsf11 | 022790 | 114706 | 110354 |
| Igsf11 | 022790 | 209958 | N/A |
| Igsf11 | 022790 | 023478 | 023478 |
| Igsf11 | 022790 | 210471 | N/A |
| Igsf3 | 042035 | 198995 | N/A |
| Igsf3 | 042035 | 043983 | 048900 |
| Igsf3 | 042035 | 195164 | 141823 |
| Il15 | 031712 | 209363 | 147848 |
| Il15 | 031712 | 209573 | 148256 |
| Il15 | 031712 | 034148 | 034148 |
| Il15 | 031712 | 211565 | 147319 |
| Il15 | 031712 | 209687 | N/A |
| Il15 | 031712 | 211722 | N/A |
| Il15 | 031712 | 210094 | 147312 |
| Il15 | 031712 | 211282 | N/A |
| Il15 | 031712 | 210885 | N/A |
| Il15 | 031712 | 210472 | N/A |
| Il16 | 001741 | 001792 | 001792 |
| Il16 | 001741 | 145610 | 146496 |
| Il16 | 001741 | 151047 | N/A |
| Il16 | 001741 | 153560 | 118516 |
| Il16 | 001741 | 131916 | 122022 |
| Il16 | 001741 | 156553 | 122813 |
| Il18 | 039217 | 213916 | 150305 |
| Il18 | 039217 | 214117 | 151002 |
| Il18 | 039217 | 180021 | 137193 |
| Il18 | 039217 | 059081 | 054591 |
| Il20rb | 044244 | 098458 | 096057 |
| Il20rb | 044244 | 136606 | N/A |
| Il20rb | 044244 | 136856 | N/A |
| Il20rb | 044244 | 125259 | N/A |
| Il20rb | 044244 | 152756 | N/A |
| Il20rb | 044244 | 122880 | N/A |
| Il22 | 074695 | 096691 | 094449 |
| Il33 | 024810 | 120388 | 113829 |
| Il33 | 024810 | 144528 | 122319 |
| Il33 | 024810 | 177518 | 135854 |
| Il33 | 024810 | 025724 | 025724 |
| Il33 | 024810 | 136850 | 135324 |
| Iltifb | 090461 | 163808 | 128415 |
| Iltifb | 090461 | 179123 | N/A |
| 5730559C18Rik | 041605 | 120339 | 113785 |
| 5730559C18Rik | 041605 | 150163 | 118074 |
| 5730559C18Rik | 041605 | 144464 | 115554 |
| 5730559C18Rik | 041605 | 194374 | N/A |
| 5730559C18Rik | 041605 | 153910 | 120263 |
| 5730559C18Rik | 041605 | 195177 | 141506 |
| Inhba | 041324 | 164993 | 132085 |
| Inhba | 041324 | 042603 | 047894 |

TABLE 2-continued

ENSEMBL IDs for mice

| Symbol | MUSG | MUST | MUSP |
|---|---|---|---|
| Inpp1 | 026102 | 027271 | 027271 |
| Inpp1 | 026102 | 177279 | 135225 |
| Inpp1 | 026102 | 159607 | N/A |
| Inpp1 | 026102 | 162576 | 124890 |
| Inpp1 | 026102 | 162351 | N/A |
| Inpp1 | 026102 | 159725 | 123977 |
| Inpp4b | 037940 | 172167 | N/A |
| Inpp4b | 037940 | 213285 | 150520 |
| Inpp4b | 037940 | 217122 | 150541 |
| Inpp4b | 037940 | 169387 | 130104 |
| Inpp4b | 037940 | 215332 | 148972 |
| Inpp4b | 037940 | 042529 | 044466 |
| Inpp4b | 037940 | 169116 | 131947 |
| Inpp4b | 037940 | 109852 | 105478 |
| Inpp4b | 037940 | 172031 | 131324 |
| Inpp4b | 037940 | 164870 | N/A |
| Inpp4b | 037940 | 216036 | N/A |
| Inpp4b | 037940 | 170160 | 132156 |
| Inpp4b | 037940 | 216387 | N/A |
| Inpp4b | 037940 | 109851 | 105477 |
| Inpp4b | 037940 | 165821 | N/A |
| Inpp5a | 025477 | 106098 | 101704 |
| Inpp5a | 025477 | 026550 | 026550 |
| Inpp5a | 025477 | 097975 | 095589 |
| Inpp5a | 025477 | 138183 | N/A |
| Inpp5a | 025477 | 131781 | N/A |
| Inpp5a | 025477 | 210320 | N/A |
| Inpp5a | 025477 | 152475 | N/A |
| Insc | 048782 | 161800 | 125061 |
| Insc | 048782 | 136645 | 119459 |
| Insc | 048782 | 139670 | N/A |
| Insc | 048782 | 117543 | 112682 |
| Insc | 048782 | 151464 | 117296 |
| Insc | 048782 | 136347 | N/A |
| Insc | 048782 | 150991 | N/A |
| Insc | 048782 | 206274 | 145636 |
| Insc | 048782 | 169913 | 129505 |
| Ipcef1 | 064065 | 086896 | 084110 |
| Ipcef1 | 064065 | 145156 | 114267 |
| Ipcef1 | 064065 | 151960 | 118510 |
| Ipcef1 | 064065 | 149708 | N/A |
| Ipcef1 | 064065 | 144622 | N/A |
| Ipcef1 | 064065 | 105617 | 101242 |
| Ipcef1 | 064065 | 154998 | N/A |
| Ipcef1 | 064065 | 078070 | 077215 |
| Ipcef1 | 064065 | 170680 | 128131 |
| Iqch | 037801 | 042322 | 047953 |
| Iqch | 037801 | 163982 | 126546 |
| Iqch | 037801 | 163624 | 128482 |
| Iqch | 037801 | 080527 | 079370 |
| Iqch | 037801 | 171243 | 131828 |
| Iqch | 037801 | 170960 | N/A |
| Iqgap1 | 030536 | 167377 | 128278 |
| Iqgap1 | 030536 | 205606 | 145991 |
| Iqgap1 | 030536 | 205383 | N/A |
| Iqgap1 | 030536 | 206149 | N/A |
| Iqgap1 | 030536 | 205824 | N/A |
| Iqgap1 | 030536 | 205813 | 145556 |
| Iqgap1 | 030536 | 205304 | 146126 |
| Iqgap1 | 030536 | 205540 | N/A |
| Iqsec1 | 034312 | 101153 | 098712 |
| Iqsec1 | 034312 | 204983 | N/A |
| Iqsec1 | 034312 | 212100 | 148669 |
| Iqsec1 | 034312 | 154198 | N/A |
| Iqsec1 | 034312 | 141434 | N/A |
| Iqsec1 | 034312 | 205068 | N/A |
| Iqsec1 | 034312 | 156834 | 118802 |
| Iqsec1 | 034312 | 133492 | N/A |
| Iqsec1 | 034312 | 146977 | N/A |
| Iqsec1 | 034312 | 101151 | 098710 |
| Irak2 | 060477 | 059286 | 055073 |
| Irak2 | 060477 | 089023 | 086417 |
| Irak2 | 060477 | 204091 | N/A |
| Irak2 | 060477 | 089022 | 086416 |
| Irak2 | 060477 | 204744 | 144848 |
| Irak2 | 060477 | 155554 | N/A |

TABLE 2-continued

ENSEMBL IDs for mice

| Symbol | MUSG | MUST | MUSP |
|---|---|---|---|
| Irak2 | 060477 | 113024 | N/A |
| Irak2 | 060477 | 203381 | N/A |
| Irak2 | 060477 | 143948 | N/A |
| Irx1 | 060969 | 077337 | 076562 |
| Irx1 | 060969 | 223379 | 152247 |
| Irx1 | 060969 | 223460 | 152128 |
| Irx2 | 001504 | 074372 | 073976 |
| Irx2 | 001504 | 169028 | N/A |
| Irx2 | 001504 | 167067 | 127963 |
| Irx2 | 001504 | 163393 | N/A |
| Irx2 | 001504 | 172353 | 126691 |
| Irx5 | 031737 | 210246 | 147339 |
| Irx5 | 031737 | 034184 | 034184 |
| Itga2 | 015533 | 056117 | 053891 |
| Itga2 | 015533 | 224204 | 153056 |
| Itga9 | 039115 | 044165 | 044227 |
| Itga9 | 039115 | 125021 | N/A |
| Itga9 | 039115 | 124360 | 122417 |
| Itga9 | 039115 | 149150 | 122408 |
| Itga9 | 039115 | 124422 | N/A |
| Itga9 | 039115 | 155437 | N/A |
| Itgav | 027087 | 028499 | 028499 |
| Itgav | 027087 | 125360 | N/A |
| Itgav | 027087 | 151463 | N/A |
| Itgav | 027087 | 148256 | N/A |
| Itgav | 027087 | 111740 | 107369 |
| Itgav | 027087 | 141725 | 122730 |
| Itgav | 027087 | 155521 | N/A |
| Itgav | 027087 | 125402 | 118016 |
| Itgav | 027087 | 131192 | 121295 |
| Itgb4 | 020758 | 021107 | 021107 |
| Itgb4 | 020758 | 068981 | 070811 |
| Itgb4 | 020758 | 106460 | 102068 |
| Itgb4 | 020758 | 106458 | 102066 |
| Itgb4 | 020758 | 151691 | N/A |
| Itgb4 | 020758 | 150129 | N/A |
| Itgb4 | 020758 | 127523 | N/A |
| Itgb4 | 020758 | 130286 | N/A |
| Itgb4 | 020758 | 169928 | 127604 |
| Itgb4 | 020758 | 106461 | 102069 |
| Itgb8 | 025321 | 026360 | 026360 |
| Itgb8 | 025321 | 137804 | N/A |
| Itgb8 | 025321 | 151023 | N/A |
| Itih3 | 006522 | 006697 | 006697 |
| Itih3 | 006522 | 227181 | N/A |
| Itih3 | 006522 | 227995 | 154659 |
| Itih3 | 006522 | 226547 | 154256 |
| Itih3 | 006522 | 226179 | N/A |
| Itih3 | 006522 | 228114 | 154720 |
| Itpka | 027296 | 028758 | 028758 |
| Itpkb | 038855 | 070181 | 069851 |
| Itpkb | 038855 | 195043 | N/A |
| Itpr1 | 030102 | 032192 | 032192 |
| Itpr1 | 030102 | 203615 | 144880 |
| Itpr1 | 030102 | 203995 | N/A |
| Itpr1 | 030102 | 203936 | 145526 |
| Itpr1 | 030102 | 212125 | 148284 |
| Itpr1 | 030102 | 205053 | N/A |
| Itpr1 | 030102 | 203262 | 145177 |
| Itpr1 | 030102 | 203638 | 145522 |
| Itpr1 | 030102 | 203687 | 145339 |
| Itpr1 | 030102 | 205048 | N/A |
| Itpr1 | 030102 | 203530 | N/A |
| Itpr1 | 030102 | 203288 | N/A |
| Itpr1 | 030102 | 205005 | N/A |
| Itpripl2 | 095115 | 178344 | 136409 |
| Jam2 | 053062 | 114195 | 109833 |
| Jam2 | 053062 | 098407 | 096007 |
| Jam2 | 053062 | 138054 | N/A |
| Jam3 | 031990 | 034472 | 034472 |
| Jam3 | 031990 | 215446 | N/A |
| Jam3 | 031990 | 213170 | N/A |
| Jam3 | 031990 | 167074 | N/A |
| Jam3 | 031990 | 213682 | N/A |
| Jazf1 | 063568 | 128282 | N/A |
| Jazf1 | 063568 | 136250 | N/A |

TABLE 2-continued

ENSEMBL IDs for mice

| Symbol | MUSG | MUST | MUSP |
|--------|------|------|------|
| Jazf1 | 063568 | 074541 | 074129 |
| Jkamp | 005078 | 117449 | 113744 |
| Jkamp | 005078 | 057257 | 061370 |
| Jkamp | 005078 | 125764 | 117251 |
| Jkamp | 005078 | 132371 | N/A |
| Jkamp | 005078 | 134041 | N/A |
| Jkamp | 005078 | 152381 | N/A |
| Jkamp | 005078 | 145752 | N/A |
| Jph1 | 042686 | 186024 | 140705 |
| Jph1 | 042686 | 038382 | 039072 |
| Kank1 | 032702 | 049400 | 042177 |
| Kank1 | 032702 | 146647 | 116660 |
| Kank1 | 032702 | 137260 | N/A |
| Kank1 | 032702 | 155788 | N/A |
| Kank4 | 035407 | 102790 | 099851 |
| Kank4 | 035407 | 137270 | N/A |
| Kcna1 | 047976 | 055168 | 055225 |
| Kcna1 | 047976 | 203094 | 144947 |
| Kcna1 | 047976 | 205171 | N/A |
| Kcna2 | 040724 | 197470 | 143798 |
| Kcna2 | 040724 | 038695 | 041702 |
| Kcna2 | 040724 | 196403 | 142873 |
| Kcnab2 | 028931 | 159840 | 124156 |
| Kcnab2 | 028931 | 160884 | 125058 |
| Kcnab2 | 028931 | 030768 | 030768 |
| Kcnab2 | 028931 | 159186 | 124588 |
| Kcnab2 | 028931 | 105648 | 101273 |
| Kcnab2 | 028931 | 159844 | N/A |
| Kcnab2 | 028931 | 161496 | N/A |
| Kcnab2 | 028931 | 161236 | 125270 |
| Kcnab2 | 028931 | 159435 | N/A |
| Kcnab2 | 028931 | 162200 | N/A |
| Kcnab2 | 028931 | 162165 | N/A |
| Kcnab2 | 028931 | 161844 | N/A |
| Kcnab2 | 028931 | 162518 | N/A |
| Kcnab2 | 028931 | 162017 | 123939 |
| Kcnab3 | 018470 | 018614 | 018614 |
| Kcnab3 | 018470 | 142328 | N/A |
| Kcnab3 | 018470 | 134561 | N/A |
| Kcnc1 | 058975 | 025202 | 025202 |
| Kcnc1 | 058975 | 160433 | 124938 |
| Kcnc1 | 058975 | 160234 | N/A |
| Kcnc2 | 035681 | 219301 | 151579 |
| Kcnc2 | 035681 | 092175 | 089814 |
| Kcnc2 | 035681 | 218445 | 151560 |
| Kcnc2 | 035681 | 219607 | 151870 |
| Kcnc2 | 035681 | 218827 | 151995 |
| Kcnc3 | 062785 | 209177 | 146535 |
| Kcnc3 | 062785 | 207493 | 146425 |
| Kcnc3 | 062785 | 208651 | 146988 |
| Kcnc3 | 062785 | 107907 | 103540 |
| Kcnc3 | 062785 | 107906 | 103539 |
| Kcnc3 | 062785 | 208412 | N/A |
| Kcnc3 | 062785 | 207497 | 146479 |
| Kcnf1 | 051726 | 170580 | 131480 |
| Kcnh1 | 058248 | 078470 | 077563 |
| Kcnh1 | 058248 | 110844 | 106468 |
| Kcnh1 | 058248 | 151152 | 141247 |
| Kcnh5 | 034402 | 042299 | 046864 |
| Kcnh7 | 059742 | 075052 | 074563 |
| Kcnh7 | 059742 | 112454 | 108073 |
| Kcnh7 | 059742 | 112452 | 108071 |
| Kcnh7 | 059742 | 131799 | N/A |
| Kcnh8 | 035580 | 039366 | 049206 |
| Kcnh8 | 035580 | 184279 | N/A |
| Kcnip1 | 053519 | 109340 | 104964 |
| Kcnip1 | 053519 | 065970 | 069063 |
| Kcnip1 | 053519 | 101368 | 098919 |
| Kcnip1 | 053519 | 135034 | N/A |
| Kcnip1 | 053519 | 154760 | N/A |
| Kcnip4 | 029088 | 166924 | 131276 |
| Kcnip4 | 029088 | 172363 | N/A |
| Kcnip4 | 029088 | 176978 | 134758 |
| Kcnip4 | 029088 | 087395 | 084656 |
| Kcnip4 | 029088 | 101215 | N/A |
| Kcnip4 | 029088 | 176191 | 135071 |

TABLE 2-continued

ENSEMBL IDs for mice

| Symbol | MUSG | MUST | MUSP |
|--------|------|------|------|
| Kcnip4 | 029088 | 175660 | 135799 |
| Kcnip4 | 029088 | 101214 | N/A |
| Kcnj10 | 044708 | 056136 | 054356 |
| Kcnj12 | 042529 | 089184 | 086588 |
| Kcnj12 | 042529 | 041944 | 041696 |
| Kcnj12 | 042529 | 108717 | 104357 |
| Kcnj16 | 051497 | 106636 | 102247 |
| Kcnj16 | 051497 | 106635 | 102246 |
| Kcnj16 | 051497 | 125692 | 119921 |
| Kcnj16 | 051497 | 150902 | 121758 |
| Kcnj16 | 051497 | 180023 | 136382 |
| Kcnj16 | 051497 | 178798 | 137414 |
| Kcnj3 | 026824 | 067101 | 063329 |
| Kcnj3 | 026824 | 112632 | 108251 |
| Kcnj3 | 026824 | 112633 | 108252 |
| Kcnj4 | 044216 | 057801 | 094075 |
| Kcnk10 | 033854 | 221240 | 152473 |
| Kcnk10 | 033854 | 110113 | 105740 |
| Kcnk10 | 033854 | 221305 | 152656 |
| Kcnk10 | 033854 | 221906 | N/A |
| Kcnk13 | 045404 | 160413 | 123916 |
| Kcnk13 | 045404 | 162221 | N/A |
| Kcnk13 | 045404 | 049788 | 051846 |
| Kcnk13 | 045404 | 177549 | 136882 |
| Kcnk3 | 049265 | 066295 | 098987 |
| Kcnk3 | 049265 | 197428 | N/A |
| Kcnma1 | 063142 | 145596 | 153247 |
| Kcnma1 | 063142 | 188285 | 140275 |
| Kcnma1 | 063142 | 225431 | 153670 |
| Kcnma1 | 063142 | 188210 | 141069 |
| Kcnma1 | 063142 | 224787 | 152999 |
| Kcnma1 | 063142 | 224025 | 153078 |
| Kcnma1 | 063142 | 190044 | 140033 |
| Kcnma1 | 063142 | 225315 | 153584 |
| Kcnma1 | 063142 | 225794 | 153254 |
| Kcnma1 | 063142 | 225556 | 152959 |
| Kcnma1 | 063142 | 190985 | 140154 |
| Kcnma1 | 063142 | 223727 | 153158 |
| Kcnma1 | 063142 | 223655 | 153362 |
| Kcnma1 | 063142 | 224077 | 153214 |
| Kcnma1 | 063142 | 188991 | 140751 |
| Kcnma1 | 063142 | 224468 | 153312 |
| Kcnma1 | 063142 | 224812 | 153527 |
| Kcnma1 | 063142 | 224285 | 153316 |
| Kcnma1 | 063142 | 225471 | 153083 |
| Kcnma1 | 063142 | 224232 | 153291 |
| Kcnma1 | 063142 | 223749 | 153216 |
| Kcnma1 | 063142 | 212542 | N/A |
| Kcnma1 | 063142 | 226051 | 153356 |
| Kcnma1 | 063142 | 224933 | N/A |
| Kcnma1 | 063142 | 212576 | 148692 |
| Kcnma1 | 063142 | 223847 | N/A |
| Kcnma1 | 063142 | 225305 | N/A |
| Kcnma1 | 063142 | 224465 | N/A |
| Kcnma1 | 063142 | 190339 | 141143 |
| Kcnma1 | 063142 | 065788 | 065293 |
| Kcnma1 | 063142 | 100831 | 098393 |
| Kcnma1 | 063142 | 074983 | 074511 |
| Kcnma1 | 063142 | 112423 | 108042 |
| Kcnma1 | 063142 | 172099 | 132204 |
| Kcnma1 | 063142 | 177634 | 136447 |
| Kcnma1 | 063142 | 163322 | 128553 |
| Kcnma1 | 063142 | 179836 | 137141 |
| Kcnma1 | 063142 | 179097 | 136568 |
| Kcnn3 | 000794 | 000811 | 000811 |
| Kcnn3 | 000794 | 124584 | N/A |
| Kcnq5 | 028033 | 029667 | 029667 |
| Kcnq5 | 028033 | 115300 | 110955 |
| Kcnq5 | 028033 | 173058 | 134166 |
| Kcnq5 | 028033 | 174183 | 134389 |
| Kcnq5 | 028033 | 173404 | 134076 |
| Kcnq5 | 028033 | 115299 | N/A |
| Kcnq5 | 028033 | 134505 | N/A |
| Kcnt2 | 052726 | 120709 | 112887 |
| Kcnt2 | 052726 | 120796 | 113333 |
| Kcnt2 | 052726 | 119786 | 113535 |

TABLE 2-continued

ENSEMBL IDs for mice

| Symbol | MUSG | MUST | MUSP |
|---|---|---|---|
| Kcnt2 | 052726 | 192840 | N/A |
| Kcnt2 | 052726 | 145077 | N/A |
| Kcnt2 | 052726 | 193606 | 141947 |
| Kcnv1 | 022342 | 022967 | 022967 |
| Kcnv1 | 022342 | 228536 | N/A |
| Kctd12b | 041633 | 039424 | 037539 |
| Kctd12b | 041633 | 112572 | 108191 |
| Kctd13 | 030685 | 032924 | 032924 |
| Kctd13 | 030685 | 141369 | N/A |
| Kctd13 | 030685 | 139233 | N/A |
| Kctd3 | 026608 | 193143 | 141861 |
| Kctd3 | 026608 | 085678 | 082821 |
| Kctd3 | 026608 | 192200 | N/A |
| Kctd3 | 026608 | 195745 | N/A |
| Kctd3 | 026608 | 195658 | 141863 |
| Kctd3 | 026608 | 195488 | N/A |
| Kctd3 | 026608 | 192458 | N/A |
| Kctd3 | 026608 | 193590 | N/A |
| Kctd3 | 026608 | 195787 | N/A |
| Kctd3 | 026608 | 193273 | N/A |
| Kdm5d | 056673 | 189069 | 139636 |
| Kdm5d | 056673 | 055032 | 061095 |
| Kdm5d | 056673 | 188910 | N/A |
| Kdm5d | 056673 | 186696 | 140663 |
| Kdm5d | 056673 | 186726 | 140462 |
| Kdm5d | 056673 | 189626 | N/A |
| Kdm5d | 056673 | 185542 | N/A |
| Kdm5d | 056673 | 187296 | N/A |
| Kdm5d | 056673 | 189955 | N/A |
| Khdrbs3 | 022332 | 022954 | 022954 |
| 9530077C05Rik | 036411 | 058868 | 062120 |
| 9530077C05Rik | 036411 | 213598 | N/A |
| 9530077C05Rik | 036411 | 214436 | 149413 |
| 9530077C05Rik | 036411 | 213133 | N/A |
| 1810041L15Rik | 062760 | 080751 | 079575 |
| 1810041L15Rik | 062760 | 189248 | 141117 |
| 1810041L15Rik | 062760 | 189994 | 140712 |
| 1810041L15Rik | 062760 | 186527 | 140964 |
| Kif13a | 021375 | 056978 | 055304 |
| Kif13a | 021375 | 223881 | 153657 |
| Kif13a | 021375 | 225836 | 153536 |
| Kif13a | 021375 | 224756 | 153385 |
| Kif13a | 021375 | 225591 | 153614 |
| Kif13a | 021375 | 223856 | 152982 |
| Kif13a | 021375 | 225904 | N/A |
| Kif13a | 021375 | 224457 | N/A |
| Kif13a | 021375 | 224923 | N/A |
| Kif13b | 060012 | 224126 | 153252 |
| Kif13b | 060012 | 224507 | N/A |
| Kif13b | 060012 | 224503 | 153168 |
| Kif13b | 060012 | 224677 | N/A |
| Kif13b | 060012 | 100473 | 098041 |
| Kif19a | 010021 | 126555 | N/A |
| Kif19a | 010021 | 137326 | N/A |
| Kif19a | 010021 | 138804 | 115663 |
| Kif19a | 010021 | 084368 | 081398 |
| Kif19a | 010021 | 131782 | N/A |
| Kif19a | 010021 | 138340 | 122743 |
| Kif19a | 010021 | 134165 | N/A |
| Kif21b | 041642 | 075164 | 074661 |
| Kif21b | 041642 | 130864 | 114297 |
| Kif21b | 041642 | 122892 | N/A |
| Kif21b | 041642 | 171381 | 131815 |
| Kif21b | 041642 | 127624 | N/A |
| Kif21b | 041642 | 165333 | N/A |
| Kif26b | 026494 | 193931 | N/A |
| Kif26b | 026494 | 161017 | 124462 |
| Kif26b | 026494 | 160789 | 124608 |
| Kif6 | 023999 | 162854 | 124674 |
| Kif6 | 023999 | 159354 | N/A |
| Kif6 | 023999 | 162029 | 125227 |
| Kif6 | 023999 | 024798 | N/A |
| Kif6 | 023999 | 159396 | N/A |
| Kif6 | 023999 | 160049 | N/A |
| Kif6 | 023999 | 162419 | N/A |
| Kirrel | 041734 | 159976 | 125525 |
| Kirrel | 041734 | 041732 | 043756 |
| Kirrel | 041734 | 107618 | 103243 |
| Kit | 005672 | 144270 | 116465 |
| Kit | 005672 | 005815 | 005815 |
| Kit | 005672 | 143221 | N/A |
| Kit | 005672 | 151357 | N/A |
| Kit | 005672 | 136002 | N/A |
| Kit | 005672 | 148993 | N/A |
| Kit | 005672 | 202167 | N/A |
| Kit | 005672 | 201240 | N/A |
| Kitl | 019966 | 105283 | 100920 |
| Kitl | 019966 | 219050 | N/A |
| Kitl | 019966 | 130190 | 123360 |
| Kitl | 019966 | 218200 | 151554 |
| Kitl | 019966 | 020129 | 020129 |
| Kitl | 019966 | 219881 | N/A |
| Klhl13 | 036782 | 115313 | 110968 |
| Klhl13 | 036782 | 115319 | 110974 |
| Klhl13 | 036782 | 115316 | 110971 |
| Klhl13 | 036782 | 115317 | 110972 |
| Klhl13 | 036782 | 144360 | N/A |
| Klhl13 | 036782 | 153345 | N/A |
| Klhl13 | 036782 | 035973 | 041190 |
| Klhl5 | 054920 | 204097 | 144976 |
| Klhl5 | 054920 | 101191 | 098752 |
| Klhl5 | 054920 | 204348 | 144732 |
| Klhl5 | 054920 | 204829 | N/A |
| Klhl5 | 054920 | 204479 | N/A |
| Klhl5 | 054920 | 203561 | N/A |
| Klhl5 | 054920 | 203538 | 145269 |
| Klk6 | 050063 | 107968 | 103602 |
| Klk6 | 050063 | 107966 | 103600 |
| Klk6 | 050063 | 177514 | 135591 |
| Klk6 | 050063 | 107967 | 103601 |
| Kndc1 | 066129 | 154782 | N/A |
| Kndc1 | 066129 | 121839 | 113856 |
| Kndc1 | 066129 | 156941 | N/A |
| Kndc1 | 066129 | 210154 | N/A |
| Kndc1 | 066129 | 053445 | 050586 |
| Krt24 | 020913 | 017255 | 017255 |
| Ksr2 | 061578 | 073347 | N/A |
| Ksr2 | 061578 | 180430 | 137670 |
| L3hypdh | 019718 | 138029 | N/A |
| L3hypdh | 019718 | 124405 | N/A |
| L3hypdh | 019718 | 019862 | 019862 |
| L3mbtl2 | 022394 | 023029 | 023029 |
| L3mbtl2 | 022394 | 174229 | 133967 |
| L3mbtl2 | 022394 | 172620 | N/A |
| L3mbtl2 | 022394 | 172568 | N/A |
| L3mbtl2 | 022394 | 172748 | 134333 |
| L3mbtl2 | 022394 | 174274 | N/A |
| L3mbtl2 | 022394 | 173105 | N/A |
| L3mbtl2 | 022394 | 173607 | N/A |
| L3mbtl2 | 022394 | 174497 | 133549 |
| L3mbtl2 | 022394 | 174401 | N/A |
| L3mbtl2 | 022394 | 173761 | N/A |
| Lama1 | 032796 | 035471 | 043957 |
| Lama2 | 019899 | 186279 | N/A |
| Lama2 | 019899 | 092639 | 090304 |
| Lama2 | 019899 | 219763 | 151741 |
| Lama2 | 019899 | 189575 | 140716 |
| Lama2 | 019899 | 185839 | N/A |
| Lama2 | 019899 | 186965 | N/A |
| Lama2 | 019899 | 188963 | N/A |
| Lama2 | 019899 | 187535 | N/A |
| Lama4 | 019846 | 159506 | N/A |
| Lama4 | 019846 | 019992 | 019992 |
| Lama4 | 019846 | 162211 | N/A |
| Lama4 | 019846 | 161303 | N/A |
| Lama4 | 019846 | 159580 | N/A |
| Lama4 | 019846 | 161992 | N/A |
| Lama4 | 019846 | 163036 | N/A |
| Lamb1 | 002900 | 169088 | 132778 |
| Lamb1 | 002900 | 002979 | 002979 |
| Lamb1 | 002900 | 164228 | N/A |
| Lamb1 | 002900 | 170495 | 132001 |

TABLE 2-continued

| ENSEMBL IDs for mice | | | |
| --- | --- | --- | --- |
| Symbol | MUSG | MUST | MUSP |
| Lamb1 | 002900 | 169065 | N/A |
| Lamb1 | 002900 | 164009 | N/A |
| Lamb1 | 002900 | 172134 | N/A |
| Lamp5 | 027270 | 144403 | 120703 |
| Lamp5 | 027270 | 057503 | 061180 |
| Lamp5 | 027270 | 154674 | N/A |
| Lamp5 | 027270 | 143777 | N/A |
| Lamp5 | 027270 | 123436 | N/A |
| Laptm4b | 022257 | 022867 | 022867 |
| Laptm4b | 022257 | 226437 | 154241 |
| Laptm4b | 022257 | 226627 | 153935 |
| Laptm4b | 022257 | 228547 | 154118 |
| Lars2 | 035202 | 038863 | 036710 |
| Lars2 | 035202 | 215674 | N/A |
| Lars2 | 035202 | 214074 | N/A |
| Lars2 | 035202 | 217116 | 150083 |
| Lars2 | 035202 | 216843 | 150895 |
| Lars2 | 035202 | 215464 | 149082 |
| Lars2 | 035202 | 214557 | N/A |
| Lars2 | 035202 | 213711 | N/A |
| Lars2 | 035202 | 215087 | N/A |
| Lbh | 024063 | 024857 | 024857 |
| Lbh | 024063 | 148556 | 123062 |
| Lcat | 035237 | 038896 | 038232 |
| Lcorl | 015882 | 045586 | 042677 |
| Lcorl | 015882 | 190036 | 140503 |
| Lcorl | 015882 | 121573 | 112416 |
| Lcorl | 015882 | 199744 | N/A |
| Lcorl | 015882 | 200142 | N/A |
| Lcorl | 015882 | 087164 | 084408 |
| Lcorl | 015882 | 016026 | 016026 |
| Lcorl | 015882 | 189859 | 139996 |
| Lcorl | 015882 | 187615 | 139466 |
| Lcorl | 015882 | 067997 | N/A |
| Lcorl | 015882 | 156295 | N/A |
| Lcorl | 015882 | 186633 | 141174 |
| Ldah | 037669 | 037383 | 042285 |
| Ldah | 037669 | 218883 | 151802 |
| Ldah | 037669 | 218305 | 151881 |
| Ldah | 037669 | 219043 | 151289 |
| Ldah | 037669 | 218086 | 151612 |
| Ldah | 037669 | 169104 | 129424 |
| Ldah | 037669 | 220345 | 151631 |
| Ldah | 037669 | 217763 | N/A |
| Ldah | 037669 | 217999 | 151852 |
| Ldah | 037669 | 219357 | 151362 |
| Ldah | 037669 | 219058 | 151541 |
| Ldah | 037669 | 220274 | 151309 |
| Ldah | 037669 | 217872 | 151257 |
| Ldah | 037669 | 219532 | 151941 |
| Ldb2 | 039706 | 199534 | 142442 |
| Ldb2 | 039706 | 070748 | 067737 |
| Ldb2 | 039706 | 199256 | 143775 |
| Ldb2 | 039706 | 199261 | 143289 |
| Ldb2 | 039706 | 199471 | N/A |
| Ldb2 | 039706 | 198356 | N/A |
| Ldb2 | 039706 | 198894 | N/A |
| Leng9 | 043432 | 058358 | 061079 |
| Lfng | 029570 | 031555 | 031555 |
| Lfng | 029570 | 200626 | N/A |
| Lfng | 029570 | 199848 | N/A |
| Lgi4 | 036560 | 039775 | 041579 |
| Lgi4 | 036560 | 169785 | 145660 |
| Lgi4 | 036560 | 164725 | 146008 |
| Lgi4 | 036560 | 172001 | 125865 |
| Lgr5 | 020140 | 020350 | 020350 |
| Lgr5 | 020140 | 172806 | 133860 |
| Lgr5 | 020140 | 173740 | 133707 |
| Lgr5 | 020140 | 173619 | N/A |
| Lgr5 | 020140 | 144732 | N/A |
| Lgr5 | 020140 | 105272 | N/A |
| Lgr5 | 020140 | 149008 | N/A |
| Lgr5 | 020140 | 129309 | N/A |
| Lgr6 | 042793 | 044828 | 035444 |
| Lgr6 | 042793 | 137968 | 122334 |
| Lgr6 | 042793 | 139369 | N/A |

TABLE 2-continued

| ENSEMBL IDs for mice | | | |
| --- | --- | --- | --- |
| Symbol | MUSG | MUST | MUSP |
| Lhfp | 048332 | 059562 | 056364 |
| Lhfp | 048332 | 137954 | N/A |
| Lhfp | 048332 | 147139 | 119019 |
| Lhfp | 048332 | 196913 | N/A |
| Lhfpl2 | 045312 | 054274 | 062239 |
| Lhfpl2 | 045312 | 144838 | N/A |
| Lhfpl2 | 045312 | 156071 | 117113 |
| Lhfpl2 | 045312 | 221096 | 152453 |
| Lhfpl2 | 045312 | 223423 | 152241 |
| Lhfpl2 | 045312 | 120051 | 113786 |
| Lhfpl2 | 045312 | 118195 | 112655 |
| Lhfpl2 | 045312 | 131595 | N/A |
| Lhfpl2 | 045312 | 121618 | 113468 |
| Lhx1 | 018698 | 018842 | 018842 |
| Lhx1 | 018698 | 184646 | 138899 |
| Lhx1 | 018698 | 176503 | N/A |
| Lhx1 | 018698 | 092827 | 090503 |
| Lhx1os | 087211 | 134800 | N/A |
| Lhx1os | 087211 | 126072 | N/A |
| Lhx1os | 087211 | 128121 | N/A |
| Lhx5 | 029595 | 031591 | 031591 |
| Lims2 | 024395 | 025254 | 025254 |
| Lims2 | 024395 | 225404 | 153218 |
| Lims2 | 024395 | 225470 | N/A |
| Lims2 | 024395 | 224383 | 152960 |
| Lims2 | 024395 | 226112 | N/A |
| Lims2 | 024395 | 225400 | N/A |
| Lims2 | 024395 | 223753 | 153122 |
| Lims2 | 024395 | 225125 | N/A |
| Lims2 | 024395 | 224328 | 153433 |
| Lin28b | 063804 | 079390 | 078361 |
| Lin28b | 063804 | 215708 | N/A |
| Lin28b | 063804 | 214555 | N/A |
| Lin7a | 019906 | 020057 | 020057 |
| Lin7a | 019906 | 105280 | 100916 |
| Lin7a | 019906 | 218031 | 151715 |
| Gm28653 | 099906 | 227082 | N/A |
| Gm28653 | 099906 | 185494 | N/A |
| Lingo1 | 049556 | 210032 | 148179 |
| Lingo1 | 049556 | 114256 | 109894 |
| Lingo1 | 049556 | 114247 | 109885 |
| Lingo1 | 049556 | 209596 | N/A |
| Lingo1 | 049556 | 210332 | N/A |
| Lingo1 | 049556 | 209332 | N/A |
| Lingo1 | 049556 | 210995 | N/A |
| Lingo1 | 049556 | 053568 | 059050 |
| Lingo2 | 045083 | 065173 | 069772 |
| Lingo2 | 045083 | 098151 | 095754 |
| Lingo2 | 045083 | 108122 | 103757 |
| Lingo2 | 045083 | 124999 | N/A |
| Lingo2 | 045083 | 145615 | N/A |
| Lingo2 | 045083 | 127372 | N/A |
| Lingo2 | 045083 | 144170 | N/A |
| Lingo2 | 045083 | 125128 | N/A |
| Lingo2 | 045083 | 108124 | 103759 |
| Lingo2 | 045083 | 164772 | 130423 |
| Litaf | 022500 | 023143 | 023143 |
| Litaf | 022500 | 117360 | 112667 |
| Litaf | 022500 | 162323 | 123948 |
| Litaf | 022500 | 140170 | N/A |
| Lmcd1 | 057604 | 032376 | 032376 |
| Lmo2 | 032698 | 111143 | 106773 |
| Lmo2 | 032698 | 111140 | 106770 |
| Lmo2 | 032698 | 133210 | N/A |
| Lmo2 | 032698 | 111139 | 106769 |
| Lmo2 | 032698 | 123437 | 117703 |
| Lmo2 | 032698 | 138815 | 121927 |
| Lmo2 | 032698 | 156813 | 122369 |
| Lmo2 | 032698 | 170926 | 128317 |
| Lonrf2 | 048814 | 147695 | 117600 |
| Lonrf2 | 048814 | 191724 | N/A |
| Lonrf2 | 048814 | 039612 | 047372 |
| Lpcat2 | 033192 | 046290 | 049252 |
| Lpcat2 | 033192 | 210099 | 147941 |
| Lpcat2 | 033192 | 209265 | 148089 |
| Lpcat2 | 033192 | 130471 | N/A |

TABLE 2-continued

ENSEMBL IDs for mice

| Symbol | MUSG | MUST | MUSP |
|---|---|---|---|
| Lpcat2 | 033192 | 151106 | N/A |
| Lpp | 033306 | 115314 | 110969 |
| Lpp | 033306 | 078988 | 078005 |
| Lpp | 033306 | 038053 | 036304 |
| Lrch1 | 068015 | 088970 | 086363 |
| Lrch1 | 068015 | 228134 | N/A |
| Lrch1 | 068015 | 228252 | 154004 |
| Lrch1 | 068015 | 226799 | N/A |
| Lrch1 | 068015 | 227433 | N/A |
| Lrig1 | 030029 | 204645 | 144963 |
| Lrig1 | 030029 | 101126 | 098686 |
| Lrig1 | 030029 | 203876 | N/A |
| Lrig1 | 030029 | 141014 | N/A |
| Lrig1 | 030029 | 150811 | N/A |
| Lrig1 | 030029 | 124165 | N/A |
| Lrig1 | 030029 | 032105 | 032105 |
| Lrp1 | 040249 | 049149 | 044004 |
| Lrp1 | 040249 | 125480 | N/A |
| Lrp1 | 040249 | 121829 | 113584 |
| Lrp1 | 040249 | 133620 | 115305 |
| Lrp1 | 040249 | 129877 | N/A |
| Lrp1 | 040249 | 129727 | 120567 |
| Lrp1 | 040249 | 145947 | N/A |
| Lrp1 | 040249 | 140269 | N/A |
| Lrp1 | 040249 | 135188 | N/A |
| Lrp1 | 040249 | 118455 | 113497 |
| Lrp1b | 049252 | 129974 | N/A |
| Lrp1b | 049252 | 052550 | 054275 |
| Lrp1b | 049252 | 142546 | 117212 |
| Lrp1b | 049252 | 203015 | 145066 |
| Lrp1b | 049252 | 134032 | N/A |
| Lrp1b | 049252 | 203080 | 145278 |
| Lrp1b | 049252 | 138700 | N/A |
| Lrp1b | 049252 | 204204 | 145045 |
| Lrp1b | 049252 | 133104 | N/A |
| Lrp1b | 049252 | 142688 | 144957 |
| Lrp1b | 049252 | 185258 | 139874 |
| Lrp1b | 049252 | 167270 | 129192 |
| Lrrc2 | 032495 | 035076 | 035076 |
| Lrrc2 | 032495 | 196834 | 142360 |
| Lrrc2 | 032495 | 196598 | 143319 |
| Lrrc20 | 037151 | 049242 | 048042 |
| Lrrc38 | 028584 | 052458 | 053597 |
| Lrrc38 | 097351 | 181564 | 137856 |
| Lrrc3b | 045201 | 055211 | 059463 |
| Lrrc3b | 045201 | 223700 | 153616 |
| Lrrc3b | 045201 | 163937 | 128624 |
| Lrrc4c | 050587 | 135431 | 130984 |
| Lrrc4c | 050587 | 162807 | 125218 |
| Lrrc4c | 050587 | 059049 | 131795 |
| Lrrc4c | 050587 | 170144 | 128490 |
| Lrrc7 | 028176 | 200196 | 143365 |
| Lrrc7 | 028176 | 200137 | 142498 |
| Lrrc7 | 028176 | 199890 | 142440 |
| Lrrc7 | 028176 | 197866 | N/A |
| Lrrc7 | 028176 | 198284 | N/A |
| Lrrc7 | 028176 | 106044 | 101659 |
| Lrrk2 | 036273 | 060642 | 052584 |
| Lrrk2 | 036273 | 140734 | N/A |
| Lrrk2 | 036273 | 156900 | N/A |
| Lrrk2 | 036273 | 133743 | N/A |
| Lrrk2 | 036273 | 137657 | N/A |
| Lrrk2 | 036273 | 172797 | N/A |
| Lrrtm4 | 052581 | 147663 | 117263 |
| Lrrtm4 | 052581 | 128718 | 114425 |
| Lrrtm4 | 052581 | 126005 | 117445 |
| Lrrtm4 | 052581 | 133918 | 115016 |
| Lrrtm4 | 052581 | 126399 | 121124 |
| Lrrtm4 | 052581 | 136421 | 121621 |
| Lrrtm4 | 052581 | 145407 | 114465 |
| Lrrtm4 | 052581 | 074662 | 074232 |
| Lrtm1 | 045776 | 055662 | 061828 |
| Lrtm1 | 045776 | 224760 | 153372 |
| Lrtm1 | 045776 | 224708 | 153518 |
| Ltbp2 | 002020 | 002073 | 002073 |
| Ltbp2 | 002020 | 163189 | 127693 |

TABLE 2-continued

ENSEMBL IDs for mice

| Symbol | MUSG | MUST | MUSP |
|---|---|---|---|
| Ltbp2 | 002020 | 166383 | 127255 |
| Ltbp2 | 002020 | 163214 | 132067 |
| Ltbp2 | 002020 | 165141 | 132690 |
| Ltbp2 | 002020 | 168699 | N/A |
| Ltbp2 | 002020 | 110254 | 105883 |
| Lurap1 | 028701 | 030469 | 030469 |
| Lurap1 | 028701 | 135982 | N/A |
| Lurap1l | 048706 | 055922 | 062628 |
| Ly6e | 022587 | 188866 | 140145 |
| Ly6e | 022587 | 187606 | 139471 |
| Ly6e | 022587 | 189186 | 139477 |
| Ly6e | 022587 | 187284 | 140553 |
| Ly6e | 022587 | 190810 | 139482 |
| Ly6e | 022587 | 185861 | 141145 |
| Ly6e | 022587 | 185863 | 140060 |
| Ly6e | 022587 | 191127 | 139966 |
| Ly6e | 022587 | 191436 | 139549 |
| Ly6e | 022587 | 186927 | N/A |
| Ly6e | 022587 | 188503 | N/A |
| Ly6e | 022587 | 191145 | 140829 |
| Ly6e | 022587 | 191439 | N/A |
| Ly6e | 022587 | 188042 | 141059 |
| Ly6e | 022587 | 051698 | 056703 |
| Ly6e | 022587 | 169343 | 132081 |
| Lypd1 | 026344 | 159417 | 125149 |
| Lypd1 | 026344 | 162899 | 125158 |
| Lypd1 | 026344 | 027582 | 027582 |
| Lypd1 | 026344 | 159529 | 123824 |
| Lypd1 | 026344 | 161361 | 124265 |
| Lypd6 | 050447 | 053208 | 061578 |
| Lypd6 | 050447 | 128451 | 116803 |
| Lypd6 | 050447 | 126337 | 119755 |
| Lypd6 | 050447 | 112712 | 108332 |
| Lypd6 | 050447 | 169232 | 131002 |
| Lypd6b | 026765 | 028103 | 028103 |
| Lypd6b | 026765 | 153422 | N/A |
| Lypd6b | 026765 | 129867 | N/A |
| Lyzl4 | 032530 | 077706 | 076887 |
| Lyzl4 | 032530 | 120918 | 113034 |
| Lyzl4 | 032530 | 213757 | 151031 |
| Lyzl4 | 032530 | 125075 | 115284 |
| Lyzl4 | 032530 | 214592 | 150807 |
| Mag | 036634 | 187137 | 139564 |
| Mag | 036634 | 191081 | 139881 |
| Mag | 036634 | 188569 | 140526 |
| Mag | 036634 | 186422 | N/A |
| Mag | 036634 | 190638 | 140578 |
| Mag | 036634 | 190950 | 139861 |
| Mag | 036634 | 191486 | N/A |
| Mag | 036634 | 040548 | 041464 |
| Magi3 | 052539 | 064371 | 067932 |
| Magi3 | 052539 | 121198 | 112934 |
| Magi3 | 052539 | 122303 | 113713 |
| Magi3 | 052539 | 199201 | N/A |
| Mak | 021363 | 225084 | 152946 |
| Mak | 021363 | 225789 | N/A |
| Mak | 021363 | 070193 | 064750 |
| Mak | 021363 | 224740 | 153314 |
| Mak | 021363 | 225906 | 153176 |
| Mak | 021363 | 224423 | 152961 |
| Mak | 021363 | 165087 | 129615 |
| Mak | 021363 | 021792 | 021792 |
| Mal | 027375 | 028854 | 028854 |
| Mal | 027375 | 028853 | 028853 |
| Mal2 | 024479 | 025356 | 025356 |
| Man1a | 003746 | 003843 | 003843 |
| Man1a | 003746 | 105470 | 101110 |
| Man1a | 003746 | 218317 | 151328 |
| Man1a | 003746 | 220088 | 151568 |
| Man1a | 003746 | 219234 | N/A |
| Man1a | 003746 | 146483 | N/A |
| Man1a | 003746 | 105469 | N/A |
| Man1a | 003746 | 133330 | N/A |
| Man1c1 | 037306 | 054096 | 050979 |
| Man1c1 | 037306 | 176606 | N/A |
| Man1c1 | 037306 | 038628 | 037949 |

TABLE 2-continued

| ENSEMBL IDs for mice | | | |
| --- | --- | --- | --- |
| Symbol | MUSG | MUST | MUSP |
| Man2a1 | 024085 | 086723 | 083928 |
| Man2a1 | 024085 | 169239 | N/A |
| Man2a1 | 024085 | 169668 | 130529 |
| Map2k6 | 020623 | 020949 | 020949 |
| Map2k6 | 020623 | 146084 | N/A |
| Map2k6 | 020623 | 100260 | 097831 |
| Map2k6 | 020623 | 133920 | N/A |
| Map2k6 | 020623 | 146540 | N/A |
| Map6d1 | 041205 | 040880 | 043332 |
| Map7 | 019996 | 020173 | 020173 |
| Map7 | 019996 | 116259 | 111963 |
| Map7 | 019996 | 214231 | 149367 |
| Map7 | 019996 | 214823 | N/A |
| Map7 | 019996 | 216909 | N/A |
| Map7 | 019996 | 217251 | N/A |
| Map7 | 019996 | 215924 | 150818 |
| Map7 | 019996 | 216065 | N/A |
| Map7 | 019996 | 213386 | N/A |
| Map7 | 019996 | 213312 | 151101 |
| Map7 | 019996 | 215812 | N/A |
| Map7 | 019996 | 216474 | N/A |
| Map7 | 019996 | 216308 | N/A |
| Mapk12 | 022610 | 088827 | 086207 |
| Mapk4 | 024558 | 159162 | 123922 |
| Mapk4 | 024558 | 091851 | 089462 |
| Mapk4 | 024558 | 162863 | 124408 |
| Mapk4 | 024558 | 160601 | N/A |
| March11 | 022269 | 126304 | 153852 |
| March11 | 022269 | 140840 | 118729 |
| March11 | 022269 | 152841 | 120622 |
| March11 | 022269 | 155819 | N/A |
| Marcks | 069662 | 092584 | 090245 |
| Marcksl1 | 047945 | 062356 | 055637 |
| Marveld2 | 021636 | 225754 | 153294 |
| Marveld2 | 021636 | 163163 | 129990 |
| Marveld2 | 021636 | 168772 | 126438 |
| Marveld2 | 021636 | 022137 | 022137 |
| Masp1 | 022887 | 089883 | 087327 |
| Matn1 | 040533 | 102576 | 099636 |
| Matn4 | 016995 | 109359 | 104983 |
| Matn4 | 016995 | 109358 | 104982 |
| Matn4 | 016995 | 103103 | 099392 |
| Matn4 | 016995 | 103104 | 099393 |
| Matn4 | 016995 | 154940 | N/A |
| Mboat1 | 038732 | 153269 | N/A |
| Mboat1 | 038732 | 152798 | N/A |
| Mboat1 | 038732 | 047311 | 045441 |
| Mboat1 | 038732 | 220870 | N/A |
| Mboat1 | 038732 | 222095 | N/A |
| Mboat2 | 020646 | 222198 | 152150 |
| Mboat2 | 020646 | 221952 | 152348 |
| Mboat2 | 020646 | 220497 | N/A |
| Mboat2 | 020646 | 078902 | 077937 |
| Mboat2 | 020646 | 110942 | 106567 |
| Mboat2 | 020646 | 222994 | 152712 |
| Mcam | 032135 | 149241 | 121090 |
| Mcam | 032135 | 034650 | 034650 |
| Mcam | 032135 | 098852 | 096451 |
| Mcam | 032135 | 216002 | 149002 |
| Mcam | 032135 | 147836 | 117924 |
| Mcam | 032135 | 132490 | N/A |
| Mcc | 071856 | 089874 | 087318 |
| Mcc | 071856 | 164666 | 128032 |
| Mcc | 071856 | 202090 | N/A |
| Mcc | 071856 | 202845 | N/A |
| Mcc | 071856 | 201270 | N/A |
| Mctp1 | 021596 | 125209 | 118958 |
| Mctp1 | 021596 | 126960 | 120673 |
| Mctp1 | 021596 | 109589 | 105218 |
| Mctp1 | 021596 | 137052 | N/A |
| Mctp1 | 021596 | 155275 | N/A |
| Mctp1 | 021596 | 122843 | N/A |
| Mctp1 | 021596 | 149028 | N/A |
| Mctp1 | 021596 | 109583 | 105212 |
| Mdfi | 032717 | 113280 | 108905 |
| Mdfi | 032717 | 066368 | 069915 |

TABLE 2-continued

| ENSEMBL IDs for mice | | | |
| --- | --- | --- | --- |
| Symbol | MUSG | MUST | MUSP |
| Mdfi | 032717 | 035375 | 037888 |
| Mdfi | 032717 | 125745 | N/A |
| Mdfi | 032717 | 131971 | 120454 |
| Mdfi | 032717 | 140234 | N/A |
| Mdfi | 032717 | 152455 | 117665 |
| Mdfi | 032717 | 132125 | 114581 |
| Mdfi | 032717 | 129360 | 114930 |
| Mdga2 | 034912 | 037181 | 046761 |
| Mdga2 | 034912 | 222987 | 152049 |
| Mdga2 | 034912 | 222623 | 152548 |
| Mdga2 | 034912 | 178814 | 137608 |
| Mdga2 | 034912 | 101379 | 098930 |
| Mdga2 | 034912 | 178724 | N/A |
| Mdga2 | 034912 | 223289 | N/A |
| Mdga2 | 034912 | 179729 | N/A |
| Mdga2 | 034912 | 177690 | N/A |
| Mdga2 | 034912 | 179577 | N/A |
| Mdga2 | 034912 | 179025 | N/A |
| Mdga2 | 034912 | 223141 | 152613 |
| Mdga2 | 034912 | 222167 | 152112 |
| Mdga2 | 034912 | 113942 | 109575 |
| Med12l | 056476 | 040846 | 041859 |
| Med12l | 056476 | 199659 | 142903 |
| Med12l | 056476 | 197374 | 143419 |
| Med12l | 056476 | 029393 | 029393 |
| Med12l | 056476 | 040325 | 042269 |
| Med12l | 056476 | 164225 | 127038 |
| Mef2c | 005583 | 198199 | 143742 |
| Mef2c | 005583 | 199450 | 143315 |
| Mef2c | 005583 | 198916 | 143235 |
| Mef2c | 005583 | 200123 | 142833 |
| Mef2c | 005583 | 005722 | 005722 |
| Mef2c | 005583 | 163888 | 132547 |
| Mef2c | 005583 | 196493 | 142897 |
| Mef2c | 005583 | 200394 | 143598 |
| Mef2c | 005583 | 199019 | 143401 |
| Mef2c | 005583 | 199105 | 143212 |
| Mef2c | 005583 | 196832 | N/A |
| Mef2c | 005583 | 199432 | 142714 |
| Mef2c | 005583 | 198069 | 143286 |
| Mef2c | 005583 | 197681 | 143420 |
| Mef2c | 005583 | 197722 | 142456 |
| Mef2c | 005583 | 197938 | 143187 |
| Mef2c | 005583 | 199262 | N/A |
| Mef2c | 005583 | 198064 | 142399 |
| Mef2c | 005583 | 196730 | 143338 |
| Mef2c | 005583 | 196207 | 143221 |
| Mef2c | 005583 | 197146 | 143227 |
| Mef2c | 005583 | 197022 | N/A |
| Mef2c | 005583 | 185052 | 138826 |
| Mef2c | 005583 | 195984 | 143611 |
| Mef2c | 005583 | 199167 | 142884 |
| Mef2c | 005583 | 195904 | 143339 |
| Mef2c | 005583 | 198217 | 142487 |
| Mef2c | 005583 | 199210 | 142595 |
| Mef2c | 005583 | 200138 | 142715 |
| Mef2c | 005583 | 198360 | 143058 |
| Mef2c | 005583 | 197145 | 142619 |
| Megf10 | 024593 | 075770 | 075174 |
| Megf10 | 024593 | 139892 | 116814 |
| Mei4 | 043289 | 057067 | 061341 |
| Mei4 | 043289 | 189832 | 140647 |
| Mei4 | 043289 | 189391 | 139589 |
| Meis1 | 020160 | 144988 | 134969 |
| Meis1 | 020160 | 102878 | 099942 |
| Meis1 | 020160 | 068264 | 069277 |
| Meis1 | 020160 | 118661 | N/A |
| Meis1 | 020160 | 177417 | 135726 |
| Meis1 | 020160 | 177357 | 139074 |
| Meis1 | 020160 | 125722 | N/A |
| Meis1 | 020160 | 137300 | N/A |
| Meis1 | 020160 | 185131 | 139219 |
| Meis2 | 027210 | 028639 | 028639 |
| Meis2 | 027210 | 102538 | 099597 |
| Meis2 | 027210 | 110907 | 106532 |
| Meis2 | 027210 | 110908 | 106533 |

TABLE 2-continued

| ENSEMBL IDs for mice | | | |
|---|---|---|---|
| Symbol | MUSG | MUST | MUSP |
| Meis2 | 027210 | 110906 | 106531 |
| Meis2 | 027210 | 074285 | 073898 |
| Meis2 | 027210 | 120995 | N/A |
| Meis2 | 027210 | 189640 | N/A |
| Meis2 | 027210 | 151279 | N/A |
| Meis2 | 027210 | 177493 | N/A |
| Meis2 | 027210 | 149217 | N/A |
| Meis2 | 027210 | 118654 | N/A |
| Meis2 | 027210 | 150477 | N/A |
| Meis2 | 027210 | 154671 | N/A |
| Meis2 | 027210 | 140461 | N/A |
| Meis2 | 027210 | 135543 | N/A |
| Meis2 | 027210 | 134314 | N/A |
| Meis2 | 027210 | 133990 | N/A |
| Meis2 | 027210 | 138526 | N/A |
| Merfk | 014361 | 014505 | 014505 |
| Merfk | 014361 | 140221 | N/A |
| Metrn | 002274 | 165838 | 127275 |
| Metrn | 002274 | 002344 | 002344 |
| Mfap3l | 031647 | 161421 | 124136 |
| Mfap3l | 031647 | 160719 | 125139 |
| Mfap3l | 031647 | 161702 | 124330 |
| Mfap3l | 031647 | 034066 | 034066 |
| Mff | 026150 | 078332 | 077446 |
| Mff | 026150 | 161572 | N/A |
| Mff | 026150 | 073025 | 072784 |
| Mff | 026150 | 161648 | 124164 |
| Mff | 026150 | 162056 | N/A |
| Mff | 026150 | 160786 | 125230 |
| Mff | 026150 | 162003 | 124334 |
| Mff | 026150 | 160972 | 124200 |
| Mff | 026150 | 160750 | 125223 |
| Mff | 026150 | 159279 | 123713 |
| Mff | 026150 | 160044 | 125005 |
| Mff | 026150 | 160744 | 125629 |
| Mff | 026150 | 160632 | N/A |
| Mff | 026150 | 188333 | N/A |
| Mff | 026150 | 162794 | N/A |
| Mff | 026150 | 162573 | N/A |
| Mfge8 | 030605 | 206338 | N/A |
| Mfge8 | 030605 | 107409 | 103032 |
| Mfge8 | 030605 | 032825 | 032825 |
| Mfge8 | 030605 | 205563 | 145720 |
| Mfge8 | 030605 | 205649 | N/A |
| Mfge8 | 030605 | 205494 | N/A |
| Mfge8 | 030605 | 205929 | N/A |
| Mfge8 | 030605 | 205688 | N/A |
| Mfge8 | 030605 | 205526 | N/A |
| Mfge8 | 030605 | 206844 | N/A |
| Mfhas1 | 070056 | 037666 | 044135 |
| Mfhas1 | 070056 | 209953 | 147927 |
| Mfhas1 | 070056 | 154989 | N/A |
| Mfsd2a | 028655 | 152308 | N/A |
| Mfsd2a | 028655 | 030408 | 030408 |
| Mfsd2a | 028655 | 138964 | N/A |
| Mfsd2a | 028655 | 127047 | 116782 |
| Mgat4c | 019888 | 146230 | N/A |
| Mgat4c | 019888 | 219195 | 151859 |
| Mgat4c | 019888 | 134930 | N/A |
| Mgat4c | 019888 | 127504 | 117148 |
| Mgat4c | 019888 | 156751 | 116216 |
| Mgat4c | 019888 | 138522 | 118056 |
| Mgat4c | 019888 | 130580 | N/A |
| Mgat4c | 019888 | 138016 | 116902 |
| Mgat4c | 019888 | 219683 | N/A |
| Mgat4c | 019888 | 218554 | N/A |
| Mgat4c | 019888 | 143640 | N/A |
| Mgat4c | 019888 | 020039 | 020039 |
| Mgat4c | 019888 | 218984 | N/A |
| Mgat4c | 019888 | 120748 | 114010 |
| Mgat4c | 019888 | 163753 | 131551 |
| Mgat4c | 019888 | 179929 | 135959 |
| Mgat5b | 043857 | 103027 | 099316 |
| Mgat5b | 043857 | 139905 | N/A |
| Mgat5b | 043857 | 136584 | 122276 |
| Mgat5b | 043857 | 126757 | N/A |

TABLE 2-continued

| ENSEMBL IDs for mice | | | |
|---|---|---|---|
| Symbol | MUSG | MUST | MUSP |
| Mgll | 033174 | 113585 | 109215 |
| Mgll | 033174 | 151699 | N/A |
| Mgll | 033174 | 113582 | 109212 |
| Mgll | 033174 | 203608 | 144883 |
| Mgll | 033174 | 113581 | 109211 |
| Mgll | 033174 | 150180 | 145068 |
| Mgll | 033174 | 089449 | 086872 |
| Mgll | 033174 | 203824 | 145364 |
| Mgll | 033174 | 205045 | N/A |
| Mgll | 033174 | 163271 | 127374 |
| Mgst1 | 008540 | 008684 | 008684 |
| Mgst1 | 008540 | 120939 | 112646 |
| Mgst1 | 008540 | 204628 | 144912 |
| Mgst1 | 008540 | 140932 | 145306 |
| Mgst1 | 008540 | 120302 | 113257 |
| Mgst1 | 008540 | 120230 | 113859 |
| Mgst1 | 008540 | 118091 | 112923 |
| Mgst1 | 008540 | 125810 | 114222 |
| Miat | 097767 | 182953 | N/A |
| Miat | 097767 | 181535 | N/A |
| Miat | 097767 | 182258 | N/A |
| Miat | 097767 | 182509 | N/A |
| Miat | 097767 | 183036 | N/A |
| Miat | 097767 | 182699 | N/A |
| Mical2 | 038244 | 050149 | 051163 |
| Mical2 | 038244 | 106647 | N/A |
| Mical2 | 038244 | 106648 | N/A |
| Mical2 | 038244 | 037991 | 047639 |
| Mical2 | 038244 | 150428 | N/A |
| Mical2 | 038244 | 144509 | 123341 |
| Micalcl | 030771 | 051308 | 062443 |
| Micalcl | 030771 | 033033 | 033033 |
| Micalcl | 030771 | 106645 | 102256 |
| Micalcl | 030771 | 213108 | 150200 |
| Micalcl | 030771 | 140202 | N/A |
| Mid1 | 035299 | 112104 | 107732 |
| Mid1 | 035299 | 036753 | 038765 |
| Mid1 | 035299 | 078947 | 077974 |
| Mid1 | 035299 | 149258 | N/A |
| Mid1 | 035299 | 133857 | N/A |
| Mid1 | 035299 | 146073 | N/A |
| Mid1 | 035299 | 152163 | N/A |
| Mid1 | 035299 | 129642 | N/A |
| Mid1 | 035299 | 151722 | N/A |
| Mid1 | 035299 | 112107 | 107735 |
| Mid1 | 035299 | 079443 | 078412 |
| Mid1 | 035299 | 143815 | N/A |
| Mid1 | 035299 | 171433 | 126746 |
| Mid1 | 035299 | 163810 | 128176 |
| Mid1 | 035299 | 112105 | 107733 |
| Mid2 | 000266 | 112990 | 108614 |
| Mid2 | 000266 | 112988 | 108612 |
| Mid2 | 000266 | 140144 | N/A |
| Mid2 | 000266 | 128809 | 123221 |
| Mid2 | 000266 | 112993 | 108617 |
| Midn | 035621 | 099492 | 097091 |
| Midn | 035621 | 042057 | 046967 |
| Midn | 035621 | 151202 | 115717 |
| Midn | 035621 | 124179 | N/A |
| Midn | 035621 | 153477 | 119787 |
| Midn | 035621 | 146516 | 119962 |
| Midn | 035621 | 144526 | 120988 |
| Mkx | 061013 | 176586 | N/A |
| Mkx | 061013 | 079788 | 078718 |
| Mkx | 061013 | 188926 | N/A |
| Mkx | 061013 | 176608 | N/A |
| Mkx | 061013 | 176757 | N/A |
| Mlc1 | 035805 | 042594 | 047667 |
| Mlc1 | 035805 | 109368 | 104993 |
| Mlycd | 074064 | 098367 | 095970 |
| Mlycd | 074064 | 145121 | N/A |
| Mmd2 | 039533 | 037048 | 039357 |
| Mmd2 | 039533 | 195947 | N/A |
| Mmd2 | 039533 | 196972 | N/A |
| Mmp14 | 000957 | 089688 | 087119 |
| Mmp14 | 000957 | 197874 | 142665 |

TABLE 2-continued

| ENSEMBL IDs for mice | | | |
|---|---|---|---|
| Symbol | MUSG | MUST | MUSP |
| Mmp14 | 000957 | 225641 | 153679 |
| Mmp14 | 000957 | 197947 | N/A |
| Mmp14 | 000957 | 198679 | N/A |
| Mmp14 | 000957 | 196155 | 143012 |
| Mmp14 | 000957 | 226710 | N/A |
| Mmp2 | 031740 | 034187 | 034187 |
| Mmp2 | 031740 | 211691 | N/A |
| Mmp2 | 031740 | 211308 | N/A |
| Mmp2 | 031740 | 211567 | 147838 |
| Mmp24 | 027612 | 029141 | 029141 |
| Mmp24 | 027612 | 135945 | N/A |
| Mns1 | 032221 | 183809 | 139105 |
| Mns1 | 032221 | 184604 | 139232 |
| Mns1 | 032221 | 034746 | 034746 |
| Mobp | 032517 | 068698 | 071084 |
| Mobp | 032517 | 215512 | 149831 |
| Mobp | 032517 | 111627 | 107254 |
| Mobp | 032517 | 093773 | 091287 |
| Mobp | 032517 | 174193 | 134410 |
| Mobp | 032517 | 214943 | 149285 |
| Mobp | 032517 | 214008 | N/A |
| Mog | 076439 | 102665 | 099726 |
| Mog | 076439 | 167275 | 129489 |
| Mpp6 | 038388 | 166318 | 125880 |
| Mpp6 | 038388 | 036236 | 039314 |
| Mpp6 | 038388 | 204545 | 144737 |
| Mpp6 | 038388 | 203415 | N/A |
| Mpp6 | 038388 | 036225 | 038772 |
| Mpp6 | 038388 | 171601 | 129004 |
| Mpp6 | 038388 | 167628 | 129355 |
| Mpp6 | 038388 | 167063 | N/A |
| Mpp6 | 038388 | 167319 | N/A |
| Mpp7 | 057440 | 115869 | 111535 |
| Mpped1 | 041708 | 109470 | 105096 |
| Mpped1 | 041708 | 123387 | 123230 |
| Mpped1 | 041708 | 046168 | 041981 |
| Mpped1 | 041708 | 109469 | 105095 |
| Mpped1 | 041708 | 150489 | 128786 |
| Mpped1 | 041708 | 125739 | 131463 |
| Mpped1 | 041708 | 148868 | 131679 |
| Mpped1 | 041708 | 163723 | 126242 |
| Mpped1 | 041708 | 172115 | 132518 |
| Mpped1 | 041708 | 171560 | 125835 |
| Mpped1 | 041708 | 172398 | 131333 |
| Mrm2 | 029557 | 031536 | 031536 |
| Msi1 | 054256 | 150779 | 120516 |
| Msi1 | 054256 | 151444 | N/A |
| Msi1 | 054256 | 067168 | 070415 |
| Msi1 | 054256 | 131079 | 144032 |
| Msi1 | 054256 | 145005 | N/A |
| Msi1 | 054256 | 139918 | N/A |
| Msi1 | 054256 | 145840 | N/A |
| Msi1 | 054256 | 136586 | 143900 |
| Msi1 | 054256 | 130849 | N/A |
| Msra | 054733 | 067927 | 065754 |
| Msra | 054733 | 210428 | 147689 |
| Msra | 054733 | 210363 | 148189 |
| Msra | 054733 | 209392 | N/A |
| Msra | 054733 | 209513 | N/A |
| Msx2 | 021469 | 021922 | 021922 |
| Msx2 | 021469 | 188606 | N/A |
| mt-Co1 | 064351 | 082402 | 080993 |
| mt-Nd4 | 064363 | 082414 | 081000 |
| Mt3 | 031760 | 034211 | 034211 |
| Mt3 | 031760 | 211930 | 148345 |
| Mt3 | 031760 | 211915 | 148383 |
| Mtch2 | 027282 | 136872 | 121851 |
| Mtch2 | 027282 | 150232 | 118566 |
| Mtch2 | 027282 | 111467 | 107092 |
| Mtch2 | 027282 | 111468 | 107093 |
| Mtch2 | 027282 | 057216 | N/A |
| Mtch2 | 027282 | 148936 | N/A |
| Mtch2 | 027282 | 146392 | N/A |
| Mtch2 | 027282 | 143773 | N/A |
| Mtch2 | 027282 | 142350 | N/A |
| Mtch2 | 027282 | 144696 | N/A |

TABLE 2-continued

| ENSEMBL IDs for mice | | | |
|---|---|---|---|
| Symbol | MUSG | MUST | MUSP |
| Mtch2 | 027282 | 135026 | N/A |
| Mtch2 | 111714 | 214148 | 149233 |
| Mtch2 | 111714 | 213376 | 149651 |
| Mtch2 | 111714 | 217470 | N/A |
| Mtch2 | 111714 | 214378 | 150912 |
| Mtch2 | 111714 | 215609 | N/A |
| Mtch2 | 111714 | 216454 | 151033 |
| Mtch2 | 111714 | 216814 | N/A |
| Mtch2 | 111714 | 215750 | N/A |
| Mtch2 | 111714 | 214987 | N/A |
| Mtch2 | 111714 | 216471 | N/A |
| Mtch2 | 111714 | 217168 | N/A |
| Mtfp1 | 004748 | 004868 | 004868 |
| Mtfp1 | 004748 | 123607 | N/A |
| Mtss1 | 022353 | 080371 | 079239 |
| Mtss1 | 022353 | 226393 | N/A |
| Mtss1 | 022353 | 226976 | N/A |
| Mtss1 | 022353 | 227045 | 154093 |
| Mtss1 | 022353 | 227196 | 154064 |
| Mtss1 | 022353 | 228067 | 153850 |
| Mtss1 | 022353 | 227290 | N/A |
| Mtss1 | 022353 | 227238 | N/A |
| Mtss1 | 022353 | 228365 | N/A |
| Mtss1 | 022353 | 228655 | N/A |
| Mtss1 | 022353 | 226923 | N/A |
| Mtss1 | 022353 | 227797 | N/A |
| Mxd4 | 037235 | 201189 | N/A |
| Mxd4 | 037235 | 042701 | 039071 |
| Mxd4 | 037235 | 119171 | 113300 |
| Mxd4 | 037235 | 201763 | N/A |
| Mxra8 | 029070 | 141883 | 114929 |
| Mxra8 | 029070 | 030947 | 030947 |
| Mxra8 | 029070 | 133592 | N/A |
| Mxra8 | 029070 | 143886 | N/A |
| Mxra8 | 029070 | 141766 | N/A |
| Mxra8 | 029070 | 126487 | N/A |
| Mxra8 | 029070 | 132142 | N/A |
| Mybpc1 | 020061 | 121629 | 112615 |
| Mybpc1 | 020061 | 124144 | N/A |
| Mybpc1 | 020061 | 119185 | 112699 |
| Mybpc1 | 020061 | 153964 | 122472 |
| Mybpc1 | 020061 | 148205 | N/A |
| Mybpc1 | 020061 | 156573 | 119024 |
| Mycl | 028654 | 144998 | 117232 |
| Mycl | 028654 | 106252 | 101859 |
| Mycl | 028654 | 030407 | 030407 |
| Mycl | 028654 | 135925 | N/A |
| Mycl | 028654 | 147259 | N/A |
| Myh14 | 030739 | 107899 | 103531 |
| Myh14 | 030739 | 048102 | 046059 |
| Myh14 | 030739 | 208200 | 146686 |
| Myh14 | 030739 | 208044 | N/A |
| Myh14 | 030739 | 207775 | 147115 |
| Myh14 | 030739 | 209024 | N/A |
| Myh14 | 030739 | 208085 | N/A |
| Myh14 | 030739 | 208131 | 146584 |
| Myh14 | 030739 | 107900 | 103532 |
| Myh6 | 040752 | 081857 | 080538 |
| Myh6 | 040752 | 226297 | 154634 |
| Myh6 | 040752 | 228731 | 153961 |
| Myh6 | 040752 | 227905 | N/A |
| Myh6 | 040752 | 131892 | N/A |
| Myh6 | 040752 | 124930 | 115615 |
| Myh6 | 040752 | 111456 | 107083 |
| Mylip | 038175 | 038275 | 047403 |
| Mylip | 038175 | 222178 | 152597 |
| Myo10 | 022272 | 110457 | 106087 |
| Myo10 | 022272 | 137601 | 118280 |
| Myo10 | 022272 | 127486 | N/A |
| Myo10 | 022272 | 130517 | N/A |
| Myo10 | 022272 | 126076 | N/A |
| Myo10 | 022272 | 135981 | 123057 |
| Myo10 | 022272 | 022882 | 022882 |
| Myo10 | 022272 | 135173 | 118744 |
| Myo10 | 022272 | 131834 | 119200 |
| Myo10 | 022272 | 124966 | 120817 |

TABLE 2-continued

ENSEMBL IDs for mice

| Symbol | MUSG | MUST | MUSP |
|---|---|---|---|
| Myo10 | 022272 | 151360 | 119367 |
| Myo10 | 022272 | 125667 | 120566 |
| Myo10 | 022272 | 145587 | N/A |
| Myo1d | 035441 | 041065 | 037819 |
| Myo1d | 035441 | 070997 | 066948 |
| Myo1d | 035441 | 125944 | N/A |
| Myo7a | 030761 | 107128 | 102745 |
| Myo7a | 030761 | 156992 | 146114 |
| Myo7a | 030761 | 084979 | 082046 |
| Myo7a | 030761 | 107122 | 102739 |
| Myo7a | 030761 | 205746 | 146165 |
| Myo7a | 030761 | 107127 | 102744 |
| Myo7a | 030761 | 124787 | N/A |
| Myo7a | 030761 | 152975 | N/A |
| Myo7a | 030761 | 153657 | N/A |
| Myo7a | 030761 | 155637 | N/A |
| Myo7a | 030761 | 149079 | N/A |
| Myo7a | 030761 | 138627 | 114944 |
| Myo7a | 030761 | 131632 | N/A |
| Myot | 024471 | 025349 | 025349 |
| Myot | 024471 | 115498 | 111160 |
| Myrf | 036098 | 088013 | 085329 |
| Myrf | 036098 | 190922 | N/A |
| Myrf | 036098 | 186056 | 140871 |
| Myrf | 036098 | 186854 | 140838 |
| Myrf | 036098 | 189897 | 139601 |
| Myrf | 036098 | 189439 | N/A |
| Ncald | 051359 | 090150 | 087611 |
| Ncald | 051359 | 120746 | 112898 |
| Ncald | 051359 | 119730 | 113858 |
| Ncald | 051359 | 116445 | 112146 |
| Ncald | 051359 | 153775 | 114576 |
| Ncald | 051359 | 148652 | 121460 |
| Ncald | 051359 | 132423 | N/A |
| Ncald | 051359 | 150453 | 119726 |
| Ncald | 051359 | 226924 | N/A |
| Ncald | 051359 | 137944 | N/A |
| Ncald | 051359 | 123317 | N/A |
| Ncald | 051359 | 168992 | 130126 |
| Ncam2 | 022762 | 037785 | 049390 |
| Ncam2 | 022762 | 067602 | 063468 |
| Ncan | 002341 | 002412 | 002412 |
| Nceh1 | 027698 | 046515 | 045864 |
| Nceh1 | 027698 | 138947 | 115209 |
| Nceh1 | 027698 | 129412 | N/A |
| Nceh1 | 027698 | 091284 | 088829 |
| Nceh1 | 027698 | 140872 | N/A |
| Nckap5 | 049690 | 161954 | 125624 |
| Nckap5 | 049690 | 162877 | 124748 |
| Nckap5 | 049690 | 160736 | N/A |
| Nckap5 | 049690 | 057846 | 062229 |
| Nckap5 | 049690 | 094610 | 092193 |
| Nckap5 | 049690 | 159934 | N/A |
| Nckap5 | 049690 | 162646 | 123936 |
| Nckap5 | 049690 | 160693 | 123975 |
| Nckap5 | 049690 | 162664 | N/A |
| Nckap5 | 049690 | 162647 | N/A |
| Nckap5 | 049690 | 112583 | 108202 |
| Nckap5 | 049690 | 094609 | 092192 |
| Ndrg1 | 005125 | 005256 | 005256 |
| Ndrg1 | 005125 | 165966 | N/A |
| Ndrg1 | 005125 | 166420 | 127099 |
| Ndrg1 | 005125 | 171569 | N/A |
| Ndrg1 | 005125 | 164675 | 130150 |
| Ndrg1 | 005125 | 168542 | 127940 |
| Ndrg1 | 005125 | 167817 | 127075 |
| Ndrg1 | 005125 | 168979 | 126985 |
| Ndrg1 | 005125 | 172447 | 130281 |
| Ndrg1 | 005125 | 171266 | 129093 |
| Ndrg1 | 005125 | 170903 | 127302 |
| Ndrg1 | 005125 | 163496 | 130584 |
| Ndrg1 | 005125 | 164070 | 126091 |
| Ndrg2 | 004558 | 004673 | 004673 |
| Ndrg2 | 004558 | 111632 | 107259 |
| Ndrg2 | 004558 | 226698 | N/A |
| Ndrg2 | 004558 | 227237 | 153938 |

TABLE 2-continued

ENSEMBL IDs for mice

| Symbol | MUSG | MUST | MUSP |
|---|---|---|---|
| Ndrg2 | 004558 | 226122 | N/A |
| Ndrg2 | 004558 | 227402 | 154279 |
| Ndrg2 | 004558 | 228164 | 153830 |
| Ndrg2 | 004558 | 226366 | N/A |
| Ndrg2 | 004558 | 226528 | 154716 |
| Ndrg2 | 004558 | 226184 | 154135 |
| Ndrg2 | 004558 | 228620 | N/A |
| Ndrg2 | 004558 | 226364 | N/A |
| Ndrg2 | 004558 | 228173 | N/A |
| Ndst3 | 027977 | 137404 | 118796 |
| Ndst3 | 027977 | 132112 | 120623 |
| Ndst3 | 027977 | 154668 | 118207 |
| Ndst3 | 027977 | 124803 | 122617 |
| Ndst3 | 027977 | 172537 | 133657 |
| Ndst3 | 027977 | 199046 | N/A |
| Ndst3 | 027977 | 199825 | N/A |
| Ndst3 | 027977 | 132896 | N/A |
| Ndst3 | 027977 | 029602 | 029602 |
| Ndst4 | 027971 | 173932 | 133341 |
| Ndst4 | 027971 | 147016 | N/A |
| Ndst4 | 027971 | 144344 | 120687 |
| Ndst4 | 027971 | 174648 | 133575 |
| Ndst4 | 027971 | 172632 | N/A |
| Ndst4 | 027971 | 198101 | 142414 |
| Nectin3 | 022656 | 023335 | 023335 |
| Nectin3 | 022656 | 023334 | 023334 |
| Nectin3 | 022656 | 096052 | 093757 |
| Nectin3 | 022656 | 133935 | N/A |
| Nectin3 | 022656 | 149901 | 117479 |
| Nectin3 | 022656 | 121245 | 113146 |
| Nectin3 | 022656 | 132089 | N/A |
| Nectin3 | 022656 | 119941 | 113301 |
| Nectin3 | 022656 | 121803 | 112567 |
| Nectin3 | 022656 | 124602 | 115927 |
| Nedd4l | 024589 | 225057 | 153537 |
| Nedd4l | 024589 | 225261 | 153107 |
| Nedd4l | 024589 | 224385 | 153594 |
| Nedd4l | 024589 | 223959 | N/A |
| Nedd4l | 024589 | 224347 | 153052 |
| Nedd4l | 024589 | 224516 | N/A |
| Nedd4l | 024589 | 224890 | N/A |
| Nedd4l | 024589 | 080418 | 079280 |
| Nedd4l | 024589 | 226058 | 153526 |
| Nedd4l | 024589 | 224663 | N/A |
| Nedd4l | 024589 | 163516 | 132838 |
| Nefh | 020396 | 093369 | 091061 |
| Negr1 | 040037 | 074015 | 073664 |
| Negr1 | 040037 | 041425 | 041132 |
| Negr1 | 040037 | 106065 | 101680 |
| Negr1 | 040037 | 197246 | N/A |
| Negr1 | 040037 | 175773 | 135531 |
| Nek2 | 026622 | 027931 | 027931 |
| Nek2 | 026622 | 126446 | N/A |
| Nek2 | 026622 | 150839 | N/A |
| Nek2 | 026622 | 136733 | N/A |
| Nek2 | 110797 | 213394 | 149034 |
| Nek2 | 110797 | 216945 | N/A |
| Nek2 | 110797 | 217216 | N/A |
| Nek2 | 110797 | 215890 | N/A |
| Nek4 | 021918 | 226551 | 154678 |
| Nek4 | 021918 | 228328 | 154090 |
| Nek4 | 021918 | 228392 | N/A |
| Nek4 | 021918 | 050171 | 057915 |
| Nek4 | 021918 | 226833 | 154606 |
| Nek4 | 021918 | 227602 | N/A |
| Nek4 | 021918 | 227199 | N/A |
| Nek4 | 021918 | 226146 | 153710 |
| Nell1 | 055409 | 151721 | 114706 |
| Nell1 | 055409 | 081872 | 080550 |
| Nell1 | 055409 | 145096 | N/A |
| Nell1 | 055409 | 107603 | 103229 |
| Nell1 | 055409 | 154410 | N/A |
| Neo1 | 032340 | 068664 | 063656 |
| Neo1 | 032340 | 214547 | 150600 |
| Neo1 | 032340 | 215165 | N/A |
| Neo1 | 032340 | 217545 | N/A |

TABLE 2-continued

ENSEMBL IDs for mice

| Symbol | MUSG | MUST | MUSP |
|---|---|---|---|
| Neo1 | 032340 | 215026 | N/A |
| Neo1 | 032340 | 216964 | 149424 |
| Nes | 004891 | 159830 | N/A |
| Nes | 004891 | 090973 | 088493 |
| Nes | 004891 | 160694 | 125571 |
| Neto1 | 050321 | 058829 | 057340 |
| Neu4 | 034000 | 050890 | 051151 |
| Neu4 | 034000 | 190212 | 140127 |
| Rbfox3 | 025576 | 117731 | 113636 |
| Rbfox3 | 025576 | 103023 | 099312 |
| Rbfox3 | 025576 | 017576 | 017576 |
| Rbfox3 | 025576 | 069343 | 069598 |
| Rbfox3 | 025576 | 106278 | 101885 |
| Rbfox3 | 025576 | 120061 | 113987 |
| Rbfox3 | 025576 | 154746 | 118332 |
| Rbfox3 | 025576 | 136551 | 119255 |
| Rbfox3 | 025576 | 128863 | N/A |
| Rbfox3 | 025576 | 134774 | N/A |
| Rbfox3 | 025576 | 117731 | 113636 |
| Rbfox3 | 025576 | 103023 | 099312 |
| Rbfox3 | 025576 | 017576 | 017576 |
| Rbfox3 | 025576 | 069343 | 069598 |
| Rbfox3 | 025576 | 106278 | 101885 |
| Rbfox3 | 025576 | 120061 | 113987 |
| Rbfox3 | 025576 | 154746 | 118332 |
| Rbfox3 | 025576 | 136551 | 119255 |
| Rbfox3 | 025576 | 128863 | N/A |
| Rbfox3 | 025576 | 134774 | N/A |
| Neurl1a | 006435 | 111808 | 107439 |
| Neurl1a | 006435 | 111807 | 107438 |
| Neurod1 | 034701 | 041099 | 040364 |
| Neurod6 | 037984 | 044767 | 047016 |
| Nfatc2 | 027544 | 074618 | 074198 |
| Nfatc2 | 027544 | 109184 | 104812 |
| Nfatc2 | 027544 | 151292 | N/A |
| Nfatc2 | 027544 | 099067 | N/A |
| Nfatc2 | 027544 | 029057 | 029057 |
| Nfatc2 | 027544 | 137451 | 118329 |
| Nfatc2 | 027544 | 140137 | N/A |
| Nfatc2 | 027544 | 138546 | N/A |
| Nfatc2 | 027544 | 171689 | 130875 |
| Nhsl1 | 039835 | 207038 | 147021 |
| Nhsl1 | 039835 | 159299 | N/A |
| Nhsl1 | 039835 | 161510 | N/A |
| Nhsl1 | 039835 | 160602 | N/A |
| Nhsl1 | 039835 | 037341 | 040799 |
| Nhsl1 | 039835 | 160547 | N/A |
| Nhsl1 | 039835 | 160600 | N/A |
| Nhsl1 | 039835 | 162891 | 124072 |
| Nhsl1 | 039835 | 100054 | 097631 |
| Nid1 | 005397 | 005532 | 005532 |
| Nid1 | 005397 | 222142 | N/A |
| Nid1 | 005397 | 222436 | N/A |
| Ninj2 | 041377 | 112711 | 108331 |
| Ninj2 | 041377 | 035244 | 046306 |
| Nipal4 | 020411 | 020679 | 020679 |
| Nkain2 | 069670 | 191234 | 140463 |
| Nkain2 | 069670 | 218645 | 151255 |
| Nkain2 | 069670 | 219125 | 151959 |
| Nkain2 | 069670 | 219306 | N/A |
| Nkain2 | 069670 | 092602 | 090264 |
| Nkain2 | 069670 | 092603 | 090265 |
| Nkx2-2 | 027434 | 109970 | 105596 |
| Nkx2-2 | 027434 | 067075 | 069666 |
| Nkx2-2 | 027434 | 109969 | N/A |
| Nkx2-2 | 027434 | 172627 | N/A |
| Nlgn3 | 031302 | 118111 | 113863 |
| Nlgn3 | 031302 | 130555 | 122213 |
| Nlgn3 | 031302 | 151528 | 123283 |
| Nlgn3 | 031302 | 065858 | 066304 |
| Nlgn3 | 031302 | 147443 | N/A |
| Nlgn3 | 031302 | 144860 | N/A |
| Nln | 021710 | 109315 | 104938 |
| Nln | 021710 | 225324 | 153299 |
| Nln | 021710 | 224058 | N/A |
| Nln | 021710 | 225704 | N/A |
| Nln | 021710 | 224945 | 153227 |
| Nln | 021710 | 224475 | N/A |
| Nln | 021710 | 225478 | N/A |
| Nln | 021710 | 224086 | N/A |
| Nnt | 025453 | 069902 | 070564 |
| Nnt | 025453 | 099149 | 096753 |
| Nnt | 025453 | 109204 | 104827 |
| Nnt | 025453 | 133627 | N/A |
| Nnt | 025453 | 144599 | N/A |
| Nnt | 025453 | 223268 | 152868 |
| Notch1 | 026923 | 028288 | 028288 |
| Notch1 | 026923 | 132941 | N/A |
| Notch1 | 026923 | 148948 | N/A |
| Notch1 | 026923 | 138034 | N/A |
| Notch1 | 026923 | 126872 | N/A |
| Notch1 | 026923 | 140082 | N/A |
| Notch1 | 026923 | 147481 | N/A |
| Notch1 | 026923 | 123873 | N/A |
| Notch1 | 026923 | 129506 | N/A |
| Notch1 | 026923 | 132820 | 115258 |
| Notch1 | 026923 | 131393 | N/A |
| Npr3 | 022206 | 066529 | 066737 |
| Npr3 | 022206 | 226139 | N/A |
| Npr3 | 022206 | 228603 | 154180 |
| Npr3 | 022206 | 228489 | 153895 |
| Npr3 | 022206 | 226878 | N/A |
| Npy1r | 036437 | 212588 | 148417 |
| Npy1r | 036437 | 039303 | 045530 |
| Nrcam | 020598 | 218940 | N/A |
| Nrcam | 020598 | 110748 | 106376 |
| Nrcam | 020598 | 219592 | N/A |
| Nrcam | 020598 | 220130 | N/A |
| Nrcam | 020598 | 020939 | 020939 |
| Nrcam | 020598 | 220126 | 151296 |
| Nrcam | 020598 | 217907 | 151419 |
| Nrcam | 020598 | 218540 | 151732 |
| Nrcam | 020598 | 219928 | N/A |
| Nrcam | 020598 | 218805 | N/A |
| Nrcam | 020598 | 220123 | 151844 |
| Nrcam | 020598 | 218431 | 151873 |
| Nrcam | 020598 | 219939 | 152002 |
| Nrcam | 020598 | 219906 | 151243 |
| Nrcam | 020598 | 220082 | 151824 |
| Nrcam | 020598 | 217796 | N/A |
| Nrcam | 020598 | 218062 | 151475 |
| Nrg1 | 062991 | 207470 | 146456 |
| Nrg1 | 062991 | 207417 | 146905 |
| Nrg1 | 062991 | 209107 | 146617 |
| Nrg1 | 062991 | 208617 | 146857 |
| Nrg1 | 062991 | 208205 | 147156 |
| Nrg1 | 062991 | 073884 | 073546 |
| Nrg1 | 062991 | 208488 | 147121 |
| Nrg1 | 062991 | 208819 | 146403 |
| Nrg1 | 062991 | 208335 | 146375 |
| Nrg1 | 062991 | 208598 | 146478 |
| Nrg1 | 062991 | 208497 | 146816 |
| Nrg1 | 062991 | 207678 | N/A |
| Nrg1 | 062991 | 208355 | N/A |
| Nrg1 | 062991 | 208931 | 146507 |
| Nrg1 | 062991 | 209022 | 146842 |
| Nrg1 | 062991 | 207584 | N/A |
| Nrg1 | 062991 | 208820 | N/A |
| Nrg1 | 062991 | 208206 | N/A |
| Nrg2 | 060275 | 115713 | 111378 |
| Nrg2 | 060275 | 115712 | 111377 |
| Nrg2 | 060275 | 115705 | N/A |
| Nrg2 | 060275 | 225173 | N/A |
| Nrg3 | 041014 | 166968 | 136884 |
| Nrg3 | 041014 | 168810 | 129783 |
| Nrg3 | 041014 | 173780 | 134727 |
| Nrg3 | 041014 | 176122 | N/A |
| Nrgn | 053310 | 065668 | 070113 |
| Nrgn | 053310 | 182070 | N/A |
| Nrk | 052854 | 113052 | 108675 |
| Nrk | 052854 | 131829 | 115962 |
| Nrk | 052854 | 155201 | N/A |

TABLE 2-continued

| ENSEMBL IDs for mice | | | |
| --- | --- | --- | --- |
| Symbol | MUSG | MUST | MUSP |
| Nrk | 052854 | 142132 | N/A |
| Nrk | 052854 | 064937 | 063397 |
| Nrxn1 | 024109 | 072671 | 072458 |
| Nrxn1 | 024109 | 160844 | 125407 |
| Nrxn1 | 024109 | 197268 | 142815 |
| Nrxn1 | 024109 | 174331 | 133491 |
| Nrxn1 | 024109 | 159778 | 125561 |
| Nrxn1 | 024109 | 173917 | 133389 |
| Nrxn1 | 024109 | 174337 | 133724 |
| Nrxn1 | 024109 | 161402 | 124116 |
| Nrxn1 | 024109 | 173222 | 146701 |
| Nrxn1 | 024109 | 054059 | 057294 |
| Nrxn1 | 024109 | 172466 | 134402 |
| Nrxn1 | 024109 | 160800 | 124561 |
| Nrxn1 | 024109 | 197104 | 142621 |
| Nrxn1 | 024109 | 176918 | N/A |
| Nrxn1 | 024109 | 196269 | N/A |
| Nrxn1 | 024109 | 161102 | N/A |
| Nrxn1 | 024109 | 196559 | 142891 |
| Nrxn1 | 024109 | 176118 | 135241 |
| Nrxn1 | 024109 | 198899 | N/A |
| Nrxn1 | 024109 | 161637 | N/A |
| Nrxn1 | 024109 | 177342 | 135301 |
| Nrxn1 | 024109 | 197224 | 142650 |
| Nrxn1 | 024109 | 162227 | N/A |
| Nrxn1 | 024109 | 160467 | N/A |
| Nrxn1 | 024109 | 159419 | N/A |
| Nrxn1 | 024109 | 162002 | N/A |
| Ntf3 | 049107 | 204542 | 144828 |
| Ntf3 | 049107 | 112244 | 107863 |
| Ntf3 | 049107 | 050484 | 052302 |
| Ntm | 059974 | 075069 | 074578 |
| Ntm | 059974 | 124119 | N/A |
| Ntm | 059974 | 151977 | N/A |
| Ntm | 059974 | 115237 | 110892 |
| Ntm | 059974 | 152513 | N/A |
| Ntm | 059974 | 140118 | 114810 |
| Ntm | 059974 | 155308 | 119030 |
| Ntm | 059974 | 115236 | 110891 |
| Ntm | 059974 | 148606 | N/A |
| Ntm | 059974 | 126044 | N/A |
| Ntm | 059974 | 146651 | N/A |
| Ntn1 | 020902 | 108674 | 104314 |
| Ntn1 | 020902 | 135141 | 121193 |
| Ntn1 | 020902 | 021284 | 021284 |
| Ntn4 | 020019 | 147080 | 123306 |
| Ntn4 | 020019 | 020204 | 020204 |
| Ntsr1 | 027568 | 029084 | 029084 |
| Ntsr1 | 027568 | 170448 | 127548 |
| Ntsr2 | 020591 | 221596 | 152110 |
| Ntsr2 | 020591 | 111064 | 106693 |
| Ntsr2 | 020591 | 220892 | 152290 |
| Ntsr2 | 020591 | 222957 | N/A |
| Ntsr2 | 020591 | 221049 | 152592 |
| Nudt4 | 020029 | 020217 | 020217 |
| Nup62cl | 072944 | 101212 | 098772 |
| Nup62cl | 072944 | 154385 | 121310 |
| Nup62cl | 072944 | 133780 | 116491 |
| Nup62cl | 072944 | 125678 | 116128 |
| Nup62cl | 072944 | 124075 | 122713 |
| Nwd1 | 048148 | 161386 | N/A |
| Nwd1 | 048148 | 161557 | 125470 |
| Nwd1 | 048148 | 161254 | 124804 |
| Nwd1 | 048148 | 228312 | 154488 |
| Nwd1 | 048148 | 160443 | 124446 |
| Nwd1 | 048148 | 163026 | N/A |
| Nwd1 | 048148 | 160912 | N/A |
| Nwd1 | 048148 | 162248 | N/A |
| Nwd1 | 048148 | 093427 | 091135 |
| Nxn | 020844 | 021204 | 021204 |
| Nxn | 020844 | 131472 | N/A |
| Nxpe3 | 075033 | 099705 | 097296 |
| Ogdhl | 021913 | 228529 | 154185 |
| Ogdhl | 021913 | 228286 | N/A |
| Ogdhl | 021913 | 022480 | 022480 |
| Olfm1 | 026833 | 028177 | 028177 |

TABLE 2-continued

| ENSEMBL IDs for mice | | | |
| --- | --- | --- | --- |
| Symbol | MUSG | MUST | MUSP |
| Olfm1 | 026833 | 113920 | 109553 |
| Olfm1 | 026833 | 102879 | 099943 |
| Olfm1 | 026833 | 152415 | N/A |
| Olfm1 | 026833 | 100244 | 097815 |
| Olfm3 | 027965 | 081752 | 080448 |
| Olfm3 | 027965 | 149158 | 121097 |
| Olfm3 | 027965 | 051309 | 060985 |
| Olig1 | 046160 | 056882 | 061408 |
| Olig2 | 039830 | 035608 | 036797 |
| Onecut2 | 045991 | 175965 | 135692 |
| Onecut2 | 045991 | 115145 | 110798 |
| Opalin | 050121 | 087176 | 084422 |
| Ophn1 | 031214 | 033560 | 033560 |
| Ophn1 | 031214 | 142267 | 119361 |
| Ophn1 | 031214 | 156634 | N/A |
| Ophn1 | 031214 | 113826 | 109457 |
| Ophn1 | 031214 | 125150 | N/A |
| Ophn1 | 031214 | 147805 | N/A |
| Ophn1 | 031214 | 156917 | N/A |
| Ophn1 | 031214 | 140598 | N/A |
| Ophn1 | 031214 | 147529 | 121723 |
| Ophn1 | 031214 | 154920 | N/A |
| Oplah | 022562 | 171340 | 129100 |
| Oplah | 022562 | 170261 | N/A |
| Oplah | 022562 | 169664 | N/A |
| Oplah | 022562 | 170063 | N/A |
| Oplah | 022562 | 163127 | N/A |
| Oplah | 022562 | 164189 | 131967 |
| Oplah | 022562 | 163977 | N/A |
| Oplah | 022562 | 210024 | 148028 |
| Oplah | 022562 | 165279 | 127955 |
| Oplah | 022562 | 023222 | 023222 |
| Oprd1 | 050511 | 056336 | 050077 |
| Optc | 010311 | 124051 | 120568 |
| Optc | 010311 | 153617 | 123262 |
| Optc | 010311 | 149380 | 115661 |
| Optc | 010311 | 126123 | 117086 |
| Optc | 010311 | 124245 | N/A |
| Osbp | 024687 | 025590 | 025590 |
| Osbpl10 | 040875 | 183104 | 138287 |
| Osbpl10 | 040875 | 182384 | 138552 |
| Osbpl10 | 040875 | 183141 | 138760 |
| Osbpl10 | 040875 | 182199 | 138206 |
| Osbpl10 | 040875 | 182920 | 138266 |
| Osbpl10 | 040875 | 182363 | N/A |
| Osbpl10 | 040875 | 182413 | N/A |
| Osbpl10 | 040875 | 046627 | 038013 |
| Osbpl3 | 029822 | 114468 | 110112 |
| Osbpl3 | 029822 | 141466 | N/A |
| Osbpl3 | 029822 | 090019 | 087473 |
| Osbpl3 | 029822 | 071728 | 071643 |
| Osbpl3 | 029822 | 114466 | 110110 |
| Osbpl3 | 029822 | 133141 | N/A |
| Osbpl3 | 029822 | 203907 | 145249 |
| Osbpl3 | 029822 | 146341 | 114472 |
| Osbpl3 | 029822 | 136926 | 144934 |
| Osbpl3 | 029822 | 154333 | N/A |
| P2ry1 | 027765 | 029331 | 029331 |
| P2ry1 | 027765 | 193201 | 142006 |
| P2ry1 | 027765 | 193943 | 141371 |
| P2ry12 | 036353 | 196583 | 143036 |
| P2ry12 | 036353 | 050360 | 051353 |
| P2ry12 | 036353 | 199609 | 143521 |
| P2ry12 | 036353 | 199675 | 143706 |
| P2ry12 | 036353 | 170388 | 126819 |
| Pak7 | 039913 | 035264 | 047285 |
| Pak7 | 039913 | 077200 | 076440 |
| Pak7 | 039913 | 143329 | N/A |
| Palm2 | 090053 | 102905 | 099969 |
| Palm2 | 090053 | 102904 | 099968 |
| Palm2 | 090053 | 142556 | 129817 |
| Palm2 | 090053 | 131201 | N/A |
| Pam | 026335 | 159041 | 124284 |
| Pam | 026335 | 058762 | 057112 |
| Pam | 026335 | 161567 | 125418 |
| Pam | 026335 | 162681 | 125133 |

TABLE 2-continued

| ENSEMBL IDs for mice | | | |
|---|---|---|---|
| Symbol | MUSG | MUST | MUSP |
| Pam | 026335 | 159585 | N/A |
| Pam | 026335 | 160210 | N/A |
| Pam | 026335 | 162803 | N/A |
| Pam | 026335 | 159131 | N/A |
| Pam | 026335 | 161071 | N/A |
| Pam | 026335 | 159841 | 124479 |
| Pam | 026335 | 159428 | N/A |
| Pam | 026335 | 162426 | N/A |
| Pam | 026335 | 186731 | N/A |
| Pam | 026335 | 163007 | N/A |
| Pam | 026335 | 097625 | 095228 |
| Panx2 | 058441 | 161372 | 125514 |
| Panx2 | 058441 | 162424 | 124354 |
| Panx2 | 058441 | 159960 | 124928 |
| Paqr6 | 041423 | 147948 | 119656 |
| Paqr6 | 041423 | 147991 | 114166 |
| Paqr6 | 041423 | 149640 | N/A |
| Paqr6 | 041423 | 123200 | N/A |
| Paqr6 | 041423 | 147818 | N/A |
| Pard3 | 025812 | 162309 | 124282 |
| Pard3 | 025812 | 160272 | 125453 |
| Pard3 | 025812 | 162907 | 124319 |
| Pard3 | 025812 | 160717 | 125612 |
| Pard3 | 025812 | 160593 | N/A |
| Pard3 | 025812 | 026921 | 026921 |
| Pard3 | 025812 | 162456 | 124162 |
| Pard3 | 025812 | 162665 | 124718 |
| Pard3 | 025812 | 161348 | 123951 |
| Pard3 | 025812 | 162035 | N/A |
| Pard3 | 025812 | 162176 | 123944 |
| Pard3 | 025812 | 159537 | 124934 |
| Pard3 | 025812 | 161277 | 124789 |
| Pard3 | 025812 | 160766 | 124533 |
| Pard3 | 025812 | 162602 | 125450 |
| Pard3 | 025812 | 162531 | 125610 |
| Pard3 | 025812 | 160581 | 124141 |
| Pard3 | 025812 | 162536 | 125212 |
| Pard3 | 025812 | 161355 | 125064 |
| Pard3 | 025812 | 159141 | 124733 |
| Pard3 | 025812 | 159818 | 124339 |
| Pard3 | 025812 | 163021 | N/A |
| Pard3 | 025812 | 162727 | 124359 |
| Pard3 | 025812 | 163002 | N/A |
| Pard3 | 025812 | 159511 | 124441 |
| Pard3 | 025812 | 159940 | N/A |
| Pard3 | 025812 | 079777 | 078710 |
| Pard3 | 025812 | 108752 | 104383 |
| Pard3b | 052062 | 138768 | N/A |
| Pard3b | 052062 | 075374 | 074837 |
| Pard3b | 052062 | 129030 | N/A |
| Pard3b | 052062 | 188325 | N/A |
| Pard3b | 052062 | 046673 | 040439 |
| Pard3b | 052062 | 094906 | 092510 |
| Pard6g | 056214 | 070219 | 069182 |
| Parm1 | 034981 | 040576 | 042844 |
| Patj | 061859 | 141796 | N/A |
| Patj | 061859 | 041284 | 049176 |
| Patj | 061859 | 107033 | 102648 |
| Patj | 061859 | 107034 | 102649 |
| Patj | 061859 | 107030 | 102645 |
| Patj | 061859 | 136675 | N/A |
| Patj | 061859 | 141965 | N/A |
| Patj | 061859 | 142103 | 116021 |
| Patj | 061859 | 107029 | 102644 |
| Patj | 061859 | 135606 | N/A |
| Patj | 061859 | 134901 | 115936 |
| Patj | 061859 | 102792 | 099854 |
| Patj | 061859 | 030290 | 030290 |
| Pax2 | 004231 | 174490 | 134661 |
| Pax2 | 004231 | 173346 | 134311 |
| Pax2 | 004340 | 004340 | 004340 |
| Pax3 | 004872 | 004994 | 004994 |
| Pax3 | 004872 | 087086 | 084320 |
| Pax3 | 004872 | 172555 | N/A |
| Paxbp1 | 022974 | 118522 | 113835 |
| Paxbp1 | 022974 | 023698 | 023698 |
| Paxbp1 | 022974 | 150397 | N/A |
| Paxbp1 | 022974 | 146281 | N/A |
| Paxbp1 | 022974 | 145136 | 117142 |
| Paxbp1 | 022974 | 128922 | N/A |
| Paxbp1 | 022974 | 124653 | N/A |
| Paxbp1 | 022974 | 127002 | N/A |
| Pbx3 | 038718 | 113132 | 108757 |
| Pbx3 | 038718 | 040638 | 045281 |
| Pbx3 | 038718 | 176213 | N/A |
| Pbx3 | 038718 | 153278 | 123567 |
| Pbx3 | 038718 | 143776 | 119914 |
| Pbx3 | 038718 | 175855 | 135838 |
| Pbx3 | 038718 | 138021 | 135226 |
| Pbx3 | 038718 | 141653 | 115710 |
| Pbx3 | 038718 | 127353 | 114695 |
| Pbx3 | 038718 | 155423 | N/A |
| Pkd1 | 032855 | 228550 | 154062 |
| Pkd1 | 032855 | 035565 | 049296 |
| Pkd1 | 032855 | 228745 | 153873 |
| Pkd1 | 032855 | 227107 | 154792 |
| Pkd1 | 032855 | 226883 | 154668 |
| Pkd1 | 032855 | 226178 | N/A |
| Pkd1 | 032855 | 227836 | 154626 |
| Pkd1 | 032855 | 228750 | N/A |
| Pkd1 | 032855 | 227058 | 153867 |
| Pkd1 | 032855 | 228581 | 154141 |
| Pkd2 | 034462 | 086831 | 084041 |
| Pkd2 | 034462 | 130931 | N/A |
| Pkd2 | 034462 | 133540 | N/A |
| Pcsk1 | 021587 | 022075 | 022075 |
| Pcsk1 | 021587 | 135349 | N/A |
| Pcsk1 | 021587 | 222727 | 152702 |
| Ifrd1 | 001627 | 001672 | 001672 |
| Ifrd1 | 001627 | 164047 | 127553 |
| Ifrd1 | 001627 | 170119 | N/A |
| Ifrd1 | 001627 | 165027 | 133028 |
| Ifrd1 | 001627 | 171530 | 128635 |
| Ifrd1 | 001627 | 169926 | 127673 |
| Ifrd1 | 001627 | 169319 | 130824 |
| Ifrd1 | 001627 | 170752 | N/A |
| Ifrd1 | 001627 | 164354 | 130846 |
| Ifrd1 | 001627 | 171553 | N/A |
| Pcsk5 | 024713 | 025618 | 025618 |
| Pcsk5 | 024713 | 050715 | 050272 |
| Pcsk5 | 024713 | 025618 | 025618 |
| Pcsk5 | 024713 | 050715 | 050272 |
| Pcsk7 | 035382 | 039059 | 047508 |
| Pcsk7 | 035382 | 215535 | N/A |
| Pcsk7 | 035382 | 215189 | 150500 |
| Pcsk7 | 035382 | 216672 | 150393 |
| Pcsk7 | 035382 | 213854 | 150379 |
| Pcsk7 | 035382 | 216614 | N/A |
| Pcsk7 | 035382 | 216504 | N/A |
| Pcsk7 | 035382 | 216514 | N/A |
| Pcsk7 | 035382 | 214425 | N/A |
| Pcdh1 | 051375 | 160721 | 124732 |
| Pcdh1 | 051375 | 161701 | 125576 |
| Pcdh1 | 051375 | 057185 | 055199 |
| Pcdh1 | 051375 | 159405 | 125309 |
| Pcdh1 | 051375 | 194312 | 141877 |
| Pcdh1 | 051375 | 193828 | 142328 |
| Pcdh15 | 052613 | 123398 | N/A |
| Pcdh15 | 052613 | 148572 | N/A |
| Pcdh15 | 052613 | 156999 | N/A |
| Pcdh15 | 052613 | 193174 | 142238 |
| Pcdh15 | 052613 | 105426 | 101066 |
| Pcdh15 | 052613 | 129404 | 117731 |
| Pcdh15 | 052613 | 131321 | 122911 |
| Pcdh15 | 052613 | 126920 | 121939 |
| Pcdh15 | 052613 | 147189 | 122940 |
| Pcdh15 | 052613 | 105424 | 101064 |
| Pcdh15 | 052613 | 092420 | 090076 |
| Pcdh15 | 052613 | 136096 | 121534 |
| Pcdh15 | 052613 | 105429 | 101069 |
| Pcdh15 | 052613 | 125055 | 114326 |
| Pcdh15 | 052613 | 193361 | 141792 |

TABLE 2-continued

| ENSEMBL IDs for mice | | | |
|---|---|---|---|
| Symbol | MUSG | MUST | MUSP |
| Pcdh15 | 052613 | 131724 | 122466 |
| Pcdh15 | 052613 | 152655 | 118201 |
| Pcdh15 | 052613 | 144302 | 122606 |
| Pcdh15 | 052613 | 151116 | 119662 |
| Pcdh15 | 052613 | 155701 | 135495 |
| Pcdh15 | 052613 | 152819 | 123647 |
| Pcdh15 | 052613 | 125517 | 115399 |
| Pcdh15 | 052613 | 124046 | 121130 |
| Pcdh15 | 052613 | 146682 | 134863 |
| Pcdh15 | 052613 | 177107 | 135501 |
| Pcdh15 | 052613 | 149977 | 118833 |
| Pcdh15 | 052613 | 191854 | 141973 |
| Pcdh15 | 052613 | 134009 | 120618 |
| Pcdh15 | 052613 | 177420 | 135849 |
| Pcdh15 | 052613 | 125006 | 120056 |
| Pcdh15 | 052613 | 191709 | 142313 |
| Pcdh15 | 052613 | 193739 | 142173 |
| Pcdh15 | 052613 | 195531 | 141920 |
| Pcdh15 | 052613 | 147455 | N/A |
| Pcdh15 | 052613 | 194315 | 141594 |
| Pcdh15 | 052613 | 139106 | N/A |
| Pcdh15 | 052613 | 128843 | N/A |
| Pcdh15 | 052613 | 127928 | N/A |
| Pcdh15 | 052613 | 194729 | N/A |
| Pcdh15 | 052613 | 192370 | N/A |
| Pcdh15 | 052613 | 064562 | 068561 |
| Pcdh17 | 035566 | 071370 | 071325 |
| Pcdh17 | 035566 | 226362 | N/A |
| Pcdh9 | 055421 | 195826 | 141396 |
| Pcdh9 | 055421 | 193901 | 141759 |
| Pcdh9 | 055421 | 192221 | 142260 |
| Pcdh9 | 055421 | 195376 | 142224 |
| Pcdh9 | 055421 | 194129 | 141205 |
| Pcdh9 | 055421 | 192817 | N/A |
| Pcdh9 | 055421 | 194056 | 141602 |
| Pcdh9 | 055421 | 068992 | 070935 |
| Pcdha1 | 103442 | 193839 | 142308 |
| Pcdha1 | 103442 | 070797 | 068828 |
| Pcdha3 | 102312 | 192503 | 141989 |
| Pcp2 | 004630 | 136105 | 121079 |
| Pcp2 | 004630 | 145855 | N/A |
| Pcp2 | 004630 | 142431 | 121403 |
| Pcp2 | 004630 | 133459 | 122902 |
| Pcp2 | 004630 | 004749 | 004749 |
| Pcp2 | 004630 | 128566 | 146683 |
| Pcp2 | 004630 | 144977 | 146399 |
| Pcp4 | 090223 | 061739 | 062539 |
| Pcsk6 | 030513 | 176199 | 135851 |
| Pcsk6 | 030513 | 055576 | 053742 |
| Pcsk6 | 030513 | 098391 | 095992 |
| Pcsk6 | 030513 | 176209 | 135033 |
| Pcsk6 | 030513 | 177369 | N/A |
| Pcsk6 | 030513 | 177272 | N/A |
| Pcx | 024892 | 224726 | 153479 |
| Pcx | 024892 | 223659 | N/A |
| Pcx | 024892 | 225189 | 152918 |
| Pcx | 024892 | 113825 | 109456 |
| Pcx | 024892 | 068004 | 063825 |
| Pdc | 006007 | 191228 | 141136 |
| Pdc | 006007 | 186572 | 140843 |
| Pdc | 006007 | 185698 | 140669 |
| Pdc | 006007 | 165062 | 131631 |
| Pde1a | 059173 | 102655 | 099715 |
| Pde1a | 059173 | 183775 | 139327 |
| Pde1a | 059173 | 102653 | 099713 |
| Pde1a | 059173 | 090756 | 088260 |
| Pde1a | 059173 | 102652 | 099712 |
| Pde1a | 059173 | 102651 | 099711 |
| Pde1a | 059173 | 134739 | 120188 |
| Pde1a | 059173 | 146076 | N/A |
| Pde1a | 059173 | 125887 | N/A |
| Pde1a | 059173 | 102654 | 099714 |
| Pde1b | 022489 | 226468 | 153865 |
| Pde1b | 022489 | 023132 | 023132 |
| Pde1b | 022489 | 226493 | 154483 |
| Pde1b | 022489 | 227955 | 153722 |

TABLE 2-continued

| ENSEMBL IDs for mice | | | |
|---|---|---|---|
| Symbol | MUSG | MUST | MUSP |
| Pde1b | 022489 | 227925 | N/A |
| Pde1c | 004347 | 044505 | 046601 |
| Pde1c | 004347 | 203372 | 145508 |
| Pde1c | 004347 | 203967 | N/A |
| Pde1c | 004347 | 114327 | 109966 |
| Pde1c | 004347 | 170774 | 133170 |
| Pde1c | 004347 | 203462 | 145419 |
| Pde1c | 004347 | 168944 | 128364 |
| Pde1c | 004347 | 166102 | 131350 |
| Pde1c | 004347 | 166890 | 131892 |
| Pde1c | 004347 | 164752 | 129185 |
| Pde1c | 004347 | 164037 | 130139 |
| Pde1c | 004347 | 204821 | N/A |
| Pde1c | 004347 | 203492 | N/A |
| Pde1c | 004347 | 203689 | N/A |
| Pde3b | 030671 | 032909 | 032909 |
| Pde3b | 030671 | 140007 | N/A |
| Pde3b | 030671 | 210411 | N/A |
| Pde3b | 030671 | 149455 | N/A |
| Pde4d | 021699 | 133929 | N/A |
| Pde4d | 021699 | 151111 | N/A |
| Pde4d | 021699 | 122041 | 113488 |
| Pde4d | 021699 | 129374 | N/A |
| Pde4d | 021699 | 138938 | N/A |
| Pde4d | 021699 | 120671 | 112991 |
| Pde4d | 021699 | 153234 | 121592 |
| Pde4d | 021699 | 119507 | 114089 |
| Pde4d | 021699 | 079975 | 078891 |
| Pde4d | 021699 | 135275 | 119583 |
| Pde4d | 021699 | 074103 | 073742 |
| Pde4d | 021699 | 134973 | N/A |
| Pde4d | 021699 | 152630 | N/A |
| Pde4d | 021699 | 119672 | 113567 |
| Pde4d | 021699 | 120664 | 113024 |
| Pde4d | 021699 | 151429 | N/A |
| Pde4d | 021699 | 117879 | 112774 |
| Pde4d | 021699 | 117420 | 113610 |
| Pde4d | 021699 | 155459 | 114945 |
| Pde4d | 021699 | 177907 | 136485 |
| Pde5a | 053965 | 066728 | 069011 |
| Pde5a | 053965 | 200389 | 143042 |
| Pde5a | 053965 | 198314 | N/A |
| Pde5a | 053965 | 199253 | N/A |
| Pde7b | 019990 | 020165 | 020165 |
| Pde7b | 019990 | 169016 | 130596 |
| Pde7b | 019990 | 169404 | 132378 |
| Pde7b | 019990 | 170265 | 126324 |
| Pde7b | 019990 | 164195 | 126913 |
| Pde7b | 019990 | 217240 | N/A |
| Pde7b | 019990 | 170683 | N/A |
| Pde7b | 019990 | 166147 | N/A |
| Pde8a | 025584 | 026672 | 026672 |
| Pde8a | 025584 | 128154 | N/A |
| Pde8a | 025584 | 130494 | N/A |
| Pde8b | 021684 | 162412 | 124409 |
| Pde8b | 021684 | 162670 | 125237 |
| Pde8b | 021684 | 162292 | 124068 |
| Pde8b | 021684 | 162882 | N/A |
| Pde8b | 021684 | 162153 | 124704 |
| Pde8b | 021684 | 172104 | 128987 |
| Pde8b | 021684 | 067082 | 070465 |
| Pde8b | 021684 | 022192 | 022192 |
| Pde8b | 021684 | 159608 | 125191 |
| Pde8b | 021684 | 160957 | 125115 |
| Pde8b | 021684 | 160412 | N/A |
| Pde8b | 021684 | 162328 | N/A |
| Pde8b | 021684 | 159598 | 124447 |
| Pde8b | 021684 | 162716 | N/A |
| Pde9a | 041119 | 047168 | 038005 |
| Pde9a | 041119 | 143549 | 117911 |
| Pde9a | 041119 | 131417 | 115188 |
| Pde9a | 041119 | 134525 | 121003 |
| Pde9a | 041119 | 127929 | 117611 |
| Pde9a | 041119 | 137927 | 121126 |
| Pde9a | 041119 | 124902 | 118869 |
| Pde9a | 041119 | 154567 | N/A |

TABLE 2-continued

| ENSEMBL IDs for mice | | | |
|---|---|---|---|
| Symbol | MUSG | MUST | MUSP |
| Pde9a | 041119 | 141314 | 117364 |
| Pde9a | 041119 | 136384 | 116724 |
| Pde9a | 041119 | 130547 | N/A |
| Pde9a | 041119 | 155395 | N/A |
| Pde9a | 041119 | 154392 | 117065 |
| Pde9a | 041119 | 155113 | N/A |
| Pdgfc | 028019 | 029652 | 029652 |
| Pdgfc | 028019 | 129285 | 118970 |
| Pdgfc | 028019 | 143721 | 122047 |
| Pdgfd | 032006 | 058692 | 056240 |
| Pdgfd | 032006 | 168039 | 128388 |
| Pdgfd | 032006 | 214892 | 149162 |
| Pdgfra | 029231 | 202681 | 143906 |
| Pdgfra | 029231 | 000476 | 000476 |
| Pdgfra | 029231 | 202186 | 144543 |
| Pdgfra | 029231 | 201711 | 143891 |
| Pdgfra | 029231 | 201241 | N/A |
| Pdgfra | 029231 | 202161 | 144485 |
| Pdgfra | 029231 | 168162 | 127173 |
| Pdgfra | 029231 | 202992 | 144132 |
| Pdgfra | 029231 | 200822 | 144634 |
| Pdk3 | 035232 | 045748 | 036604 |
| Pdk3 | 035232 | 134502 | N/A |
| Pdk3 | 035232 | 154717 | N/A |
| Pdlim4 | 020388 | 018755 | 018755 |
| Pdlim4 | 020388 | 093109 | 090797 |
| Pdlim4 | 020388 | 144477 | 121248 |
| Pdlim4 | 020388 | 127271 | N/A |
| Pdlim4 | 020388 | 151948 | N/A |
| Pdzd3 | 032105 | 034618 | 034618 |
| Pdzd3 | 032105 | 213186 | N/A |
| Pdzph1 | 024227 | 177108 | N/A |
| Pdzph1 | 024227 | 025064 | 025064 |
| Pdzph1 | 024227 | 177360 | 135180 |
| Pdzm4 | 036218 | 169942 | 133159 |
| Pdzm4 | 036218 | 035399 | 040456 |
| Pea15a | 013698 | 013842 | 013842 |
| Pea15a | 013698 | 111247 | 106878 |
| Pea15a | 013698 | 125361 | N/A |
| Pea15a | 013698 | 155109 | 117735 |
| Pea15a | 013698 | 152432 | N/A |
| Peg3 | 002265 | 051209 | 050750 |
| Peg3 | 002265 | 150182 | 116161 |
| Peg3 | 002265 | 143703 | 122423 |
| Peg3 | 002265 | 155910 | N/A |
| Penk | 045573 | 070375 | 066822 |
| Penk | 045573 | 133567 | 122389 |
| Pet100 | 087687 | 208950 | 146433 |
| Pet100 | 087687 | 208185 | N/A |
| Pet100 | 087687 | 156380 | 137626 |
| Pet100 | 087687 | 207257 | N/A |
| Pet100 | 087687 | 207428 | 146950 |
| Pet100 | 087687 | 207389 | 146942 |
| Pex5l | 027674 | 194016 | 142196 |
| Pex5l | 027674 | 193681 | 141454 |
| Pex5l | 027674 | 192093 | 141387 |
| Pex5l | 027674 | 193289 | 142008 |
| Pex5l | 027674 | 078226 | 077353 |
| Pex5l | 027674 | 108224 | 103859 |
| Pex5l | 027674 | 108226 | 103861 |
| Pex5l | 027674 | 108221 | 103856 |
| Pex5l | 027674 | 108219 | N/A |
| Pex5l | 027674 | 155264 | N/A |
| Pex5l | 027674 | 194627 | N/A |
| Pex5l | 027674 | 108225 | 103860 |
| Pfkfb4 | 025648 | 198140 | 142378 |
| Pfkfb4 | 025648 | 051873 | 057197 |
| Pfkfb4 | 025648 | 198277 | N/A |
| Pfkfb4 | 025648 | 199620 | N/A |
| Pfkfb4 | 025648 | 196249 | 143249 |
| Pfkfb4 | 025648 | 199591 | 142992 |
| Pfkfb4 | 025648 | 199184 | N/A |
| Pfkfb4 | 025648 | 200229 | N/A |
| Pfkfb4 | 025648 | 200015 | 142339 |
| Pfkfb4 | 025648 | 198763 | N/A |
| Pfkm | 033065 | 163507 | 132803 |

TABLE 2-continued

| ENSEMBL IDs for mice | | | |
|---|---|---|---|
| Symbol | MUSG | MUST | MUSP |
| Pfkm | 033065 | 051226 | 059801 |
| Pfkp | 021196 | 131648 | N/A |
| Pfkp | 021196 | 138703 | 117030 |
| Pfkp | 021196 | 021614 | 021614 |
| Pfkp | 021196 | 142972 | 114439 |
| Pfkp | 021196 | 154100 | 116523 |
| Pfkp | 021196 | 133041 | 123662 |
| Pfkp | 021196 | 142372 | N/A |
| Pfkp | 021196 | 151894 | N/A |
| Pfkp | 021196 | 144053 | N/A |
| Pfkp | 021196 | 148999 | N/A |
| Pfkp | 021196 | 135761 | N/A |
| Pfkp | 021196 | 137327 | N/A |
| Pfkp | 021196 | 136585 | 115313 |
| Pgghg | 062031 | 164337 | N/A |
| Pgghg | 062031 | 164580 | 128214 |
| Pgghg | 062031 | 169736 | N/A |
| Pgghg | 062031 | 168084 | N/A |
| Pgghg | 062031 | 079403 | 078372 |
| Pgghg | 062031 | 163094 | 128478 |
| Pgm2l1 | 030729 | 084935 | 081998 |
| Pgm2l1 | 030729 | 208158 | N/A |
| Pgm2l1 | 030729 | 162108 | 124851 |
| Pgm2l1 | 030729 | 054436 | 054782 |
| Pgr | 031870 | 070463 | 063562 |
| Pgr | 031870 | 098986 | 096584 |
| Pgr | 031870 | 151080 | N/A |
| Pgr | 031870 | 189181 | 140124 |
| Phf21b | 016624 | 016768 | 016768 |
| Phf21b | 016624 | 162996 | N/A |
| Phf21b | 016624 | 159939 | 125355 |
| Phf21b | 016624 | 162044 | 124941 |
| Phf21b | 016624 | 159502 | N/A |
| Phf21b | 016624 | 160389 | N/A |
| Phf24 | 036062 | 151824 | N/A |
| Phf24 | 036062 | 132173 | 138443 |
| Phf24 | 036062 | 107975 | 103609 |
| Phf24 | 036062 | 107976 | 103610 |
| Phf24 | 036062 | 069184 | 071011 |
| Phf24 | 036062 | 124380 | 138593 |
| Phf24 | 036062 | 139100 | 138130 |
| Phf24 | 036062 | 138425 | 115816 |
| Phf24 | 036062 | 131234 | 138332 |
| Phkg1 | 025537 | 026617 | 026617 |
| Phkg1 | 025537 | 154932 | 122040 |
| Phkg1 | 025537 | 140667 | 117510 |
| Phkg1 | 025537 | 154495 | N/A |
| Phkg1 | 025537 | 200832 | N/A |
| Phkg1 | 025537 | 200922 | N/A |
| Phox2a | 007946 | 008090 | 008090 |
| Phox2a | 007946 | 209878 | N/A |
| Phyhip | 003469 | 003561 | 003561 |
| Phyhip | 003469 | 159180 | 125254 |
| Pid1 | 045658 | 168574 | 127716 |
| Pid1 | 045658 | 176559 | 135164 |
| Pid1 | 045658 | 175948 | N/A |
| Pid1 | 045658 | 176720 | 134961 |
| Pid1 | 045658 | 175996 | 134979 |
| Pid1 | 045658 | 176822 | 135425 |
| Pid1 | 045658 | 177458 | 135120 |
| Pid1 | 045658 | 187992 | N/A |
| Piezo2 | 041482 | 047480 | 040019 |
| Piezo2 | 041482 | 137141 | 117107 |
| Piezo2 | 041482 | 132576 | N/A |
| Piezo2 | 041482 | 123322 | N/A |
| Piezo2 | 041482 | 183217 | 138758 |
| Piezo2 | 041482 | 182233 | 138170 |
| Piezo2 | 041482 | 182166 | 138754 |
| Piezo2 | 041482 | 182177 | N/A |
| Piezo2 | 041482 | 046860 | 036099 |
| Piga | 031381 | 208741 | 147146 |
| Piga | 031381 | 112257 | 137831 |
| Piga | 031381 | 033754 | 033754 |
| Piga | 031381 | 151911 | 138077 |
| Piga | 031381 | 208697 | 146731 |
| Piga | 031381 | 208261 | 146808 |

TABLE 2-continued

| | ENSEMBL IDs for mice | | |
| --- | --- | --- | --- |
| Symbol | MUSG | MUST | MUSP |
| Piga | 031381 | 112255 | 107874 |
| Piga | 031381 | 133813 | 122176 |
| Piga | 031381 | 155849 | N/A |
| Pigh | 021120 | 072154 | 072018 |
| Pigh | 021120 | 217998 | 151930 |
| Pigh | 021120 | 217979 | N/A |
| Pigs | 041958 | 048073 | 044871 |
| Pigz | 045625 | 052174 | 057509 |
| Pigz | 045625 | 151412 | N/A |
| Pigz | 045625 | 134928 | N/A |
| Pigz | 045625 | 134666 | N/A |
| Pih1h3b | 042433 | 044806 | 048754 |
| Pik3c2b | 026447 | 153707 | 115469 |
| Pik3c2b | 026447 | 145153 | N/A |
| Pik3c2b | 026447 | 124934 | N/A |
| Pik3c2b | 026447 | 077730 | 076911 |
| Pik3r1 | 041417 | 055518 | 056774 |
| Pik3r1 | 041417 | 035532 | 047004 |
| Pik3r1 | 041417 | 187009 | 140256 |
| Pik3r1 | 041417 | 185795 | 140312 |
| Pik3r1 | 041417 | 190171 | N/A |
| Pik3r1 | 041417 | 185701 | N/A |
| Pik3r1 | 041417 | 189426 | N/A |
| Pitpnm3 | 040543 | 075258 | 074737 |
| Pitpnm3 | 040543 | 134210 | N/A |
| Pitpnm3 | 040543 | 132781 | N/A |
| Pitpnm3 | 040543 | 142471 | N/A |
| Pitpnm3 | 040543 | 108508 | 104148 |
| Pkd2l1 | 037578 | 042026 | 045675 |
| Pkd2l1 | 037578 | 161357 | N/A |
| Pkia | 027499 | 192468 | 142120 |
| Pkia | 027499 | 028999 | 028999 |
| Pkia | 027499 | 193330 | 141466 |
| Pknox2 | 035934 | 177218 | 135581 |
| Pknox2 | 035934 | 039674 | 035806 |
| Pknox2 | 035934 | 175938 | 138866 |
| Pknox2 | 035934 | 177080 | N/A |
| Pknox2 | 035934 | 176562 | N/A |
| Pknox2 | 035934 | 176622 | N/A |
| Pknox2 | 035934 | 177444 | 135641 |
| Pknox2 | 035934 | 188348 | 139976 |
| Pknox2 | 035934 | 188057 | 140793 |
| Pknox2 | 035934 | 189294 | 139728 |
| Pknox2 | 035934 | 188433 | N/A |
| Pknox2 | 035934 | 213653 | N/A |
| Pknox2 | 035934 | 215175 | N/A |
| Pknox2 | 035934 | 080754 | 079578 |
| Pkp3 | 054065 | 106039 | 101654 |
| Pkp3 | 054065 | 159375 | 124572 |
| Pkp3 | 054065 | 066873 | 069961 |
| Pkp3 | 054065 | 163041 | 124434 |
| Pkp3 | 054065 | 160869 | 124013 |
| Pkp3 | 054065 | 160615 | N/A |
| Pkp3 | 054065 | 160403 | N/A |
| Pkp3 | 054065 | 159253 | N/A |
| Pkp3 | 054065 | 161142 | N/A |
| Pla2g16 | 060675 | 025925 | 025925 |
| Pla2g16 | 060675 | 136756 | 115151 |
| Pla2g16 | 060675 | 136465 | 119403 |
| Pla2g16 | 060675 | 141887 | 123524 |
| Pla2g4a | 056220 | 070200 | 070868 |
| Pla2g4a | 056220 | 111926 | 107557 |
| Pla2g4a | 056220 | 190507 | 139851 |
| Pla2g4a | 056220 | 155438 | N/A |
| Pla2g4a | 056220 | 142040 | N/A |
| Pla2g4a | 056220 | 134676 | N/A |
| Pla2g4e | 050211 | 090071 | 087525 |
| Pla2g4e | 050211 | 127009 | N/A |
| Pla2g4e | 050211 | 136845 | N/A |
| Pla2g4e | 050211 | 152263 | N/A |
| Pla2g5 | 041193 | 102512 | 099570 |
| Pla2g5 | 041193 | 102513 | 099571 |
| Pla2g5 | 041193 | 102511 | 099569 |
| Pla2g5 | 041193 | 127183 | N/A |
| Pla2g5 | 041193 | 136393 | N/A |
| Pla2g5 | 041193 | 140117 | N/A |

TABLE 2-continued

| | ENSEMBL IDs for mice | | |
| --- | --- | --- | --- |
| Symbol | MUSG | MUST | MUSP |
| Pla2g5 | 041193 | 154844 | N/A |
| Pla2g5 | 041193 | 140100 | N/A |
| Pla2g5 | 041193 | 030524 | 030524 |
| Pla2g7 | 023913 | 167214 | 130404 |
| Pla2g7 | 023913 | 024706 | 024706 |
| Pla2g7 | 023913 | 167418 | 131898 |
| Pla2g7 | 023913 | 165706 | N/A |
| Pla2g7 | 023913 | 169694 | 132027 |
| Pla2g7 | 023913 | 163489 | N/A |
| Plag1 | 003282 | 003369 | 003369 |
| Plag1 | 003282 | 137439 | 117532 |
| Plag1 | 003282 | 151543 | 119937 |
| Plag1 | 003282 | 147035 | N/A |
| Plat | 031538 | 210960 | N/A |
| Plat | 031538 | 033941 | 033941 |
| Plat | 031538 | 211033 | N/A |
| Plcb1 | 051177 | 131552 | 118756 |
| Plcb1 | 051177 | 110116 | 105743 |
| Plcb1 | 051177 | 130524 | N/A |
| Plcb1 | 051177 | 202531 | N/A |
| Plcb1 | 051177 | 070724 | 064844 |
| Plcb1 | 051177 | 129382 | N/A |
| Plcb1 | 051177 | 201485 | 144399 |
| Plcb1 | 051177 | 201524 | N/A |
| Plce1 | 024998 | 181994 | N/A |
| Plce1 | 024998 | 182481 | 138360 |
| Plce1 | 024998 | 169713 | 130604 |
| Plce1 | 024998 | 182267 | 138330 |
| Plce1 | 024998 | 182999 | 138098 |
| Plce1 | 024998 | 182589 | N/A |
| Plce1 | 024998 | 183131 | N/A |
| Plch1 | 036834 | 048134 | 047693 |
| Plch1 | 036834 | 159374 | N/A |
| Plch1 | 036834 | 159982 | N/A |
| Plch1 | 036834 | 084105 | 081122 |
| Plch1 | 036834 | 162269 | 124463 |
| Plch1 | 036834 | 159676 | 124632 |
| Plch1 | 036834 | 059973 | 058524 |
| Plch1 | 036834 | 177143 | 135424 |
| Plch1 | 036834 | 176861 | 135562 |
| Plch1 | 036834 | 175947 | 135353 |
| Plch1 | 036834 | 159188 | 124491 |
| Plch1 | 036834 | 161052 | 125581 |
| Plch1 | 036834 | 160638 | 123921 |
| Plcl1 | 038349 | 042986 | 037854 |
| Plcl1 | 038349 | 187059 | N/A |
| Pld5 | 055214 | 125404 | 121428 |
| Pld5 | 055214 | 065967 | 069326 |
| Pld5 | 055214 | 156184 | N/A |
| Pld5 | 055214 | 144340 | N/A |
| Pld5 | 055214 | 111166 | 106796 |
| Pld5 | 055214 | 111167 | 106797 |
| Plekhd1 | 066438 | 153762 | N/A |
| Plekhd1 | 066438 | 142760 | 121812 |
| Plekhd1 | 066438 | 152465 | N/A |
| Plekhd1 | 066438 | 140770 | 119711 |
| Plekhg3 | 052609 | 217730 | 151564 |
| Plekhg3 | 052609 | 075249 | 074729 |
| Plekhg3 | 052609 | 218461 | N/A |
| Plekhg3 | 052609 | 219063 | 151851 |
| Plekhg3 | 052609 | 218380 | 151867 |
| Plekhg3 | 052609 | 219751 | 151704 |
| Plekhg3 | 052609 | 218357 | N/A |
| Plekhg3 | 052609 | 219426 | N/A |
| Plekhg3 | 052609 | 218427 | N/A |
| Plekhh1 | 060716 | 039928 | 049460 |
| Plekhh1 | 060716 | 217954 | 151944 |
| Plekhh1 | 060716 | 219956 | 151747 |
| Plekhh1 | 060716 | 219946 | N/A |
| Plekhh2 | 040852 | 047206 | 039628 |
| Plekho2 | 050721 | 214740 | N/A |
| Plekho2 | 050721 | 213554 | N/A |
| Plekho2 | 050721 | 068944 | 063677 |
| Plekho2 | 050721 | 213652 | N/A |
| Pllp | 031775 | 034227 | 034227 |
| Pllp | 031775 | 212555 | N/A |

TABLE 2-continued

ENSEMBL IDs for mice

| Symbol | MUSG | MUST | MUSP |
|---|---|---|---|
| Pllp | 031775 | 213043 | 148729 |
| Plp1 | 031425 | 033800 | 033800 |
| Plp1 | 031425 | 113085 | 108708 |
| Plp1 | 031425 | 125644 | N/A |
| Plp1 | 031425 | 144880 | N/A |
| Plpp3 | 028517 | 064139 | 065719 |
| Plpp4 | 070366 | 094018 | 091557 |
| Plpp4 | 070366 | 206551 | N/A |
| Plpp4 | 070366 | 206918 | N/A |
| Plpp4 | 070366 | 205630 | 145851 |
| Plpp4 | 070366 | 205896 | 145944 |
| Plppr4 | 044667 | 061071 | 052306 |
| Plppr4 | 044667 | 125664 | N/A |
| Plppr4 | 044667 | 197743 | 143753 |
| Pls1 | 049493 | 093800 | 091317 |
| Pls1 | 049493 | 119760 | 113200 |
| Pls1 | 049493 | 135816 | N/A |
| Plscr1 | 032369 | 093801 | 091318 |
| Plscr1 | 032369 | 186364 | 139479 |
| Plscr1 | 032369 | 187952 | N/A |
| Plscr4 | 032377 | 034941 | 034941 |
| Plscr4 | 032377 | 143866 | N/A |
| Pltp | 017754 | 109316 | 104939 |
| Pltp | 017754 | 109317 | 104940 |
| Pltp | 017754 | 059954 | 061519 |
| Pltp | 017754 | 142603 | N/A |
| Pltp | 017754 | 148912 | N/A |
| Pltp | 017754 | 156255 | 119955 |
| Pltp | 017754 | 128110 | 122760 |
| Plxdc1 | 017417 | 017561 | 017561 |
| Plxdc1 | 017417 | 107565 | 103191 |
| Plxdc1 | 017417 | 141708 | N/A |
| Plxdc1 | 017417 | 107564 | 103190 |
| Plxna4 | 029765 | 115096 | 110748 |
| Plxna4 | 029765 | 200732 | N/A |
| Plxnb1 | 053646 | 072093 | 071966 |
| Plxnb1 | 053646 | 131462 | 115265 |
| Plxnb1 | 053646 | 130366 | 114358 |
| Plxnb1 | 053646 | 192988 | 142431 |
| Plxnb1 | 053646 | 195364 | N/A |
| Plxnb1 | 053646 | 192117 | N/A |
| Plxnb1 | 053646 | 194734 | N/A |
| Plxnb3 | 031385 | 149478 | N/A |
| Plxnb3 | 031385 | 146812 | N/A |
| Plxnb3 | 031385 | 147127 | N/A |
| Plxnb3 | 031385 | 002079 | 002079 |
| Plxnb3 | 031385 | 155096 | N/A |
| Plxnc1 | 074785 | 099337 | 096939 |
| Plxnc1 | 074785 | 218839 | N/A |
| Plxnc1 | 074785 | 180514 | N/A |
| Plxnc1 | 074785 | 181244 | 138038 |
| Plxnc1 | 074785 | 180573 | N/A |
| Pmepa1 | 038400 | 124124 | N/A |
| Pmepa1 | 038400 | 139306 | 115534 |
| Pmepa1 | 038400 | 036248 | 039950 |
| Pmp2 | 052468 | 029034 | 029034 |
| Pmp22 | 018217 | 018361 | 018361 |
| Pmp22 | 018217 | 108702 | 104342 |
| Pmp22 | 018217 | 108701 | 104341 |
| Pmp22 | 018217 | 140648 | N/A |
| Pmp22 | 018217 | 108700 | 104340 |
| Polr2a | 005198 | 058470 | 050771 |
| Polr2a | 005198 | 156588 | N/A |
| Polr2a | 005198 | 151586 | N/A |
| Polr2a | 005198 | 071213 | 071200 |
| Pon2 | 032667 | 057792 | 062670 |
| Pon2 | 032667 | 123838 | N/A |
| Pon2 | 032667 | 135342 | N/A |
| Pon2 | 032667 | 203882 | N/A |
| Por | 005514 | 153500 | 121531 |
| Por | 005514 | 150058 | N/A |
| Por | 005514 | 153515 | 121022 |
| Por | 005514 | 005651 | 005651 |
| Por | 005514 | 122113 | 112924 |
| Por | 005514 | 147515 | N/A |
| Por | 005514 | 127096 | 119138 |

TABLE 2-continued

ENSEMBL IDs for mice

| Symbol | MUSG | MUST | MUSP |
|---|---|---|---|
| Por | 005514 | 149684 | N/A |
| Por | 005514 | 132084 | N/A |
| Pparg | 000440 | 171644 | 131962 |
| Pparg | 000440 | 203732 | 145525 |
| Pparg | 000440 | 204305 | 145083 |
| Pparg | 000440 | 203308 | N/A |
| Pparg | 000440 | 205213 | 144975 |
| Pparg | 000440 | 000450 | 000450 |
| Pparg | 000440 | 203896 | N/A |
| Ppfia4 | 026458 | 168515 | 128314 |
| Ppfia4 | 026458 | 186730 | 139800 |
| Ppfia4 | 026458 | 186964 | N/A |
| Ppfia4 | 026458 | 189862 | N/A |
| Ppfia4 | 026458 | 189361 | 139833 |
| Ppfia4 | 026458 | 186553 | N/A |
| Ppfibp1 | 016487 | 133825 | N/A |
| Ppfibp1 | 016487 | 155415 | 121270 |
| Ppfibp1 | 016487 | 204028 | N/A |
| Ppfibp1 | 016487 | 136837 | 114340 |
| Ppfibp1 | 016487 | 123902 | N/A |
| Ppfibp1 | 016487 | 149203 | N/A |
| Ppfibp1 | 016487 | 126774 | N/A |
| Ppfibp1 | 016487 | 203730 | 145088 |
| Ppfibp1 | 016487 | 111623 | 107250 |
| Ppfibp1 | 016487 | 204660 | 144887 |
| Ppfibp1 | 016487 | 154221 | 122515 |
| Ppfibp1 | 016487 | 016631 | 016631 |
| Ppfibp2 | 036528 | 207852 | N/A |
| Ppfibp2 | 036528 | 040056 | 042574 |
| Ppfibp2 | 036528 | 208504 | N/A |
| Ppfibp2 | 036528 | 208956 | 146889 |
| Ppfibp2 | 036528 | 098134 | 095738 |
| Ppfibp2 | 036528 | 208159 | 147038 |
| Ppm1e | 046442 | 055438 | 061278 |
| Ppm1e | 046442 | 155154 | N/A |
| Ppm1h | 034613 | 162853 | N/A |
| Ppm1h | 034613 | 161487 | 124982 |
| Ppm1h | 034613 | 067918 | 066561 |
| Ppm1h | 034613 | 160315 | N/A |
| Ppm1h | 034613 | 159885 | N/A |
| Ppm1h | 034613 | 161065 | N/A |
| Ppm1h | 034613 | 161371 | N/A |
| Ppm1h | 034613 | 162969 | 124006 |
| Ppp1r14a | 037166 | 207714 | 146684 |
| Ppp1r14a | 037166 | 048187 | 035642 |
| Ppp1r16b | 037754 | 052927 | 062615 |
| Ppp1r16b | 037754 | 045503 | 039540 |
| Ppp1r16b | 037754 | 129902 | N/A |
| Ppp1r16b | 037754 | 145073 | 117310 |
| Ppp1r16b | 037754 | 103116 | 099405 |
| Ppp1r17 | 002930 | 052827 | 059708 |
| Ppp4r4 | 021209 | 021631 | 021631 |
| Ppp4r4 | 021209 | 189871 | 139786 |
| Ppp4r4 | 021209 | 187155 | 140874 |
| Ppp4r4 | 021209 | 190664 | 140295 |
| Ppp4r4 | 021209 | 190151 | 139815 |
| Pragl | 050271 | 110492 | 106118 |
| Pragl | 050271 | 145386 | N/A |
| Pragl | 050271 | 150295 | N/A |
| Prex1 | 039621 | 036719 | 037180 |
| Prex1 | 039621 | 127553 | N/A |
| Prex1 | 039621 | 099080 | 096679 |
| Prex1 | 039621 | 109246 | 104869 |
| Prex1 | 039621 | 140624 | N/A |
| Prex1 | 039621 | 152238 | N/A |
| Prex1 | 039621 | 136564 | N/A |
| Prex1 | 039621 | 136974 | N/A |
| Prex2 | 048960 | 027056 | 027056 |
| Prex2 | 048960 | 190935 | N/A |
| Prex2 | 048960 | 189822 | N/A |
| Prex2 | 048960 | 187694 | N/A |
| Prex2 | 048960 | 188189 | 140621 |
| Prex2 | 048960 | 187745 | 140788 |
| Prex2 | 048960 | 189385 | 140863 |
| Prex2 | 048960 | 188154 | 140580 |
| Prickle1 | 036158 | 048982 | 049204 |

TABLE 2-continued

ENSEMBL IDs for mice

| Symbol | MUSG | MUST | MUSP |
|---|---|---|---|
| Prickle1 | 036158 | 109255 | 104878 |
| Prima1 | 041669 | 123655 | N/A |
| Prima1 | 041669 | 127843 | 114309 |
| Prima1 | 041669 | 074416 | 074017 |
| Prima1 | 041669 | 156176 | 123331 |
| Prima1 | 041669 | 155547 | N/A |
| Prkag3 | 006542 | 160732 | 125344 |
| Prkag3 | 006542 | 113672 | 109302 |
| Prkag3 | 006542 | 081636 | 080342 |
| Prkag3 | 006542 | 162093 | 125242 |
| Prkag3 | 006542 | 159728 | 124979 |
| Prkag3 | 006542 | 188073 | 139909 |
| Prkcb | 052889 | 143692 | 138788 |
| Prkcb | 052889 | 064989 | 070019 |
| Prkcb | 052889 | 064921 | 064812 |
| Prkcb | 052889 | 131167 | N/A |
| Prkcb | 052889 | 149583 | N/A |
| Prkcb | 052889 | 205550 | N/A |
| Prkcb | 052889 | 127910 | N/A |
| Prkcb | 052889 | 206495 | N/A |
| Prkcd | 021948 | 112210 | 107829 |
| Prkcd | 021948 | 022521 | 022521 |
| Prkcd | 021948 | 112207 | 107826 |
| Prkcd | 021948 | 112206 | 107825 |
| Prkcd | 021948 | 140701 | N/A |
| Prkcd | 021948 | 112202 | 107821 |
| Prkcd | 021948 | 112203 | 107822 |
| Prkcd | 021948 | 130736 | N/A |
| Prkcd | 021948 | 135714 | N/A |
| Prkcd | 021948 | 145806 | N/A |
| Prkcd | 021948 | 112208 | N/A |
| Prkcd | 021948 | 227078 | N/A |
| Prkcd | 021948 | 112211 | 107830 |
| Prkcg | 078816 | 203600 | N/A |
| Prkcg | 078816 | 100301 | 097874 |
| Prkcg | 078816 | 172109 | 131351 |
| Prkcg | 078816 | 203081 | 145498 |
| Prkcg | 078816 | 203454 | N/A |
| Prkcg | 097449 | 181455 | 137923 |
| Prkcg | 097449 | 181221 | 137836 |
| Prkcq | 026778 | 028118 | 028118 |
| Prkcq | 026778 | 114853 | N/A |
| Prkcq | 026778 | 195207 | N/A |
| Prkcq | 026778 | 102970 | 100035 |
| Prkcq | 026778 | 192461 | N/A |
| Prkcq | 026778 | 195628 | N/A |
| Prkd3 | 024070 | 003191 | 003191 |
| Prkd3 | 024070 | 119284 | 113395 |
| Prkd3 | 024070 | 146917 | N/A |
| Prkd3 | 024070 | 118768 | 113232 |
| Prkd3 | 024070 | 118991 | 112775 |
| Prkd3 | 024070 | 124229 | N/A |
| Prkd3 | 024070 | 130070 | N/A |
| Prkd3 | 024070 | 168887 | 132004 |
| Prkg2 | 029334 | 161490 | 124963 |
| Prkg2 | 029334 | 162619 | 142743 |
| Prkg2 | 029334 | 162147 | 143708 |
| Prkg2 | 029334 | 031277 | 031277 |
| Prkg2 | 029334 | 160765 | N/A |
| Prmt8 | 030350 | 032500 | 032500 |
| Procr | 027611 | 029140 | 029140 |
| Procr | 027611 | 143493 | N/A |
| Procr | 027611 | 155095 | N/A |
| Procr | 027611 | 132608 | 114567 |
| Prr5 | 036106 | 171460 | 127890 |
| Prr5 | 036106 | 065499 | 066396 |
| Prr5l | 032841 | 043845 | 042167 |
| Prr5l | 032841 | 141814 | 118537 |
| Prr5l | 032841 | 125985 | 122996 |
| Prr5l | 032841 | 154525 | 120192 |
| Prr5l | 032841 | 124802 | 118502 |
| Prr5l | 032841 | 144549 | 116266 |
| Prr5l | 032841 | 140387 | N/A |
| Prr5l | 032841 | 127358 | N/A |
| Prr5l | 032841 | 163762 | 127530 |
| Prr5l | 032841 | 171088 | 130152 |

TABLE 2-continued

ENSEMBL IDs for mice

| Symbol | MUSG | MUST | MUSP |
|---|---|---|---|
| Prrc1 | 024594 | 025490 | 025490 |
| Prrg3 | 033361 | 126362 | 118155 |
| Prrg3 | 033361 | 048790 | 038947 |
| Prrg3 | 033361 | 170096 | 128073 |
| Prrx1 | 026586 | 075805 | 075203 |
| Prrx1 | 026586 | 027878 | 027878 |
| Prrx1 | 026586 | 183691 | N/A |
| Prrx1 | 026586 | 174397 | 134338 |
| Prrx1 | 026586 | 174098 | N/A |
| Psd2 | 024347 | 115716 | 111381 |
| Psd2 | 024347 | 176873 | 135616 |
| Psd2 | 024347 | 177432 | 135431 |
| Psd2 | 024347 | 176472 | 135285 |
| Psd2 | 024347 | 175734 | 135795 |
| Psd2 | 024347 | 175720 | N/A |
| Pstpip2 | 025429 | 114741 | 110389 |
| Ptchd1 | 041552 | 038665 | 039443 |
| Ptchd1 | 041552 | 170236 | 132293 |
| Ptchd1 | 041552 | 141356 | N/A |
| Ptchd4 | 042256 | 048691 | 047640 |
| Pter | 026730 | 154269 | 118645 |
| Pter | 026730 | 150283 | N/A |
| Pter | 026730 | 114796 | 110444 |
| Pter | 026730 | 134794 | 117009 |
| Pter | 026730 | 028063 | 028063 |
| Pter | 026730 | 193742 | N/A |
| Pter | 026730 | 195521 | N/A |
| Ptgfrn | 027864 | 102694 | 099755 |
| Ptgfrn | 027864 | 198037 | N/A |
| Ptgfrn | 027864 | 200065 | N/A |
| Ptk2b | 059456 | 022622 | 022622 |
| Ptk2b | 059456 | 154865 | 122683 |
| Ptk2b | 059456 | 089250 | 086661 |
| Ptk2b | 059456 | 136216 | N/A |
| Ptk2b | 059456 | 111121 | 106750 |
| Ptk2b | 059456 | 148104 | N/A |
| Ptk2b | 059456 | 127083 | N/A |
| Ptk2b | 059456 | 178730 | 137008 |
| Ptn | 029838 | 101534 | 099073 |
| Ptn | 029838 | 201321 | 144184 |
| Ptpn14 | 026604 | 097442 | 095051 |
| Ptpn14 | 026604 | 194127 | N/A |
| Ptpn14 | 026604 | 128275 | N/A |
| Ptpn14 | 026604 | 027898 | 027898 |
| Ptpn14 | 026604 | 195038 | N/A |
| Ptpn14 | 026604 | 148129 | N/A |
| Ptpn22 | 027843 | 146071 | 122307 |
| Ptpn22 | 027843 | 029433 | 029433 |
| Ptpn22 | 027843 | 198530 | N/A |
| Ptpn22 | 027843 | 197997 | N/A |
| Ptpn22 | 027843 | 196385 | N/A |
| Ptpn22 | 027843 | 198701 | N/A |
| Ptpn22 | 027843 | 134373 | N/A |
| Ptpn22 | 027843 | 126548 | N/A |
| Ptpn5 | 030854 | 102626 | 099686 |
| Ptpn5 | 030854 | 209161 | N/A |
| Ptpn5 | 030854 | 033142 | 033142 |
| Ptpn5 | 030854 | 208324 | N/A |
| Ptpn5 | 030854 | 208531 | N/A |
| Ptpn5 | 030854 | 207172 | N/A |
| Ptpn5 | 030854 | 208437 | N/A |
| Ptpn5 | 030854 | 209179 | N/A |
| Ptpn5 | 030854 | 209184 | N/A |
| Ptpn5 | 030854 | 207344 | N/A |
| Ptpn5 | 030854 | 209057 | N/A |
| Ptprk | 019889 | 166468 | 126279 |
| Ptprk | 019889 | 218359 | 151986 |
| Ptprk | 019889 | 218276 | 151866 |
| Ptprk | 019889 | 219478 | N/A |
| Ptprk | 019889 | 218633 | N/A |
| Ptprk | 019889 | 219107 | N/A |
| Ptprk | 019889 | 218584 | N/A |
| Ptprk | 019889 | 219761 | N/A |
| Ptprk | 019889 | 219621 | 151294 |
| Ptprk | 019889 | 220357 | 151493 |
| Ptprk | 019889 | 220404 | N/A |

TABLE 2-continued

ENSEMBL IDs for mice

| Symbol | MUSG | MUST | MUSP |
|---|---|---|---|
| Ptprm | 033278 | 037974 | 045603 |
| Ptprm | 033278 | 223982 | 153662 |
| Ptprm | 033278 | 225074 | N/A |
| Ptprm | 033278 | 224091 | 153463 |
| Ptprm | 033278 | 225554 | 153042 |
| Ptprm | 033278 | 225688 | N/A |
| Ptprm | 033278 | 224862 | 153179 |
| Ptpro | 030223 | 203010 | N/A |
| Ptpro | 030223 | 167679 | 127112 |
| Ptpro | 030223 | 077115 | 076364 |
| Ptpro | 030223 | 167002 | 131764 |
| Ptpro | 030223 | 203914 | 144870 |
| Ptpro | 030223 | 204780 | N/A |
| Ptpro | 030223 | 203255 | N/A |
| Ptpro | 030223 | 203127 | N/A |
| Ptprr | 020151 | 063470 | 064392 |
| Ptprr | 020151 | 142617 | N/A |
| Ptprr | 020151 | 105271 | 100907 |
| Ptprr | 020151 | 148731 | 120965 |
| Ptprr | 020151 | 155606 | 122259 |
| Ptprr | 020151 | 128399 | 114455 |
| Ptprr | 020151 | 124369 | N/A |
| Ptprt | 053141 | 109445 | 105071 |
| Ptprt | 053141 | 109443 | 105069 |
| Ptprt | 053141 | 109442 | 105068 |
| Ptprt | 053141 | 109441 | 105067 |
| Ptprt | 053141 | 153770 | N/A |
| Ptprt | 053141 | 129015 | N/A |
| Ptprz1 | 068748 | 090568 | 088056 |
| Ptprz1 | 068748 | 202579 | 144605 |
| Ptprz1 | 068748 | 202102 | 143902 |
| Ptprz1 | 068748 | 202341 | N/A |
| Ptprz1 | 068748 | 201827 | N/A |
| Ptprz1 | 068748 | 200769 | N/A |
| Pttg1 | 020415 | 020687 | 020687 |
| Pttg1 | 020415 | 117446 | 112841 |
| Pttg1 | 020415 | 140434 | 122019 |
| Pttg1 | 020415 | 101340 | 098894 |
| Pttg1 | 020415 | 118368 | 112834 |
| Pttg1 | 020415 | 121638 | 112815 |
| Pttg1 | 020415 | 152115 | 119554 |
| Pttg1 | 020415 | 020685 | 020685 |
| Pttg1 | 020415 | 150726 | N/A |
| Pttg1 | 020415 | 148130 | N/A |
| Purb | 094483 | 179343 | 136957 |
| Pvalb | 005716 | 005860 | 005860 |
| Pvalb | 005716 | 120592 | 112598 |
| Pxdc1 | 021411 | 053459 | 051246 |
| Pxdc1 | 021411 | 021847 | 021847 |
| Pxdc1 | 021411 | 125037 | 117791 |
| Pxdc1 | 021411 | 152392 | N/A |
| Pxdn | 020674 | 220271 | 151320 |
| Pxdn | 020674 | 122328 | 113703 |
| Pxdn | 020674 | 118321 | 113477 |
| Pxdn | 020674 | 155318 | N/A |
| Pxdn | 020674 | 155190 | N/A |
| Pxdn | 020674 | 126233 | N/A |
| Pxdn | 020674 | 137316 | N/A |
| Pxdn | 020674 | 218620 | N/A |
| Pxk | 033885 | 036682 | 035265 |
| Pxk | 033885 | 225827 | N/A |
| Pxk | 033885 | 225616 | N/A |
| Pxk | 033885 | 225653 | 152987 |
| Pxk | 033885 | 224462 | N/A |
| Pxk | 033885 | 112689 | 108309 |
| Pxylp1 | 043587 | 112951 | 108574 |
| Pxylp1 | 043587 | 078478 | 077571 |
| Pxylp1 | 043587 | 120101 | 113210 |
| Pxylp1 | 043587 | 119141 | 113489 |
| Pxylp1 | 043587 | 126411 | 121537 |
| Pxylp1 | 043587 | 121077 | 113059 |
| Pxylp1 | 043587 | 135834 | N/A |
| Pxylp1 | 043587 | 154146 | 114946 |
| Pxylp1 | 043587 | 137770 | N/A |
| Pxylp1 | 043587 | 124923 | 120377 |
| Pxylp1 | 043587 | 141127 | N/A |

TABLE 2-continued

ENSEMBL IDs for mice

| Symbol | MUSG | MUST | MUSP |
|---|---|---|---|
| Pxylp1 | 043587 | 136987 | N/A |
| Pxylp1 | 043587 | 185561 | N/A |
| Pyroxd2 | 060224 | 076505 | 075825 |
| Qdpr | 015806 | 198258 | 143741 |
| Qdpr | 015806 | 197946 | 143584 |
| Qdpr | 015806 | 117425 | 112469 |
| Qdpr | 015806 | 120867 | 113203 |
| Qdpr | 015806 | 118097 | 113958 |
| Qdpr | 015806 | 015950 | 015950 |
| Qdpr | 015806 | 200259 | N/A |
| Qdpr | 015806 | 149290 | N/A |
| Qdpr | 015806 | 154962 | 122081 |
| Qdpr | 015806 | 127562 | 115453 |
| Qk | 062078 | 042296 | 046740 |
| Qk | 062078 | 097414 | 095025 |
| Rab11fip1 | 031488 | 054212 | 058042 |
| Rab11fip1 | 031488 | 033878 | 033878 |
| Rab11fip1 | 031488 | 209377 | 147543 |
| Rab11fip1 | 031488 | 210187 | N/A |
| Rab11fip1 | 031488 | 210919 | N/A |
| Rab11fip1 | 031488 | 211646 | N/A |
| Rab15 | 021062 | 021459 | 021459 |
| Rab15 | 021062 | 143863 | N/A |
| Rab15 | 021062 | 122419 | 112457 |
| Rab15 | 021062 | 121716 | 113299 |
| Rab15 | 021062 | 118604 | 112789 |
| Rab15 | 021062 | 154765 | 122067 |
| Rab15 | 021062 | 141622 | 115720 |
| Rab15 | 021062 | 134124 | N/A |
| Rab27a | 032202 | 184146 | 139310 |
| Rab27a | 032202 | 034722 | 034722 |
| Rab27a | 032202 | 184575 | N/A |
| Rab27a | 032202 | 184032 | N/A |
| Rab27b | 024511 | 121693 | 114094 |
| Rab27b | 024511 | 127217 | N/A |
| Rab27b | 024511 | 117692 | 112807 |
| Rab27b | 024511 | 069749 | 068349 |
| Rab31 | 056515 | 070673 | 068195 |
| Rab3a | 031840 | 110093 | 105720 |
| Rab3a | 031840 | 143118 | 123384 |
| Rab3a | 031840 | 034301 | 034301 |
| Rab3a | 031840 | 110090 | 105717 |
| Rab3a | 031840 | 110092 | 105719 |
| Rab3a | 031840 | 130468 | N/A |
| Rab3a | 111277 | 217185 | 150125 |
| Rab3b | 003411 | 106650 | 102261 |
| Rab3b | 003411 | 106651 | 102262 |
| Rab3b | 003411 | 003502 | 003502 |
| Rab3b | 003411 | 157062 | N/A |
| Rab3c | 021700 | 167824 | 132945 |
| Rab3c | 021700 | 223922 | 153347 |
| Rab3c | 021700 | 224180 | 153136 |
| Rab3c | 021700 | 224287 | N/A |
| Rab3c | 021700 | 226040 | N/A |
| Rai2 | 043518 | 112338 | 107957 |
| Rai2 | 043518 | 061514 | 051618 |
| Ralgps2 | 026594 | 172057 | 132533 |
| Ralgps2 | 026594 | 027886 | 027886 |
| Ralgps2 | 026594 | 192343 | 142004 |
| Ralgps2 | 026594 | 171292 | 130581 |
| Ralgps2 | 026594 | 063199 | 063872 |
| Ralgps2 | 026594 | 191605 | 139645 |
| Ralgps2 | 026594 | 189208 | N/A |
| Ralgps2 | 026594 | 185198 | 139618 |
| Ralgps2 | 026594 | 189316 | 140230 |
| Ralgps2 | 026594 | 190648 | 140055 |
| Ralgps2 | 026594 | 188656 | 140342 |
| Ralgps2 | 026594 | 191503 | N/A |
| Ralgps2 | 026594 | 185970 | N/A |
| Ralgps2 | 026594 | 190762 | 139822 |
| Ralgps2 | 026594 | 189648 | 140108 |
| Ralyl | 039717 | 191806 | 148406 |
| Ralyl | 039717 | 193117 | 148795 |
| Ralyl | 039717 | 211860 | 148430 |
| Ralyl | 039717 | 192209 | 142094 |
| Ralyl | 039717 | 171075 | 125848 |

TABLE 2-continued

| ENSEMBL IDs for mice | | | |
|---|---|---|---|
| Symbol | MUSG | MUST | MUSP |
| Ralyl | 039717 | 108372 | 104009 |
| Ralyl | 039717 | 108373 | 148751 |
| Ramp2 | 001240 | 129680 | 122072 |
| Ramp2 | 001240 | 149006 | N/A |
| Ramp2 | 001240 | 128260 | 127718 |
| Ramp2 | 001240 | 122006 | 114061 |
| Ramp2 | 001240 | 149585 | 116331 |
| Ramp2 | 001240 | 151830 | 123150 |
| Ramp2 | 001240 | 138229 | N/A |
| Ramp2 | 001240 | 107282 | 102903 |
| Rapgef3 | 022469 | 126854 | 116426 |
| Rapgef3 | 022469 | 129223 | 118148 |
| Rapgef3 | 022469 | 128775 | 120126 |
| Rapgef3 | 022469 | 177352 | 135238 |
| Rapgef3 | 022469 | 134885 | 135317 |
| Rapgef3 | 022469 | 175894 | 135194 |
| Rapgef3 | 022469 | 125002 | N/A |
| Rapgef3 | 022469 | 123397 | N/A |
| Rapgef3 | 022469 | 155810 | N/A |
| Rapgef3 | 022469 | 146214 | N/A |
| Rapgef3 | 022469 | 134371 | 122746 |
| Rapgef3 | 022469 | 153241 | N/A |
| Rapgef3 | 022469 | 149419 | 122285 |
| Rapgef3 | 022469 | 153464 | N/A |
| Rapgef3 | 022469 | 146620 | 116673 |
| Rapgef3 | 022469 | 142196 | N/A |
| Rapgef3 | 022469 | 135080 | 117337 |
| Rapgef4 | 049044 | 090826 | 088336 |
| Rapgef4 | 049044 | 150234 | N/A |
| Rapgef4 | 049044 | 102698 | 099759 |
| Rapgef4 | 049044 | 151236 | N/A |
| Rapgef4 | 049044 | 028525 | 028525 |
| Rapgef4 | 049044 | 153887 | N/A |
| Rapgef4 | 049044 | 149421 | N/A |
| Rapgef4 | 049044 | 124004 | N/A |
| Rapgef4 | 049044 | 122975 | N/A |
| Rapgef4 | 049044 | 156031 | N/A |
| Rapgef4 | 049044 | 146970 | N/A |
| Rarb | 017491 | 063750 | 067694 |
| Rarb | 017491 | 225921 | 152980 |
| Rarb | 017491 | 223576 | 153098 |
| Rarb | 017491 | 225594 | 153178 |
| Rarb | 017491 | 223976 | 153519 |
| Rarb | 017491 | 225356 | N/A |
| Rarb | 017491 | 225245 | 153454 |
| Rasal2 | 070565 | 078308 | 077423 |
| Rasal2 | 070565 | 132699 | 114964 |
| Rasal2 | 070565 | 129880 | 118367 |
| Rasal2 | 070565 | 134543 | 119623 |
| Rasal2 | 070565 | 128538 | N/A |
| Rasal2 | 070565 | 143358 | 116974 |
| Rasal2 | 070565 | 143080 | N/A |
| Rasgef1b | 089809 | 031276 | 031276 |
| Rasgef1b | 089809 | 168092 | 129652 |
| Rasgef1b | 089809 | 209346 | 147997 |
| Rasgef1b | 089809 | 166484 | 128947 |
| Rasgef1b | 089809 | 166632 | N/A |
| Rasgef1b | 089809 | 146396 | 125723 |
| Rasgef1b | 089809 | 161516 | 125057 |
| Rasgef1b | 089809 | 142639 | N/A |
| Rasgef1b | 089809 | 160803 | N/A |
| Rasgef1b | 089809 | 161148 | 125009 |
| Rasgrf1 | 032356 | 189545 | 140921 |
| Rasgrf1 | 032356 | 034909 | 034909 |
| Rasgrf1 | 032356 | 034912 | 034912 |
| Rasgrf1 | 032356 | 190073 | N/A |
| Rasgrp1 | 027347 | 102534 | 099593 |
| Rasgrp1 | 027347 | 174770 | 134167 |
| Rasgrp1 | 027347 | 173541 | 134027 |
| Rasgrp1 | 027347 | 172901 | 133449 |
| Rasgrp1 | 027347 | 173252 | 134592 |
| Rasgrp1 | 027347 | 110898 | N/A |
| Rasgrp1 | 027347 | 178884 | 136423 |
| Rassf2 | 027339 | 028814 | 028814 |
| Rassf2 | 027339 | 103182 | 099471 |
| Rassf2 | 027339 | 155829 | N/A |

TABLE 2-continued

| ENSEMBL IDs for mice | | | |
|---|---|---|---|
| Symbol | MUSG | MUST | MUSP |
| Rassf2 | 027339 | 139047 | 120194 |
| Rassf2 | 027339 | 140791 | 117619 |
| Rbks | 029136 | 201744 | N/A |
| Rbks | 029136 | 031018 | 031018 |
| Rbks | 029136 | 202036 | N/A |
| Rbm24 | 038132 | 037923 | 043120 |
| Rbm24 | 038132 | 225221 | N/A |
| Rbm24 | 038132 | 225727 | N/A |
| Rbm24 | 038132 | 224638 | N/A |
| Rbm24 | 038132 | 225890 | N/A |
| Rbm25 | 010608 | 181983 | 138572 |
| Rbm25 | 010608 | 182004 | 138573 |
| Rbm25 | 010608 | 048155 | 048470 |
| Rbm25 | 010608 | 182618 | 138665 |
| Rbm25 | 010608 | 183154 | 138669 |
| Rbm25 | 010608 | 182036 | 138565 |
| Rbm25 | 010608 | 182347 | 138410 |
| Rbm25 | 010608 | 182633 | 138625 |
| Rbm25 | 010608 | 182881 | N/A |
| Rbm25 | 010608 | 183128 | N/A |
| Rbm25 | 010608 | 182450 | 138416 |
| Rbm25 | 010608 | 182255 | N/A |
| Rbm25 | 010608 | 183039 | N/A |
| Rbm25 | 010608 | 182032 | N/A |
| Rbm25 | 010608 | 183242 | N/A |
| Rbm25 | 010608 | 183282 | N/A |
| Rbm25 | 010608 | 182840 | N/A |
| Rbm25 | 010608 | 183181 | N/A |
| Rbms3 | 039607 | 111773 | 107403 |
| Rbms3 | 039607 | 068962 | 066735 |
| Rbms3 | 039607 | 173429 | 133900 |
| Rbms3 | 039607 | 174868 | 133621 |
| Rbms3 | 039607 | 164018 | 131371 |
| Rbms3 | 039607 | 111772 | 107402 |
| Rbms3 | 039607 | 044901 | 039706 |
| Rbms3 | 039607 | 172469 | 134172 |
| Rbms3 | 039607 | 069095 | N/A |
| Rbms3 | 039607 | 172564 | 134528 |
| Rbms3 | 039607 | 174276 | N/A |
| Rbms3 | 039607 | 084824 | N/A |
| Rbp2 | 032454 | 189446 | 140676 |
| Rbp2 | 032454 | 187905 | 140630 |
| Rbp2 | 032454 | 188779 | N/A |
| Rbp2 | 032454 | 035029 | 035029 |
| Rbpjl | 017007 | 137427 | N/A |
| Rbpjl | 017007 | 017151 | 017151 |
| Rbpjl | 017007 | 109356 | N/A |
| Rbpms2 | 032387 | 169003 | 131076 |
| Rbpms2 | 032387 | 055844 | 057600 |
| Rbpms2 | 032387 | 213927 | N/A |
| Rbpms2 | 032387 | 216342 | 149535 |
| Rbpms2 | 032387 | 216382 | 151192 |
| Rbpms2 | 032387 | 216769 | N/A |
| Rcn1 | 005973 | 006128 | 006128 |
| Rcn1 | 005973 | 127019 | N/A |
| Rcn2 | 032320 | 147842 | 120953 |
| Rcn2 | 032320 | 114276 | 109915 |
| Rcn2 | 032320 | 151585 | N/A |
| Rcn2 | 032320 | 144869 | N/A |
| Reck | 028476 | 030198 | 030198 |
| Reck | 028476 | 128463 | N/A |
| Reck | 028476 | 130415 | N/A |
| Reln | 042453 | 161356 | 124052 |
| Reln | 042453 | 160791 | N/A |
| Reln | 042453 | 062372 | 058025 |
| Reln | 042453 | 200318 | N/A |
| Reln | 042453 | 200667 | N/A |
| Reln | 042453 | 199034 | N/A |
| Reln | 042453 | 159768 | N/A |
| Reln | 042453 | 161353 | N/A |
| Reln | 042453 | 162427 | N/A |
| Reln | 042453 | 159741 | N/A |
| Reln | 042453 | 162876 | 124077 |
| Reln | 042453 | 162637 | N/A |
| Reln | 042453 | 162622 | N/A |
| Reln | 042453 | 160707 | N/A |

TABLE 2-continued

ENSEMBL IDs for mice

| Symbol | MUSG | MUST | MUSP |
|---|---|---|---|
| Reln | 042453 | 161782 | N/A |
| Rep15 | 040121 | 036194 | 037503 |
| Rerg | 030222 | 032347 | 032347 |
| Rerg | 030222 | 117919 | 113105 |
| Rerg | 030222 | 119610 | 113702 |
| Rerg | 030222 | 203003 | 144823 |
| Rerg | 030222 | 149100 | 144902 |
| Ret | 030110 | 032201 | 032201 |
| Ret | 030110 | 088790 | 086169 |
| Rftn1 | 039316 | 044503 | 046524 |
| Rftn1 | 039316 | 113195 | 108820 |
| Rftn1 | 039316 | 156094 | N/A |
| Rfx4 | 020037 | 060397 | 051107 |
| Rfx4 | 020037 | 173479 | N/A |
| Rfx4 | 020037 | 165868 | N/A |
| Rfx4 | 020037 | 166696 | 128690 |
| Rfx4 | 020037 | 020226 | N/A |
| Rfx4 | 020037 | 095388 | 093035 |
| Rgcc | 022018 | 022595 | 022595 |
| Rgma | 070509 | 119206 | 112599 |
| Rgma | 070509 | 094312 | 091870 |
| Rgma | 070509 | 128471 | 116552 |
| Rgma | 070509 | 139780 | 145758 |
| Rgma | 070509 | 206253 | N/A |
| Rgs6 | 021219 | 201602 | 144044 |
| Rgs6 | 021219 | 186848 | 141044 |
| Rgs6 | 021219 | 161801 | 125256 |
| Rgs6 | 021219 | 185665 | 139566 |
| Rgs6 | 021219 | 200911 | 143801 |
| Rgs6 | 021219 | 202210 | 143961 |
| Rgs6 | 021219 | 186458 | 139735 |
| Rgs6 | 021219 | 186081 | 140188 |
| Rgs6 | 021219 | 201271 | 144139 |
| Rgs6 | 021219 | 200861 | 144118 |
| Rgs6 | 021219 | 186309 | 140701 |
| Rgs6 | 021219 | 201861 | 144395 |
| Rgs6 | 021219 | 193448 | N/A |
| Rgs6 | 021219 | 191311 | 140723 |
| Rgs6 | 021219 | 191352 | 139718 |
| Rgs6 | 021219 | 191107 | 139725 |
| Rgs6 | 021219 | 186323 | 141079 |
| Rgs6 | 021219 | 185674 | 139940 |
| Rgs6 | 021219 | 190964 | N/A |
| Rgs6 | 021219 | 201767 | 143829 |
| Rgs6 | 021219 | 201512 | N/A |
| Rgs6 | 021219 | 101234 | 098793 |
| Rgs7bp | 021719 | 063551 | 066614 |
| Rgs9 | 020599 | 020920 | 020920 |
| Rgs9 | 020599 | 103062 | 099351 |
| Rgs9 | 020599 | 106706 | 102317 |
| Rgs9 | 020599 | 156785 | N/A |
| Rgs9 | 020599 | 106704 | 102315 |
| Rhpn2 | 030494 | 032705 | 032705 |
| Rhpn2 | 030494 | 155140 | N/A |
| Rhpn2 | 030494 | 187997 | N/A |
| Rhpn2 | 030494 | 085556 | 082692 |
| Rimbp2 | 029420 | 199537 | 143276 |
| Rimbp2 | 029420 | 198941 | 142455 |
| Rimbp2 | 029420 | 196085 | 143725 |
| Rimbp2 | 029420 | 200470 | 143099 |
| Rimbp2 | 029420 | 199737 | 142712 |
| Rimbp2 | 029420 | 196569 | N/A |
| Rimbp2 | 029420 | 111346 | 106978 |
| Rims1 | 041670 | 185942 | 140963 |
| Rims1 | 041670 | 097808 | 095417 |
| Rims1 | 041670 | 081544 | 080259 |
| Rims1 | 041670 | 115273 | 110928 |
| Rims1 | 041670 | 218140 | 151404 |
| Rims1 | 041670 | 097811 | 095420 |
| Rims1 | 041670 | 097810 | 095419 |
| Rims1 | 041670 | 097809 | 095418 |
| Rims1 | 041670 | 164877 | 131808 |
| Rims3 | 032890 | 132895 | N/A |
| Rims3 | 032890 | 071093 | 068178 |
| Rims3 | 032890 | 106283 | 101890 |
| Rims3 | 032890 | 171363 | 130295 |

TABLE 2-continued

ENSEMBL IDs for mice

| Symbol | MUSG | MUST | MUSP |
|---|---|---|---|
| Rims4 | 035226 | 044734 | 045637 |
| Rin2 | 001768 | 147976 | 124206 |
| Rin2 | 001768 | 110005 | 105632 |
| Rin2 | 001768 | 142847 | 125476 |
| Rin2 | 001768 | 150449 | 124078 |
| Rin2 | 001768 | 145874 | N/A |
| Rin2 | 001768 | 149269 | N/A |
| Rin2 | 001768 | 144278 | N/A |
| Rin2 | 001768 | 094480 | 092053 |
| Rit2 | 057455 | 153060 | 114323 |
| Rit2 | 057455 | 139924 | 122938 |
| Rit2 | 057455 | 082070 | 080724 |
| Rit2 | 057455 | 153196 | N/A |
| Rlbp1 | 039194 | 179243 | 137143 |
| Rlbp1 | 039194 | 053718 | 054545 |
| Rlbp1 | 039194 | 206624 | N/A |
| Rlbp1 | 039194 | 206162 | 146196 |
| Rlbp1 | 039194 | 206320 | 145611 |
| Rlbp1 | 039194 | 205442 | 145850 |
| Rlbp1 | 039194 | 205638 | 146144 |
| Rlbp1 | 039194 | 206695 | 146075 |
| Rnf112 | 010086 | 060255 | 059903 |
| Rnf112 | 010086 | 054927 | 056464 |
| Rnf112 | 010086 | 102661 | 099722 |
| Rnf112 | 010086 | 152137 | N/A |
| Rnf112 | 010086 | 126859 | N/A |
| Rnf112 | 010086 | 136966 | N/A |
| Rnf112 | 010086 | 130648 | N/A |
| Rnf207 | 058498 | 076183 | 075540 |
| Rnf207 | 058498 | 108688 | N/A |
| Rnf207 | 058498 | 170820 | 129400 |
| Rnf207 | 058498 | 135837 | N/A |
| Rnf207 | 058498 | 127565 | N/A |
| Rnf207 | 058498 | 142427 | N/A |
| Rnf207 | 058498 | 130008 | 127196 |
| Rnf207 | 058498 | 143968 | N/A |
| Rnf207 | 058498 | 134269 | N/A |
| Rnf207 | 058498 | 145311 | N/A |
| Rnf207 | 058498 | 123133 | N/A |
| Rnf207 | 058498 | 146496 | N/A |
| Rnf217 | 063760 | 081989 | 080650 |
| Rnf220 | 028677 | 030439 | 030439 |
| Rnf220 | 028677 | 102690 | 099751 |
| Rnf220 | 028677 | 221654 | 152367 |
| Rnf220 | 028677 | 094853 | 092449 |
| Rnf220 | 028677 | 128122 | N/A |
| Rnf220 | 028677 | 223371 | N/A |
| Rnf220 | 028677 | 221157 | N/A |
| Rnf220 | 028677 | 151829 | 152638 |
| Rnf220 | 028677 | 223182 | N/A |
| Rnf220 | 028677 | 154974 | N/A |
| Rnf220 | 028677 | 133971 | N/A |
| Rnf220 | 028677 | 150148 | N/A |
| Rnf220 | 028677 | 138435 | N/A |
| Rnf220 | 028677 | 123222 | N/A |
| Rnf43 | 034177 | 134684 | N/A |
| Rnf43 | 034177 | 123658 | N/A |
| Rnf43 | 034177 | 092800 | 090476 |
| Rnf43 | 034177 | 121782 | 112748 |
| Rnf43 | 034177 | 040089 | 044241 |
| Rnf43 | 034177 | 162740 | N/A |
| Rnf43 | 034177 | 124625 | N/A |
| Rnf43 | 034177 | 150866 | N/A |
| Rnf43 | 034177 | 165679 | 130685 |
| Robo2 | 052516 | 226478 | 154353 |
| Robo2 | 052516 | 117785 | 112776 |
| Robo2 | 052516 | 117200 | 113795 |
| Robo2 | 052516 | 149114 | N/A |
| Robo2 | 052516 | 137420 | N/A |
| Robo2 | 052516 | 116586 | 112285 |
| Robo2 | 052516 | 138852 | N/A |
| Robo2 | 052516 | 227347 | 154010 |
| Robo2 | 052516 | 147408 | N/A |
| Robo2 | 052516 | 140062 | N/A |
| Robo2 | 052516 | 156010 | N/A |
| Robo3 | 032128 | 167089 | N/A |

TABLE 2-continued

| ENSEMBL IDs for mice | | | |
| --- | --- | --- | --- |
| Symbol | MUSG | MUST | MUSP |
| Robo3 | 032128 | 171467 | N/A |
| Robo3 | 032128 | 034643 | 034643 |
| Robo3 | 032128 | 115038 | 110690 |
| Robo3 | 032128 | 170512 | 150639 |
| Robo3 | 032128 | 167216 | N/A |
| Rpa1 | 000751 | 092907 | 090585 |
| Rpa1 | 000751 | 000767 | 000767 |
| Rpa1 | 000751 | 149365 | N/A |
| Rpa1 | 000751 | 154894 | N/A |
| Rpa1 | 000751 | 135770 | N/A |
| Rph3a | 029608 | 079204 | 078198 |
| Rph3a | 029608 | 202406 | 143917 |
| Rph3a | 029608 | 202326 | 144291 |
| Rph3a | 029608 | 200792 | 144437 |
| Rprm | 075334 | 100089 | 097667 |
| Rps6ka1 | 003644 | 105894 | 101514 |
| Rps6ka1 | 003644 | 168974 | 126774 |
| Rps6ka1 | 003644 | 003741 | 003741 |
| Rps6ka1 | 003644 | 157067 | 121341 |
| Rps6ka1 | 003644 | 174481 | 134507 |
| Rps6ka1 | 003644 | 137486 | 119328 |
| Rps6ka1 | 003644 | 173989 | N/A |
| Rps6ka1 | 003644 | 129636 | N/A |
| Rps6ka1 | 003644 | 173961 | N/A |
| Rpusd3 | 051169 | 113092 | 108715 |
| Rpusd3 | 051169 | 060634 | 059057 |
| Rpusd3 | 051169 | 203758 | N/A |
| Rpusd3 | 051169 | 129047 | 120380 |
| Rpusd3 | 051169 | 147726 | 120250 |
| Rpusd3 | 051169 | 124078 | N/A |
| Rpusd3 | 051169 | 151618 | 115950 |
| Rpusd3 | 051169 | 134853 | N/A |
| Rpusd3 | 051169 | 129560 | 114511 |
| Rpusd3 | 051169 | 150452 | N/A |
| Rspo2 | 051920 | 226810 | 154600 |
| Rspo2 | 051920 | 063492 | 067325 |
| Rspo2 | 051920 | 226402 | N/A |
| Rtn1 | 021087 | 150156 | N/A |
| Rtn1 | 021087 | 078505 | 077594 |
| Rtn1 | 021087 | 137990 | 120033 |
| Rtn1 | 021087 | 144181 | N/A |
| Rtn1 | 021087 | 221756 | N/A |
| Rtn1 | 021087 | 021497 | 021497 |
| Rtn1 | 021087 | 150156 | N/A |
| Rtn1 | 021087 | 078505 | 077594 |
| Rtn1 | 021087 | 137990 | 120033 |
| Rtn1 | 021087 | 144181 | N/A |
| Rtn1 | 021087 | 221756 | N/A |
| Rtn1 | 021087 | 021497 | 021497 |
| Rtn4r | 043811 | 059589 | 062924 |
| Rtn4r | 111113 | 213627 | 149817 |
| Rtn4rl1 | 045287 | 102514 | 099572 |
| Rtn4rl2 | 050896 | 151799 | 118362 |
| Rtn4rl2 | 050896 | 151759 | N/A |
| Rtn4rl2 | 050896 | 054514 | 057725 |
| Rubcnl | 034959 | 036072 | 045566 |
| Rubcnl | 034959 | 228689 | N/A |
| Rxfp1 | 034009 | 078527 | 077611 |
| Rxfp1 | 034009 | 182491 | 138578 |
| Rxfp1 | 034009 | 183199 | N/A |
| Rxfp1 | 034009 | 183040 | N/A |
| Ryr1 | 030592 | 214374 | 149042 |
| Ryr1 | 030592 | 179893 | 137123 |
| Ryr1 | 030592 | 208318 | N/A |
| Ryr1 | 030592 | 208010 | N/A |
| Ryr1 | 030592 | 207764 | N/A |
| Ryr1 | 030592 | 207783 | N/A |
| Ryr1 | 030592 | 208922 | N/A |
| Ryr1 | 030592 | 032813 | 032813 |
| Ryr2 | 021313 | 021750 | 021750 |
| Ryr2 | 021313 | 222113 | N/A |
| Ryr2 | 021313 | 222788 | N/A |
| Ryr2 | 021313 | 221527 | 152510 |
| Ryr2 | 021313 | 221916 | N/A |
| Ryr2 | 021313 | 220712 | 152669 |
| Ryr2 | 021313 | 221941 | N/A |

TABLE 2-continued

| ENSEMBL IDs for mice | | | |
| --- | --- | --- | --- |
| Symbol | MUSG | MUST | MUSP |
| Ryr2 | 021313 | 221890 | N/A |
| Ryr2 | 021313 | 221609 | N/A |
| Ryr2 | 021313 | 222386 | N/A |
| Ryr2 | 021313 | 220597 | 152051 |
| Ryr2 | 021313 | 221018 | N/A |
| Ryr2 | 021313 | 221341 | N/A |
| Ryr2 | 021313 | 170156 | 127991 |
| Ryr3 | 057378 | 091818 | 089426 |
| Ryr3 | 057378 | 208135 | 146719 |
| Ryr3 | 057378 | 128192 | N/A |
| Ryr3 | 057378 | 207603 | N/A |
| Ryr3 | 057378 | 156757 | N/A |
| Ryr3 | 057378 | 146187 | N/A |
| Ryr3 | 057378 | 208574 | N/A |
| Ryr3 | 057378 | 134358 | 147196 |
| Ryr3 | 057378 | 142537 | N/A |
| Ryr3 | 057378 | 080673 | 079503 |
| Ryr3 | 057378 | 208290 | 147250 |
| Ryr3 | 057378 | 208151 | 146449 |
| S100a4 | 001020 | 001046 | 001046 |
| S100a4 | 001020 | 142476 | 143522 |
| S100b | 033208 | 036387 | 047968 |
| S1pr1 | 045092 | 055676 | 050897 |
| Sall1 | 031665 | 034090 | 034090 |
| Samd12 | 058656 | 078673 | 077741 |
| Samd12 | 058656 | 154119 | N/A |
| Samd12 | 058656 | 132059 | 123446 |
| Samd12 | 058656 | 132362 | N/A |
| Sapcd2 | 026955 | 114293 | 109932 |
| Sapcd2 | 026955 | 100323 | 097898 |
| Sapcd2 | 026955 | 155310 | N/A |
| Sapcd2 | 026955 | 129214 | N/A |
| Sapcd2 | 026955 | 137171 | N/A |
| Sapcd2 | 026955 | 132539 | N/A |
| Sapcd2 | 026955 | 028329 | 028329 |
| Scamp5 | 040722 | 046587 | 035898 |
| Scamp5 | 040722 | 215208 | N/A |
| Scamp5 | 040722 | 214256 | 150867 |
| Scamp5 | 040722 | 215734 | 151197 |
| Scamp5 | 040722 | 213771 | 149622 |
| Scamp5 | 040722 | 215059 | 150248 |
| Scel | 022123 | 227322 | 154402 |
| Scel | 022123 | 095576 | 093233 |
| Scg3 | 032181 | 034699 | 034699 |
| Scg3 | 032181 | 213324 | 149561 |
| Scg3 | 032181 | 215603 | 152480 |
| Scg3 | 032181 | 213637 | N/A |
| Scg3 | 032181 | 214244 | 151074 |
| Scg3 | 032181 | 214176 | N/A |
| Scg3 | 032181 | 215722 | N/A |
| Scn1a | 064329 | 200839 | 144214 |
| Scn1a | 064329 | 112366 | 107985 |
| Scn1a | 064329 | 077489 | 076697 |
| Scn1a | 064329 | 094951 | 092558 |
| Scn1a | 064329 | 156865 | 144633 |
| Scn1a | 064329 | 138910 | 116881 |
| Scn1a | 064329 | 129508 | N/A |
| Scn1a | 064329 | 112371 | 107990 |
| Scn2a | 075318 | 144254 | 117955 |
| Scn2a | 075318 | 028377 | 028377 |
| Scn2a | 075318 | 201378 | N/A |
| Scn2a | 075318 | 202653 | N/A |
| Scn2a | 075318 | 200829 | 143882 |
| Scn2a | 075318 | 138368 | N/A |
| Scn2a | 075318 | 202508 | 143958 |
| Scn2a | 075318 | 202162 | 143888 |
| Scn2a | 075318 | 100067 | 097645 |
| Scn2b | 070304 | 093855 | 091377 |
| Scn2b | 070304 | 170998 | 126826 |
| Scn4b | 046480 | 060125 | 062507 |
| Scn9a | 075316 | 100064 | 097642 |
| Scn9a | 075316 | 112354 | 107973 |
| Scn9a | 075316 | 151234 | N/A |
| Scn9a | 075316 | 141603 | N/A |
| Scn9a | 075316 | 164384 | 126528 |
| Scn9a | 075316 | 100063 | 097641 |

TABLE 2-continued      TABLE 2-continued

| Symbol | MUSG | MUST | MUSP | | Symbol | MUSG | MUST | MUSP |
|---|---|---|---|---|---|---|---|---|
| Scn9a | 075316 | 169900 | 131711 | | Sema6d | 027200 | 103238 | 099528 |
| Scnn1g | 000216 | 000221 | 000221 | | Sema6d | 027200 | 103239 | 099529 |
| Scube1 | 016763 | 144773 | N/A | | Sema6d | 027200 | 076335 | 075674 |
| Scube1 | 016763 | 043634 | 044835 | | Sema6d | 027200 | 078621 | 077691 |
| Scube1 | 016763 | 076060 | 075434 | | Sema6d | 027200 | 077847 | 077014 |
| Scube1 | 016763 | 016907 | 016907 | | Sept4 | 020486 | 122945 | 115682 |
| Scube1 | 016763 | 171496 | 130131 | | Sept4 | 020486 | 107962 | 103596 |
| Sdc3 | 025743 | 070478 | 065877 | | Sept4 | 020486 | 140398 | N/A |
| Sdc3 | 025743 | 146093 | N/A | | Sept4 | 020486 | 122067 | 112960 |
| Sdc3 | 025743 | 152591 | 118685 | | Sept4 | 020486 | 132723 | N/A |
| Sdc3 | 025743 | 141297 | 123608 | | Sept4 | 020486 | 123081 | N/A |
| Sdc3 | 025743 | 140623 | N/A | | Sept4 | 020486 | 133638 | N/A |
| Sdc4 | 017009 | 017153 | 017153 | | Sept4 | 020486 | 135175 | N/A |
| Sdc4 | 017009 | 142909 | N/A | | Sept4 | 020486 | 107961 | 103595 |
| Sec14l5 | 091712 | 165810 | 128063 | | Sept4 | 020486 | 018544 | 018544 |
| Sec24d | 039234 | 047923 | 035823 | | Sept4 | 020486 | 063156 | 060127 |
| Sec24d | 039234 | 198210 | N/A | | Sept4 | 020486 | 107960 | 103594 |
| Sec24d | 039234 | 200333 | 143588 | | Sept4 | 020486 | 136229 | N/A |
| Sec24d | 039234 | 197291 | N/A | | Sept4 | 020486 | 134923 | N/A |
| Sec24d | 039234 | 196167 | N/A | | Sept4 | 020486 | 133202 | 115790 |
| Sec24d | 039234 | 196631 | N/A | | Sept4 | 020486 | 148216 | N/A |
| Sec24d | 039234 | 200309 | N/A | | Sept4 | 020486 | 127414 | N/A |
| Sec24d | 039234 | 196482 | N/A | | Sept4 | 020486 | 143950 | N/A |
| Sel1l3 | 029189 | 031090 | 031090 | | Sept7 | 001833 | 165594 | 127641 |
| Sel1l3 | 029189 | 196435 | N/A | | Sept7 | 001833 | 215692 | N/A |
| Sel1l3 | 029189 | 196516 | N/A | | Sept7 | 001833 | 215721 | N/A |
| Sel1l3 | 029189 | 196550 | N/A | | Sept7 | 001833 | 213980 | N/A |
| Sel1l3 | 029189 | 199919 | N/A | | Sept7 | 001833 | 217598 | N/A |
| Sema3c | 028780 | 030568 | 030568 | | Sept7 | 001833 | 214911 | N/A |
| Sema3c | 028780 | 170181 | 126614 | | Sept7 | 001833 | 214520 | N/A |
| Sema3c | 028780 | 170348 | N/A | | Sept7 | 001833 | 213435 | N/A |
| Sema3c | 028780 | 169603 | 132330 | | Sept7 | 001833 | 214360 | N/A |
| Sema3c | 028780 | 115271 | N/A | | Sept7 | 001833 | 115272 | 110927 |
| Sema3d | 040254 | 030868 | 030868 | | Serinc2 | 023232 | 122374 | 112535 |
| Sema3d | 040254 | 196618 | N/A | | Serinc2 | 023232 | 105996 | 101618 |
| Sema3d | 040254 | 197927 | 142453 | | Serinc2 | 023232 | 120126 | 113044 |
| Sema3d | 040254 | 196093 | N/A | | Serinc2 | 023232 | 146478 | 115198 |
| Sema3d | 040254 | 195923 | N/A | | Serinc2 | 023232 | 154846 | 116586 |
| Sema4d | 021451 | 110040 | 105667 | | Serpinb1a | 044734 | 076352 | 075690 |
| Sema4d | 021451 | 021900 | 021900 | | Serpinb1a | 044734 | 223016 | N/A |
| Sema4d | 021451 | 110039 | 105666 | | Serpinb1a | 044734 | 091668 | 089257 |
| Sema4d | 021451 | 125511 | N/A | | Serpinb1a | 044734 | 221967 | N/A |
| Sema4d | 021451 | 138228 | N/A | | Serpine2 | 026249 | 027467 | 027467 |
| Sema4d | 021451 | 139865 | N/A | | Serpine2 | 026249 | 189793 | 140065 |
| Sema4d | 021451 | 150662 | N/A | | Serpine2 | 026249 | 190724 | 140255 |
| Sema4d | 021451 | 139018 | N/A | | Serpine2 | 026249 | 153862 | N/A |
| Sema4d | 021451 | 146238 | N/A | | Serpine2 | 026249 | 191529 | N/A |
| Sema4d | 021451 | 146922 | N/A | | Serpine2 | 026249 | 191026 | N/A |
| Sema4d | 021451 | 143396 | N/A | | Serpinh1 | 070436 | 169437 | 126390 |
| Sema4d | 021451 | 139858 | N/A | | Serpinh1 | 070436 | 094154 | 091706 |
| Sema4d | 021451 | 155896 | N/A | | Serpinh1 | 070436 | 208119 | 146969 |
| Sema5a | 022231 | 226876 | N/A | | Serpinh1 | 070436 | 207849 | 147064 |
| Sema5a | 022231 | 067458 | 069024 | | Serpinh1 | 070436 | 208749 | 146515 |
| Sema5a | 022231 | 228442 | N/A | | Serpinh1 | 070436 | 207989 | 146444 |
| Sema5a | 022231 | 228103 | N/A | | Serpinh1 | 070436 | 208292 | 146373 |
| Sema5a | 022231 | 228555 | N/A | | Serpini1 | 027834 | 161776 | 123845 |
| Sema5a | 022231 | 228015 | N/A | | Serpini1 | 027834 | 029423 | 029423 |
| Sema5a | 022231 | 227802 | N/A | | Serpini1 | 027834 | 195285 | N/A |
| Sema5a | 022231 | 227976 | N/A | | Serpini1 | 027834 | 161695 | N/A |
| Sema5a | 022231 | 227429 | N/A | | Serpini2 | 034139 | 039047 | 046943 |
| Sema6a | 019647 | 019791 | 019791 | | Sertm1 | 056306 | 162201 | 124102 |
| Sema6a | 019647 | 076043 | 075420 | | Sertm1 | 056306 | 070342 | 064870 |
| Sema6a | 019647 | 135790 | 120011 | | Sestd1 | 042272 | 102660 | 099721 |
| Sema6a | 019647 | 141224 | N/A | | Sestd1 | 042272 | 102659 | 099720 |
| Sema6a | 019647 | 151382 | N/A | | Sestd1 | 042272 | 145366 | N/A |
| Sema6a | 019647 | 156422 | 121442 | | Sestd1 | 042272 | 139021 | N/A |
| Sema6a | 019647 | 126684 | 118655 | | Setbp1 | 024548 | 025430 | 025430 |
| Sema6a | 019647 | 144223 | N/A | | Sez6l2 | 030683 | 106335 | 101942 |
| Sema6a | 019647 | 123228 | 120249 | | Sez6l2 | 030683 | 146017 | 115905 |
| Sema6a | 019647 | 115449 | 111109 | | Sez6l2 | 030683 | 106333 | 101940 |
| Sema6d | 027200 | 103241 | 099531 | | Sez6l2 | 030683 | 106332 | 101939 |
| Sema6d | 027200 | 137172 | N/A | | Sez6l2 | 030683 | 125669 | 145667 |
| Sema6d | 027200 | 151199 | N/A | | Sez6l2 | 030683 | 134471 | N/A |
| Sema6d | 027200 | 103240 | 099530 | | Sez6l2 | 030683 | 155138 | 146086 |
| Sema6d | 027200 | 132088 | N/A | | Sgcd | 020354 | 154578 | N/A |
| Sema6d | 027200 | 051419 | 061123 | | Sgcd | 020354 | 077221 | 076459 |

TABLE 2-continued

| ENSEMBL IDs for mice | | | |
|---|---|---|---|
| Symbol | MUSG | MUST | MUSP |
| Sgcd | 020354 | 109220 | 104843 |
| Sgcd | 020354 | 128558 | N/A |
| Sgms2 | 050931 | 090246 | 087713 |
| Sgms2 | 050931 | 126569 | 114192 |
| Sgms2 | 050931 | 197057 | 143170 |
| Sgms2 | 050931 | 200431 | N/A |
| Sh2d1a | 005696 | 129855 | N/A |
| Sh2d1a | 005696 | 189753 | 141070 |
| Sh2d1a | 005696 | 005839 | 005839 |
| Sh2d1a | 005696 | 115070 | 110722 |
| Sh2d1a | 005696 | 153948 | 138624 |
| Sh2d1a | 005696 | 128393 | N/A |
| Sh2d1a | 005696 | 101619 | N/A |
| Sh2d4b | 037833 | 070328 | 064708 |
| Sh2d4b | 037833 | 096000 | 093699 |
| Sh2d4b | 037833 | 225854 | N/A |
| Sh3bgrl2 | 032261 | 188241 | 140951 |
| Sh3bgrl2 | 032261 | 113215 | 108841 |
| Sh3bgrl2 | 032261 | 188617 | N/A |
| Sh3bgrl2 | 032261 | 188030 | 140348 |
| Sh3bgrl2 | 032261 | 185664 | N/A |
| Sh3bp4 | 036206 | 066279 | 067581 |
| Sh3bp4 | 036206 | 123745 | N/A |
| Sh3d19 | 028082 | 182969 | N/A |
| Sh3d19 | 028082 | 182723 | N/A |
| Sh3d19 | 028082 | 183119 | N/A |
| Sh3d19 | 028082 | 182399 | N/A |
| Sh3d19 | 028082 | 182666 | 138320 |
| Sh3d19 | 028082 | 183202 | N/A |
| Sh3d19 | 028082 | 107664 | 103291 |
| Sh3rf1 | 031642 | 034060 | 034060 |
| Sh3rf1 | 031642 | 209611 | 148118 |
| Sh3rf1 | 031642 | 210210 | N/A |
| Sh3rf3 | 037990 | 135526 | 114368 |
| Sh3rf3 | 037990 | 153031 | 120938 |
| Sh3rf3 | 037990 | 133151 | N/A |
| Sh3rf3 | 037990 | 148267 | N/A |
| Sh3rf3 | 037990 | 152924 | N/A |
| Sh3tc2 | 045629 | 051720 | 055094 |
| Shank1 | 038738 | 107938 | 103571 |
| Shank1 | 038738 | 107935 | 103568 |
| Shank1 | 038738 | 107934 | 103567 |
| Shank1 | 038738 | 134470 | N/A |
| Shank1 | 038738 | 154776 | N/A |
| Shank1 | 038738 | 127164 | N/A |
| Shank3 | 022623 | 109309 | 104932 |
| Shank3 | 022623 | 135214 | N/A |
| Shank3 | 022623 | 066545 | 064477 |
| Shank3 | 022623 | 154240 | N/A |
| Shank3 | 022623 | 123799 | N/A |
| Shank3 | 022623 | 167173 | 132229 |
| Shank3 | 022623 | 039074 | 048062 |
| Shc3 | 021448 | 021898 | 021898 |
| Shc3 | 021448 | 223543 | 152080 |
| Shc3 | 021448 | 221850 | N/A |
| Shc4 | 035109 | 042246 | 043146 |
| Shc4 | 035109 | 110480 | 106106 |
| Shc4 | 035109 | 110477 | 106103 |
| Shc4 | 035109 | 157002 | N/A |
| Shisa6 | 053930 | 134562 | N/A |
| Shisa6 | 053930 | 123454 | 120862 |
| Shisa6 | 053930 | 066679 | 071025 |
| Shisa7 | 053550 | 117452 | 112405 |
| Shisa7 | 053550 | 119433 | 112423 |
| Shisa7 | 053550 | 157068 | N/A |
| Shisa7 | 053550 | 132806 | N/A |
| Shisa7 | 053550 | 066041 | 064886 |
| Shroom3 | 029381 | 113055 | 108678 |
| Shroom3 | 029381 | 168878 | 130419 |
| Shroom3 | 029381 | 202767 | N/A |
| Shroom3 | 029381 | 113054 | 108677 |
| Shroom3 | 029381 | 172849 | N/A |
| Shroom3 | 029381 | 225438 | 153516 |
| Shroom3 | 029381 | 113051 | 108674 |
| Shroom3 | 029381 | 172706 | 133690 |
| Shroom3 | 029381 | 201800 | N/A |

TABLE 2-continued

| ENSEMBL IDs for mice | | | |
|---|---|---|---|
| Symbol | MUSG | MUST | MUSP |
| Shroom3 | 029381 | 200869 | N/A |
| Shroom3 | 029381 | 172752 | N/A |
| Shroom4 | 068270 | 103005 | 100070 |
| Shroom4 | 068270 | 143641 | 131806 |
| Shroom4 | 068270 | 089520 | 086949 |
| Shtn1 | 041362 | 047511 | 041378 |
| Shtn1 | 041362 | 163821 | 126227 |
| Siah3 | 091722 | 164848 | 130827 |
| Sidt1 | 022696 | 127567 | 116201 |
| Sidt1 | 022696 | 136381 | 115372 |
| Sidt1 | 022696 | 047446 | 038433 |
| Sidt1 | 022696 | 127124 | N/A |
| Sidt1 | 022696 | 147032 | 114424 |
| Sidt1 | 022696 | 124651 | N/A |
| Sipa1l1 | 042700 | 220550 | N/A |
| Sipa1l1 | 042700 | 166429 | 131030 |
| Sipa1l1 | 042700 | 220963 | 152681 |
| Sipa1l1 | 042700 | 222312 | N/A |
| Sipa1l1 | 042700 | 222849 | N/A |
| Sipa1l1 | 042700 | 222298 | 152356 |
| Sipa1l1 | 042700 | 222714 | 152212 |
| Sipa1l1 | 042700 | 220766 | N/A |
| Sipa1l1 | 042700 | 221169 | 152485 |
| Sipa1l1 | 042700 | 221327 | N/A |
| Sipa1l1 | 042700 | 053969 | 061014 |
| Sipa1l3 | 030583 | 183330 | 138345 |
| Sipa1l3 | 030583 | 182223 | N/A |
| Sipa1l3 | 030583 | 183096 | 138171 |
| Sipa1l3 | 030583 | 182009 | N/A |
| Sipa1l3 | 030583 | 182780 | 138311 |
| Sipa1l3 | 030583 | 182484 | 138714 |
| Sipa1l3 | 030583 | 182829 | N/A |
| Sipa1l3 | 030583 | 183164 | N/A |
| Sipa1l3 | 030583 | 182911 | N/A |
| Sipa1l3 | 030583 | 183275 | 138381 |
| Sipa1l3 | 030583 | 182529 | N/A |
| Sipa1l3 | 030583 | 182011 | N/A |
| Sipa1l3 | 030583 | 181975 | 138592 |
| Sipa1l3 | 030583 | 182702 | N/A |
| Sipa1l3 | 030583 | 182236 | N/A |
| Sipa1l3 | 030583 | 183081 | N/A |
| Sipa1l3 | 030583 | 183085 | N/A |
| Sipa1l3 | 030583 | 085809 | 082965 |
| Sirpa | 037902 | 127751 | N/A |
| Sirpa | 037902 | 136153 | N/A |
| Sirpa | 037902 | 153491 | 120324 |
| Sirpa | 037902 | 161620 | 124048 |
| Sirpa | 037902 | 136554 | N/A |
| Sirpa | 037902 | 103203 | 099492 |
| Sirpa | 037902 | 103202 | 099491 |
| Sirpa | 037902 | 049262 | 049022 |
| Sirpa | 037902 | 160952 | N/A |
| Sirpa | 037902 | 163034 | 124888 |
| Sirpa | 037902 | 160276 | 125004 |
| Sirpa | 037902 | 162764 | N/A |
| Sirpa | 037902 | 099113 | 096713 |
| Sirpa | 037902 | 179001 | 137611 |
| Skap2 | 059182 | 204778 | 145462 |
| Skap2 | 059182 | 205174 | N/A |
| Skap2 | 059182 | 078214 | 077342 |
| Skap2 | 059182 | 203948 | 145275 |
| Skap2 | 059182 | 205112 | N/A |
| Skap2 | 059182 | 204178 | N/A |
| Skap2 | 059182 | 203313 | N/A |
| Skor1 | 022245 | 119146 | 113924 |
| Skor1 | 022245 | 116613 | 112312 |
| Skor1 | 022245 | 055281 | 055037 |
| Skor2 | 091519 | 166956 | 132338 |
| Slc12a2 | 024597 | 115366 | 111023 |
| Slc12a8 | 035506 | 121925 | 112439 |
| Slc12a8 | 035506 | 119173 | 113633 |
| Slc12a8 | 035506 | 122314 | 113901 |
| Slc12a8 | 035506 | 122427 | 113164 |
| Slc12a8 | 035506 | 117134 | 112925 |
| Slc12a8 | 035506 | 149291 | N/A |
| Slc12a8 | 035506 | 059056 | 062337 |

TABLE 2-continued

TABLE 2-continued

| ENSEMBL IDs for mice | | | | | ENSEMBL IDs for mice | | | |
| --- | --- | --- | --- | --- | --- | --- | --- | --- |
| Symbol | MUSG | MUST | MUSP | | Symbol | MUSG | MUST | MUSP |
| Slc14a1 | 059336 | 091813 | 089421 | | Slc2a4 | 018566 | 018710 | 018710 |
| Slc14a1 | 059336 | 160292 | 125114 | | Slc2a4 | 018566 | 141837 | 136806 |
| Slc14a1 | 059336 | 160639 | 125367 | | Slc2a4 | 018566 | 152487 | 136504 |
| Slc14a2 | 024552 | 025434 | 025434 | | Slc2a4 | 018566 | 178363 | 136455 |
| Slc14a2 | 024552 | 163367 | 126416 | | Slc2a4 | 018566 | 179298 | 136726 |
| Slc16a10 | 019838 | 092566 | 090227 | | Slc2a4 | 018566 | 142500 | 137463 |
| Slc16a10 | 019838 | 213827 | 151126 | | Slc2a4 | 018566 | 135437 | 137092 |
| Slc16a10 | 019838 | 213488 | 150416 | | Slc30a3 | 029151 | 031037 | 031037 |
| Slc16a10 | 019838 | 217252 | N/A | | Slc30a3 | 029151 | 202740 | 144566 |
| Slc17a7 | 070570 | 085374 | 082489 | | Slc30a3 | 029151 | 201783 | 144353 |
| Slc17a7 | 070570 | 209634 | 147661 | | Slc30a3 | 029151 | 202731 | 144574 |
| Slc17a7 | 070570 | 210498 | N/A | | Slc30a3 | 029151 | 200906 | 144098 |
| Slc17a7 | 070570 | 210540 | N/A | | Slc30a3 | 029151 | 201396 | 144295 |
| Slc17a7 | 070570 | 211652 | N/A | | Slc31a2 | 066152 | 107468 | 103092 |
| Slc19a1 | 001436 | 136150 | 121237 | | Slc31a2 | 066152 | 084530 | 081578 |
| Slc19a1 | 001436 | 133059 | 120266 | | Slc31a2 | 066152 | 107467 | 103091 |
| Slc19a1 | 001436 | 144234 | 116784 | | Slc32a1 | 037771 | 045738 | 036299 |
| Slc19a1 | 001436 | 105410 | 101050 | | Slc35d1 | 028521 | 150285 | 122124 |
| Slc19a1 | 001436 | 136925 | 119382 | | Slc35d1 | 028521 | 036195 | 037617 |
| Slc19a1 | 001436 | 130703 | 115658 | | Slc35d1 | 028521 | 183432 | 138926 |
| Slc19a1 | 001436 | 132984 | 116657 | | Slc35d1 | 028521 | 094947 | N/A |
| Slc19a1 | 001436 | 127249 | N/A | | Slc35d1 | 028521 | 154845 | N/A |
| Slc19a1 | 001436 | 131031 | 114884 | | Slc35f1 | 038602 | 105473 | 101113 |
| Slc1a1 | 024935 | 161340 | N/A | | Slc38a1 | 023169 | 088452 | 085799 |
| Slc1a1 | 024935 | 025875 | 025875 | | Slc38a1 | 023169 | 088454 | 085801 |
| Slc1a1 | 024935 | 161119 | N/A | | Slc38a1 | 023169 | 100262 | 097833 |
| Slc1a1 | 024935 | 160702 | N/A | | Slc39a12 | 036949 | 114731 | 110379 |
| Slc1a1 | 024935 | 162189 | N/A | | Slc39a12 | 036949 | 082290 | 080911 |
| Slc1a4 | 020142 | 004634 | 004634 | | Slc39a12 | 036949 | 133258 | 122795 |
| Slc1a4 | 020142 | 109594 | 105223 | | Slc41a1 | 013275 | 132585 | N/A |
| Slc1a6 | 005357 | 005490 | 005490 | | Slc41a1 | 013275 | 086559 | 083747 |
| Slc1a6 | 005357 | 217717 | 151544 | | Slc41a1 | 013275 | 146360 | N/A |
| Slc20a1 | 027397 | 028880 | 028880 | | Slc43a2 | 038178 | 042561 | 046074 |
| Slc20a1 | 027397 | 140907 | N/A | | Slc43a2 | 038178 | 108433 | 104071 |
| Slc20a1 | 027397 | 144744 | N/A | | Slc43a2 | 038178 | 151891 | N/A |
| Slc20a1 | 027397 | 141285 | N/A | | Slc43a2 | 038178 | 145901 | N/A |
| Slc20a1 | 027397 | 148988 | 121074 | | Slc43a2 | 038178 | 134112 | N/A |
| Slc20a1 | 027397 | 110315 | 105944 | | Slc43a2 | 038178 | 155981 | N/A |
| Slc20a1 | 027397 | 125714 | N/A | | Slc43a2 | 038178 | 127226 | 117264 |
| Slc20a1 | 027397 | 144025 | N/A | | Slc43a2 | 038178 | 143035 | 123101 |
| Slc22a15 | 033147 | 106928 | 102541 | | Slc43a2 | 038178 | 149727 | 116255 |
| Slc22a15 | 033147 | 190824 | 139518 | | Slc43a2 | 038178 | 152775 | N/A |
| Slc22a15 | 033147 | 182130 | N/A | | Slc43a2 | 038178 | 169547 | 126838 |
| Slc22a15 | 033147 | 183293 | N/A | | Slc44a5 | 028360 | 089948 | 087394 |
| Slc22a15 | 033147 | 183255 | 138357 | | Slc44a5 | 028360 | 128362 | N/A |
| Slc22a15 | 033147 | 183098 | N/A | | Slc44a5 | 028360 | 144677 | N/A |
| Slc22a15 | 033147 | 182040 | N/A | | Slc45a1 | 039838 | 037827 | 036774 |
| Slc22a23 | 038267 | 148390 | 122283 | | Slc45a1 | 039838 | 117997 | 112737 |
| Slc22a23 | 038267 | 040336 | 042742 | | Slc45a1 | 039838 | 147706 | N/A |
| Slc22a23 | 038267 | 128392 | N/A | | Slc4a4 | 060961 | 148750 | 119325 |
| Slc22a23 | 038267 | 145038 | 122376 | | Slc4a4 | 060961 | 135283 | N/A |
| Slc22a23 | 038267 | 143353 | N/A | | Slc4a4 | 060961 | 113218 | 108844 |
| Slc22a4 | 020334 | 020586 | 020586 | | Slc4a4 | 060961 | 156238 | 121744 |
| Slc22a4 | 020334 | 146351 | N/A | | Slc4a4 | 060961 | 144713 | 122975 |
| Slc22a4 | 020334 | 154369 | N/A | | Slc4a4 | 060961 | 130041 | 118413 |
| Slc24a3 | 063873 | 153249 | N/A | | Slc4a4 | 060961 | 113216 | 108842 |
| Slc24a3 | 063873 | 131123 | N/A | | Slc4a4 | 060961 | 134303 | 119976 |
| Slc24a3 | 063873 | 110007 | 105634 | | Slc4a7 | 021733 | 057015 | 058313 |
| Slc24a3 | 063873 | 137908 | N/A | | Slc4a7 | 021733 | 225496 | N/A |
| Slc24a3 | 063873 | 081121 | 079897 | | Slc4a7 | 021733 | 225232 | 153280 |
| Slc24a4 | 041771 | 159329 | 124513 | | Slc4a7 | 021733 | 224197 | N/A |
| Slc24a4 | 041771 | 079020 | 078030 | | Slc4a7 | 021733 | 223981 | 153084 |
| Slc24a4 | 041771 | 161325 | 125012 | | Slc4a7 | 021733 | 223607 | 153180 |
| Slc25a18 | 004902 | 112682 | 108302 | | Slc4a7 | 021733 | 225238 | 152984 |
| Slc25a33 | 028982 | 105686 | 101311 | | Slc4a7 | 021733 | 223761 | 153045 |
| Slc26a3 | 001225 | 167432 | 130676 | | Slc4a7 | 021733 | 225175 | 153166 |
| Slc26a3 | 001225 | 171616 | 128722 | | Slc4a7 | 021733 | 224222 | 153116 |
| Slc26a3 | 001225 | 110854 | 106478 | | Slc4a7 | 021733 | 225630 | 153597 |
| Slc26a3 | 001225 | 001254 | 001254 | | Slc4a7 | 021733 | 225979 | 153690 |
| Slc26a3 | 001225 | 168209 | N/A | | Slc4a7 | 021733 | 226079 | 153323 |
| Slc26a3 | 001225 | 165816 | N/A | | Slc4a7 | 021733 | 224952 | 153345 |
| Slc26a3 | 001225 | 109275 | N/A | | Slc4a7 | 021733 | 223695 | 153648 |
| Slc27a6 | 024600 | 025500 | 025500 | | Slc4a7 | 021733 | 224333 | 153470 |
| Slc2a10 | 027661 | 029196 | 029196 | | Slc4a7 | 021733 | 223740 | 152933 |
| Slc2a10 | 027661 | 148463 | N/A | | Slc4a7 | 021733 | 224672 | 152950 |
| Slc2a4 | 018566 | 178809 | N/A | | Slc4a7 | 021733 | 224049 | 153093 |

TABLE 2-continued

| ENSEMBL IDs for mice | | | |
|---|---|---|---|
| Symbol | MUSG | MUST | MUSP |
| Slc4a7 | 021733 | 224752 | 153185 |
| Slc4a7 | 021733 | 225078 | N/A |
| Slc4a7 | 021733 | 223771 | 153532 |
| Slc4a7 | 021733 | 225508 | N/A |
| Slc4a7 | 021733 | 224750 | N/A |
| Slc4a7 | 021733 | 225613 | N/A |
| Slc5a11 | 030769 | 131933 | 121459 |
| Slc5a11 | 030769 | 140721 | N/A |
| Slc5a11 | 030769 | 033035 | 033035 |
| Slc5a11 | 030769 | 131461 | 123027 |
| Slc5a11 | 030769 | 127655 | 117956 |
| Slc5a11 | 030769 | 131209 | 120678 |
| Slc5a11 | 030769 | 206180 | N/A |
| Slc5a11 | 030769 | 167299 | 127977 |
| Slc5a7 | 023945 | 095712 | 093379 |
| Slc6a7 | 052026 | 025520 | 025520 |
| Slc7a1 | 041313 | 048116 | 046714 |
| Slc7a1 | 041313 | 138257 | 117781 |
| Slc7a1 | 041313 | 201860 | N/A |
| Slc7a1 | 041313 | 202457 | 144000 |
| Slc7a1 | 041313 | 138596 | 122914 |
| Slc7a1 | 041313 | 201348 | N/A |
| Slc7a10 | 030495 | 135452 | 127577 |
| Slc7a10 | 030495 | 001854 | 001854 |
| Slc7a10 | 030495 | 131048 | 118331 |
| Slc7a10 | 030495 | 167441 | 129954 |
| Slc7a10 | 030495 | 146959 | 127311 |
| Slc7a11 | 027737 | 194462 | 141988 |
| Slc7a11 | 027737 | 029297 | 029297 |
| Slc7a11 | 027737 | 192564 | N/A |
| Slc7a11 | 027737 | 142932 | N/A |
| Slc7a11 | 027737 | 193838 | N/A |
| Slc7a14 | 069072 | 091259 | 088803 |
| Slc7a14 | 069072 | 108245 | 103880 |
| Slc7a3 | 031297 | 138162 | N/A |
| Slc7a3 | 031297 | 101362 | 098914 |
| Slc7a3 | 031297 | 113710 | 109339 |
| Slc7a3 | 031297 | 126282 | N/A |
| Slc7a3 | 031297 | 144410 | N/A |
| Slc7a3 | 031297 | 151922 | N/A |
| Slc7a3 | 031297 | 073927 | 073582 |
| Slc8a1 | 054640 | 163680 | 126373 |
| Slc8a1 | 054640 | 086538 | 083725 |
| Slc8a1 | 054640 | 163123 | 132809 |
| Slc8a2 | 030376 | 211649 | 147497 |
| Slc8a2 | 030376 | 168693 | 128926 |
| Slc8a3 | 079055 | 085238 | 082334 |
| Slc8a3 | 079055 | 064594 | 063258 |
| Slc8a3 | 079055 | 182208 | 138735 |
| Slc8a3 | 079055 | 182366 | 138803 |
| Slc8a3 | 079055 | 183102 | N/A |
| Slc8b1 | 032754 | 068326 | 064714 |
| Slc8b1 | 032754 | 111890 | 107521 |
| Slc8b1 | 032754 | 076051 | 075428 |
| Slc8b1 | 032754 | 147496 | 120947 |
| Slc8b1 | 032754 | 140329 | 117260 |
| Slc8b1 | 032754 | 111889 | 107520 |
| Slc8b1 | 032754 | 123326 | N/A |
| Slc9a3 | 036123 | 221410 | N/A |
| Slc9a3 | 036123 | 225423 | 153255 |
| Slc9a3 | 036123 | 221703 | 152682 |
| Slc9a3 | 036123 | 036208 | 038142 |
| Slc9a9 | 031129 | 033463 | 033463 |
| Slc9a9 | 031129 | 162870 | N/A |
| Slc9a9 | 031129 | 162329 | N/A |
| Slco4a1 | 038963 | 038259 | 046502 |
| Slco4a1 | 038963 | 139902 | N/A |
| Slco4a1 | 038963 | 038225 | 045023 |
| Slco4a1 | 038963 | 138446 | N/A |
| Slco4a1 | 038963 | 128367 | N/A |
| Slco4c1 | 040693 | 071985 | 071875 |
| Slit3 | 056427 | 069837 | 066857 |
| Slit3 | 056427 | 156571 | N/A |
| Slit3 | 056427 | 153098 | N/A |
| Slit3 | 056427 | 124438 | N/A |
| Slitrk1 | 075478 | 100322 | 097897 |

TABLE 2-continued

| ENSEMBL IDs for mice | | | |
|---|---|---|---|
| Symbol | MUSG | MUST | MUSP |
| Slitrk6 | 045871 | 078386 | 077492 |
| Smad3 | 032402 | 034973 | 034973 |
| Smad3 | 032402 | 154323 | 116790 |
| Smad3 | 032402 | 137065 | N/A |
| Smad3 | 032402 | 133108 | 122217 |
| Smad3 | 032402 | 137713 | 121671 |
| Smad7 | 025880 | 026999 | 026999 |
| Smad7 | 025880 | 174843 | 133544 |
| Smad7 | 025880 | 174411 | 133696 |
| Smad7 | 025880 | 172718 | N/A |
| Smad7 | 025880 | 168918 | 129322 |
| Smpx | 041476 | 038007 | 048522 |
| Smpx | 041476 | 136141 | 119573 |
| Smpx | 041476 | 112520 | 108139 |
| Smpx | 041476 | 147283 | 120412 |
| Smpx | 041476 | 112521 | 108140 |
| Smpx | 041476 | 132805 | N/A |
| Smpx | 041476 | 126418 | N/A |
| Smpx | 041476 | 190091 | 140268 |
| Sned1 | 047793 | 062202 | 050832 |
| Sned1 | 047793 | 172289 | N/A |
| Sned1 | 047793 | 165843 | N/A |
| Sned1 | 047793 | 163688 | 132455 |
| Sned1 | 047793 | 168122 | N/A |
| Sned1 | 047793 | 165883 | N/A |
| Snfb1 | 060429 | 039769 | 041294 |
| Snfb1 | 060429 | 110200 | 105829 |
| Snfb1 | 060429 | 140574 | N/A |
| Snx33 | 032733 | 050916 | 060225 |
| Soat1 | 026600 | 187987 | N/A |
| Soat1 | 026600 | 191379 | N/A |
| Soat1 | 026600 | 187507 | 139431 |
| Soat1 | 026600 | 187073 | N/A |
| Soat1 | 026600 | 188027 | 141074 |
| Soat1 | 026600 | 186420 | N/A |
| Soat1 | 026600 | 189661 | 140721 |
| Soat1 | 026600 | 051396 | 058344 |
| Sobp | 038248 | 040275 | 040072 |
| Sobp | 038248 | 189987 | N/A |
| Socs2 | 020027 | 139210 | 121305 |
| Socs2 | 020027 | 130784 | N/A |
| Socs2 | 020027 | 128854 | N/A |
| Socs2 | 020027 | 155148 | N/A |
| Socs2 | 020027 | 020215 | 020215 |
| Socs2 | 020027 | 134918 | N/A |
| Socs2 | 020027 | 119917 | 113378 |
| Socs2 | 020027 | 135822 | 118720 |
| Socs2 | 020027 | 150432 | 117785 |
| Socs2 | 020027 | 129942 | 117576 |
| Socs2 | 020027 | 128363 | N/A |
| Socs2 | 020027 | 145847 | N/A |
| Socs2 | 020027 | 170690 | 129331 |
| Socs2 | 020027 | 172070 | 131875 |
| Sod3 | 072941 | 101208 | 098768 |
| Sorbs2 | 031626 | 209534 | N/A |
| Sorbs2 | 031626 | 124544 | 147462 |
| Sorbs2 | 031626 | 138049 | 123503 |
| Sorbs2 | 031626 | 132139 | 123250 |
| Sorbs2 | 031626 | 141039 | 117544 |
| Sorbs2 | 031626 | 171337 | 128000 |
| Sorbs2 | 031626 | 067107 | 067641 |
| Sorbs2 | 031626 | 145458 | 116536 |
| Sorbs2 | 031626 | 134321 | 115842 |
| Sorbs2 | 031626 | 135336 | 114286 |
| Sorbs2 | 031626 | 127395 | N/A |
| Sorbs2 | 031626 | 130850 | 123195 |
| Sorbs2 | 031626 | 153798 | 118353 |
| Sorbs2 | 031626 | 210946 | 147573 |
| Sorbs2 | 031626 | 134675 | 118160 |
| Sorbs2 | 031626 | 139869 | 121235 |
| Sorbs2 | 031626 | 133864 | N/A |
| Sorbs2 | 031626 | 211095 | 148072 |
| Sorbs2 | 031626 | 126067 | 118562 |
| Sorbs2 | 031626 | 136119 | N/A |
| Sorbs2 | 031626 | 143820 | 119539 |
| Sorbs2 | 031626 | 149752 | 121073 |

TABLE 2-continued

| ENSEMBL IDs for mice | | | |
|---|---|---|---|
| Symbol | MUSG | MUST | MUSP |
| Sorbs2 | 031626 | 130011 | 121619 |
| Sorbs2 | 031626 | 150102 | 114951 |
| Sorbs2 | 031626 | 139103 | 119380 |
| Sorbs2 | 031626 | 211442 | N/A |
| Sorbs2 | 031626 | 125295 | 116768 |
| Sorbs2 | 031626 | 132767 | N/A |
| Sorbs2 | 031626 | 140088 | 114158 |
| Sorbs2 | 031626 | 155858 | 122820 |
| Sorbs2 | 031626 | 132730 | N/A |
| Sorbs2 | 031626 | 146627 | 120487 |
| Sorbs2 | 031626 | 211721 | N/A |
| Sorbs2 | 031626 | 136344 | N/A |
| Sorbs2 | 031626 | 156549 | N/A |
| Sorbs2 | 031626 | 067065 | 070720 |
| Sorbs3 | 022091 | 227653 | 154195 |
| Sorbs3 | 022091 | 022682 | 022682 |
| Sorbs3 | 022091 | 227259 | 153715 |
| Sorbs3 | 022091 | 227929 | 154773 |
| Sorcs3 | 063434 | 078880 | 077919 |
| Sox10 | 033006 | 040019 | 039466 |
| Sox13 | 070643 | 144386 | 122980 |
| Sox13 | 070643 | 153799 | 119729 |
| Sox13 | 070643 | 145922 | N/A |
| Sox13 | 070643 | 126530 | N/A |
| Sox13 | 070643 | 094551 | 092130 |
| Sox2 | 074637 | 099151 | 096755 |
| Sox6 | 051910 | 206034 | 145919 |
| Sox6 | 051910 | 169129 | 126404 |
| Sox6 | 051910 | 206369 | 145931 |
| Sox6 | 051910 | 205405 | 145732 |
| Sox6 | 051910 | 205980 | N/A |
| Sox6 | 051910 | 206775 | N/A |
| Sox6 | 051910 | 206573 | N/A |
| Sox6 | 051910 | 205479 | 145561 |
| Sox6 | 051910 | 206427 | N/A |
| Sox6 | 051910 | 206123 | 145576 |
| Sox6 | 051910 | 205818 | N/A |
| Sox6 | 051910 | 206912 | N/A |
| Sox6 | 051910 | 072804 | 072583 |
| Sox6 | 051910 | 166877 | 129512 |
| Sox6 | 051910 | 106612 | 102223 |
| Sox6 | 051910 | 166207 | 129027 |
| Sox8 | 024176 | 025003 | 025003 |
| Sox8 | 024176 | 174560 | 133742 |
| Sox8 | 024176 | 173447 | 133403 |
| Sox9 | 000567 | 000579 | 000579 |
| Sp5 | 075304 | 100043 | 097620 |
| Spag5 | 002055 | 045026 | 045286 |
| Spag5 | 002055 | 133579 | N/A |
| Spag5 | 002055 | 146068 | N/A |
| Spag5 | 002055 | 141026 | N/A |
| Spag5 | 002055 | 150016 | N/A |
| Spag5 | 002055 | 149711 | N/A |
| Spag5 | 002055 | 128359 | N/A |
| Spag5 | 002055 | 125477 | N/A |
| Sparc | 018593 | 108858 | 104486 |
| Sparc | 018593 | 018737 | 018737 |
| Sparc | 018593 | 123775 | N/A |
| Sparc | 018593 | 213866 | 149604 |
| Sparc | 018593 | 216313 | 149918 |
| Sparc | 018593 | 214685 | 151000 |
| Sparc | 018593 | 130642 | N/A |
| Sparc | 018593 | 141530 | 119475 |
| Sparc | 018593 | 125787 | N/A |
| Sparcl1 | 029309 | 031249 | 031249 |
| Sparcl1 | 029309 | 199947 | 143177 |
| Specc1 | 042331 | 201866 | N/A |
| Specc1 | 042331 | 202178 | 144161 |
| Specc1 | 042331 | 136971 | N/A |
| Specc1 | 042331 | 202389 | 144055 |
| Specc1 | 042331 | 202869 | N/A |
| Specc1 | 042331 | 201624 | 144659 |
| Specc1 | 042331 | 049836 | 063102 |
| Specc1 | 042331 | 202905 | 144311 |
| Specc1 | 042331 | 201364 | 143853 |
| Specc1 | 042331 | 092415 | 090071 |

TABLE 2-continued

| ENSEMBL IDs for mice | | | |
|---|---|---|---|
| Symbol | MUSG | MUST | MUSP |
| Specc1 | 042331 | 201015 | 144174 |
| Specc1 | 042331 | 200742 | N/A |
| Specc1 | 042331 | 202744 | 144483 |
| Specc1 | 042331 | 201723 | 144542 |
| Specc1 | 042331 | 202179 | 144300 |
| Specc1 | 042331 | 108709 | 104349 |
| Specc1 | 042331 | 201671 | 144030 |
| Speg | 026207 | 087122 | 084361 |
| Speg | 026207 | 148515 | 116953 |
| Speg | 026207 | 113590 | 109220 |
| Speg | 026207 | 187214 | N/A |
| Speg | 026207 | 125306 | 119969 |
| Speg | 026207 | 146705 | N/A |
| Speg | 026207 | 125118 | N/A |
| Speg | 026207 | 132228 | 121825 |
| Speg | 026207 | 132222 | N/A |
| Speg | 026207 | 137868 | 141009 |
| Speg | 026207 | 113589 | 109219 |
| Speg | 026207 | 113588 | 109218 |
| Speg | 026207 | 113587 | 109217 |
| Speg | 026207 | 122266 | 113646 |
| Speg | 026207 | 143679 | N/A |
| Sphkap | 026163 | 160953 | 124872 |
| Sphkap | 026163 | 159078 | 124384 |
| Sphkap | 026163 | 053075 | N/A |
| Sphkap | 026163 | 160237 | N/A |
| Sphkap | 026163 | 160567 | N/A |
| Spock3 | 054162 | 117377 | 113797 |
| Spock3 | 054162 | 118003 | 113683 |
| Spock3 | 054162 | 138398 | N/A |
| Spock3 | 054162 | 119068 | 112930 |
| Spock3 | 054162 | 141513 | N/A |
| Spock3 | 054162 | 093480 | 091192 |
| Spon1 | 038156 | 046687 | 041157 |
| Spon1 | 038156 | 084696 | 081746 |
| Spp1 | 029304 | 086833 | 084043 |
| Spp1 | 029304 | 031243 | 031243 |
| Spp1 | 029304 | 112748 | 108368 |
| Spp1 | 029304 | 112746 | 108366 |
| Spp1 | 029304 | 145084 | 117338 |
| Spp1 | 029304 | 132457 | 123163 |
| Spp1 | 029304 | 112747 | 108367 |
| Spsb4 | 046997 | 055433 | 057849 |
| Spsb4 | 046997 | 162307 | N/A |
| Spsb4 | 046997 | 159298 | N/A |
| Spsb4 | 046997 | 064445 | N/A |
| Sptb | 021061 | 021458 | 021458 |
| Sptb | 021061 | 170532 | N/A |
| Sptb | 021061 | 166101 | 129782 |
| Sptbn2 | 067889 | 008991 | 008991 |
| Src | 027646 | 109533 | 105159 |
| Src | 027646 | 145715 | N/A |
| Src | 027646 | 029175 | 029175 |
| Src | 027646 | 133900 | N/A |
| Src | 027646 | 129770 | N/A |
| Src | 027646 | 109531 | 105157 |
| Src | 027646 | 109529 | 105155 |
| Src | 027646 | 092576 | 090237 |
| Srgap1 | 020121 | 020322 | 020322 |
| Srgap1 | 020121 | 161996 | N/A |
| Srgap1 | 020121 | 161156 | 125109 |
| Srgap1 | 020121 | 162710 | N/A |
| Srgap1 | 020121 | 081688 | 080389 |
| Ssh1 | 042121 | 159592 | 124312 |
| Ssh1 | 042121 | 112298 | 107917 |
| Ssh1 | 042121 | 077689 | 076873 |
| Ssh1 | 042121 | 159510 | 125025 |
| Ssh1 | 042121 | 162396 | 125388 |
| Ssh1 | 042121 | 162322 | N/A |
| St18 | 033740 | 140079 | 118322 |
| St18 | 033740 | 131494 | 117789 |
| St18 | 033740 | 043578 | 042056 |
| St18 | 033740 | 139756 | 142063 |
| St18 | 033740 | 131467 | 120134 |
| St18 | 033740 | 150761 | 120298 |
| St18 | 033740 | 151281 | 122055 |

TABLE 2-continued

ENSEMBL IDs for mice

| Symbol | MUSG | MUST | MUSP |
|---|---|---|---|
| St18 | 033740 | 139838 | 118129 |
| St18 | 033740 | 132207 | 142317 |
| St18 | 033740 | 142304 | N/A |
| St18 | 033740 | 151015 | N/A |
| St18 | 033740 | 130338 | 141266 |
| St18 | 033740 | 163727 | 131417 |
| St3gal5 | 056091 | 069994 | 070414 |
| St3gal5 | 056091 | 114112 | 109747 |
| St3gal5 | 056091 | 187007 | 146063 |
| St3gal5 | 056091 | 188366 | 145599 |
| St5 | 031024 | 084738 | 081789 |
| St5 | 031024 | 077909 | 077067 |
| St5 | 031024 | 207664 | N/A |
| St5 | 031024 | 208557 | N/A |
| St5 | 031024 | 207745 | 146934 |
| St5 | 031024 | 208981 | N/A |
| St5 | 031024 | 208583 | 146747 |
| St5 | 031024 | 207394 | 146549 |
| St5 | 031024 | 208734 | 146829 |
| St5 | 031024 | 079282 | 078264 |
| St5 | 031024 | 168005 | 130119 |
| St6galnac3 | 052544 | 200397 | 143747 |
| St6galnac3 | 052544 | 199707 | 143030 |
| St6galnac3 | 052544 | 064460 | 068598 |
| St6galnac3 | 052544 | 200576 | N/A |
| St6galnac3 | 052544 | 198775 | N/A |
| Stac | 032502 | 161995 | 125182 |
| Stac | 032502 | 035083 | 035083 |
| Stac | 032502 | 162345 | N/A |
| Stac2 | 017400 | 017544 | 017544 |
| Stac2 | 017400 | 131519 | 118164 |
| Stag3 | 036928 | 160729 | 124170 |
| Stag3 | 036928 | 161113 | N/A |
| Stag3 | 036928 | 159483 | N/A |
| Stag3 | 036928 | 048028 | 040945 |
| Stag3 | 036928 | 162245 | 125523 |
| Stag3 | 036928 | 161691 | 125290 |
| Stag3 | 036928 | 161615 | N/A |
| Stag3 | 036928 | 160849 | 125376 |
| Stag3 | 036928 | 159189 | 124959 |
| Stambpl1 | 024776 | 054956 | 059927 |
| Stambpl1 | 024776 | 125232 | N/A |
| Stambpl1 | 024776 | 119603 | 112938 |
| Stambpl1 | 024776 | 129535 | 115333 |
| Stambpl1 | 024776 | 130756 | N/A |
| Stard13 | 016128 | 110483 | 106109 |
| Stard13 | 016128 | 062015 | 053232 |
| Stard13 | 016128 | 202111 | 144056 |
| Stard13 | 016128 | 201680 | N/A |
| Stard13 | 016128 | 202385 | N/A |
| Stard13 | 016128 | 129088 | 116705 |
| Stard13 | 016128 | 141117 | N/A |
| Stard13 | 016128 | 146814 | N/A |
| Stard13 | 016128 | 126770 | 122468 |
| Stard13 | 016128 | 202866 | N/A |
| Stard8 | 031216 | 036606 | 044491 |
| Stard8 | 031216 | 149999 | 114897 |
| Stard8 | 031216 | 145820 | N/A |
| Stard8 | 031216 | 127361 | N/A |
| Stat2 | 040033 | 218863 | N/A |
| Stat2 | 040033 | 085708 | 082855 |
| Stat2 | 040033 | 217852 | N/A |
| Stat2 | 040033 | 220142 | N/A |
| Stat2 | 040033 | 217727 | N/A |
| Stat2 | 040033 | 218862 | N/A |
| Stat2 | 040033 | 220277 | N/A |
| Stat2 | 040033 | 105238 | 100872 |
| Stc2 | 020303 | 020546 | 020546 |
| Stc2 | 020303 | 152094 | N/A |
| Stc2 | 020303 | 134199 | N/A |
| Stc2 | 020303 | 139991 | N/A |
| Stc2 | 020303 | 149467 | N/A |
| Stk17b | 026094 | 027263 | 027263 |
| Stk17b | 026094 | 187066 | N/A |
| Stk17b | 026094 | 185920 | 139880 |
| Stk3 | 022329 | 018476 | 018476 |
| Stk3 | 022329 | 226555 | 154154 |
| Stk3 | 022329 | 067033 | 064225 |
| Stk3 | 022329 | 226730 | N/A |
| Stk3 | 022329 | 128425 | N/A |
| Stk3 | 022329 | 138841 | 116310 |
| Stk32a | 039954 | 045477 | 038471 |
| Stmn4 | 022044 | 152093 | 117000 |
| Stmn4 | 022044 | 074523 | 074113 |
| Stmn4 | 022044 | 136192 | N/A |
| Stmn4 | 022044 | 123435 | N/A |
| Stmn4 | 022044 | 118426 | 113629 |
| Stmn4 | 022044 | 121955 | 113788 |
| Stmn4 | 022044 | 120229 | 113759 |
| Stmn4 | 022044 | 134440 | 123092 |
| Stmn4 | 022044 | 147477 | N/A |
| Ston1 | 033855 | 137138 | 118522 |
| Ston1 | 033855 | 153613 | N/A |
| Ston1 | 033855 | 064035 | 067027 |
| Ston1 | 033855 | 150023 | 122928 |
| Ston1 | 033855 | 132384 | N/A |
| Ston1 | 033855 | 112216 | N/A |
| Ston1 | 033855 | 163588 | 131703 |
| Ston2 | 020961 | 052969 | 053908 |
| Ston2 | 020961 | 164713 | 131098 |
| Ston2 | 020961 | 111609 | N/A |
| Ston2 | 020961 | 170077 | 126429 |
| Ston2 | 020961 | 170984 | N/A |
| Ston2 | 020961 | 166967 | 128561 |
| Ston2 | 020961 | 166008 | N/A |
| Stox2 | 038143 | 079195 | 078190 |
| Stox2 | 038143 | 211882 | 148776 |
| Stox2 | 038143 | 110367 | 105996 |
| Stox2 | 038143 | 211737 | 147477 |
| Stox2 | 038143 | 210030 | 147281 |
| Stox2 | 038143 | 209337 | 148231 |
| Stox2 | 038143 | 210153 | 147670 |
| Stox2 | 038143 | 209941 | N/A |
| Stox2 | 038143 | 181417 | N/A |
| Strip2 | 039629 | 046028 | 036477 |
| Strip2 | 039629 | 130969 | N/A |
| Strip2 | 039629 | 115224 | 110879 |
| Strip2 | 039629 | 137068 | N/A |
| Strip2 | 039629 | 151738 | 119506 |
| Strn | 024077 | 145910 | 120830 |
| Strn | 024077 | 024881 | 024881 |
| Stm | 024077 | 145480 | 117663 |
| Stx17 | 061455 | 107721 | 103349 |
| Stx17 | 061455 | 153502 | 117512 |
| Stx17 | 061455 | 107720 | 103348 |
| Stx17 | 061455 | 064765 | 068087 |
| Stxbp3 | 027882 | 102621 | 099681 |
| Stxbp3 | 027882 | 124782 | N/A |
| Stxbp3 | 027882 | 124903 | N/A |
| Stxbp3 | 027882 | 150010 | N/A |
| Stxbp3 | 027882 | 196679 | 142785 |
| Stxbp3 | 027882 | 200035 | N/A |
| Stxbp3 | 027882 | 138552 | 142860 |
| Stxbp3 | 027882 | 106596 | 102206 |
| Sulf2 | 006800 | 109249 | 104872 |
| Sulf2 | 006800 | 146497 | 154557 |
| Sulf2 | 006800 | 088086 | 085405 |
| Sulf2 | 006800 | 125503 | N/A |
| Sulf2 | 006800 | 143996 | N/A |
| Sulf2 | 006800 | 139266 | 154315 |
| Sulf2 | 006800 | 133395 | 154724 |
| Susd5 | 086596 | 135338 | 128826 |
| Svep1 | 028369 | 042850 | 045856 |
| Svep1 | 028369 | 128783 | N/A |
| Svep1 | 028369 | 146329 | N/A |
| Svep1 | 028369 | 149152 | N/A |
| Svil | 024236 | 126977 | 115078 |
| Svil | 024236 | 131210 | N/A |
| Svil | 024236 | 138258 | N/A |
| Svil | 024236 | 143254 | 119287 |
| Svil | 024236 | 153016 | 121497 |
| Svil | 024236 | 140448 | 119803 |

TABLE 2-continued

| | ENSEMBL IDs for mice | | |
|---|---|---|---|
| Symbol | MUSG | MUST | MUSP |
| Svil | 024236 | 148564 | N/A |
| Svil | 024236 | 210707 | 147843 |
| Svil | 024236 | 127297 | 115223 |
| Svil | 024236 | 131609 | 122242 |
| Svil | 024236 | 125512 | 121972 |
| Svil | 024236 | 139761 | N/A |
| Svil | 024236 | 146723 | 115591 |
| Svil | 024236 | 129543 | N/A |
| Svil | 024236 | 025079 | 025079 |
| Swap70 | 031015 | 033325 | 033325 |
| Swap70 | 031015 | 209261 | N/A |
| Swap70 | 031015 | 210743 | N/A |
| Swap70 | 031015 | 210513 | N/A |
| Sycp1 | 027855 | 029448 | 029448 |
| Sycpl | 027855 | 198651 | N/A |
| Sycp1 | 027855 | 196988 | 143651 |
| Sycp1 | 027855 | 199930 | 143493 |
| Syn3 | 059602 | 120638 | 113720 |
| Syn3 | 059602 | 145864 | N/A |
| Syn3 | 059602 | 123783 | N/A |
| Syn3 | 059602 | 139197 | N/A |
| Syn3 | 059602 | 121789 | 113408 |
| Syn3 | 059602 | 143319 | N/A |
| Syndig1 | 074736 | 109935 | 105561 |
| Syndig1 | 074736 | 144179 | 116877 |
| Syndig1 | 074736 | 109934 | 105560 |
| Syndig1 | 074736 | 137280 | 122838 |
| Syndig1 | 074736 | 149705 | 122327 |
| Syndig1 | 074736 | 140870 | 114499 |
| Syndig11 | 071234 | 095550 | 093206 |
| Syndig11 | 071234 | 222422 | 152374 |
| Syndig11 | 071234 | 221905 | 152304 |
| Syndig11 | 071234 | 221793 | N/A |
| Synj2 | 023805 | 146009 | 122381 |
| Synj2 | 023805 | 134767 | 138449 |
| Synj2 | 023805 | 080283 | 079164 |
| Synj2 | 023805 | 142409 | 120006 |
| Synj2 | 023805 | 061091 | 060382 |
| Synj2 | 023805 | 115790 | 111456 |
| Synj2 | 023805 | 115789 | 111455 |
| Synj2 | 023805 | 115788 | 111454 |
| Synj2 | 023805 | 115787 | 111453 |
| Synj2 | 023805 | 115786 | 111452 |
| Synj2 | 023805 | 115784 | 111450 |
| Synj2 | 023805 | 115785 | 111451 |
| Synj2 | 023805 | 130661 | N/A |
| Synj2 | 023805 | 154114 | 122316 |
| Synj2 | 023805 | 126881 | 115371 |
| Synj2 | 023805 | 115791 | 111457 |
| Synpr | 056296 | 070323 | 064986 |
| Synpr | 056296 | 223580 | N/A |
| Synpr | 056296 | 225636 | N/A |
| Synpr | 056296 | 226094 | N/A |
| Synpr | 056296 | 223583 | 153361 |
| Synpr | 056296 | 153954 | 116342 |
| Synpr | 056296 | 145700 | N/A |
| Synpr | 056296 | 147677 | N/A |
| Synpr | 056296 | 112656 | 108275 |
| Syt10 | 063260 | 029441 | 029441 |
| Syt12 | 049303 | 059295 | 055237 |
| Syt12 | 049303 | 128114 | N/A |
| Syt12 | 049303 | 166191 | 130418 |
| Syt12 | 049303 | 133222 | N/A |
| Syt14 | 016200 | 215093 | 151129 |
| Syt14 | 016200 | 195354 | 142190 |
| Syt14 | 016200 | 195530 | 141563 |
| Syt14 | 016200 | 016344 | 016344 |
| Syt14 | 016200 | 191907 | N/A |
| Syt17 | 058420 | 081574 | 080284 |
| Syt17 | 058420 | 203465 | 147122 |
| Syt17 | 058420 | 203796 | 145087 |
| Syt17 | 058420 | 203485 | 144987 |
| Syt17 | 058420 | 207034 | 146460 |
| Syt17 | 058420 | 207650 | N/A |
| Syt4 | 024261 | 025110 | 025110 |
| Tanc1 | 035168 | 112568 | 108187 |

TABLE 2-continued

| | ENSEMBL IDs for mice | | |
|---|---|---|---|
| Symbol | MUSG | MUST | MUSP |
| Tanc1 | 035168 | 142573 | N/A |
| Tanc1 | 035168 | 128030 | N/A |
| Tanc1 | 035168 | 139863 | 123345 |
| Tanc1 | 035168 | 127013 | N/A |
| Tanc1 | 035168 | 056900 | N/A |
| Tanc1 | 035168 | 126271 | N/A |
| Tanc1 | 035168 | 136248 | N/A |
| Tanc1 | 035168 | 162857 | N/A |
| Tanc1 | 035168 | 147650 | N/A |
| Tanc1 | 035168 | 037526 | 036003 |
| Taok3 | 061288 | 111978 | 107609 |
| Taok3 | 061288 | 125738 | 117841 |
| Taok3 | 061288 | 128720 | N/A |
| Taok3 | 061288 | 092889 | 090565 |
| Taok3 | 061288 | 126813 | N/A |
| Taok3 | 061288 | 145640 | 116920 |
| Taok3 | 061288 | 153709 | N/A |
| Taok3 | 061288 | 127814 | 119998 |
| Taok3 | 061288 | 111975 | 107606 |
| Taok3 | 061288 | 179276 | 136750 |
| Tbc1d1 | 029174 | 199270 | 143451 |
| Tbc1d1 | 029174 | 043893 | 044577 |
| Tbc1d1 | 029174 | 121370 | 112493 |
| Tbc1d1 | 029174 | 129389 | N/A |
| Tbc1d1 | 029174 | 119756 | 113643 |
| Tbc1d1 | 029174 | 147348 | 119710 |
| Tbc1d1 | 029174 | 140960 | N/A |
| Tbc1d1 | 029174 | 101195 | 098756 |
| Tbc1d4 | 033083 | 161991 | 125509 |
| Tbc1d4 | 033083 | 161304 | N/A |
| Tbc1d4 | 033083 | 159951 | 124511 |
| Tbc1d4 | 033083 | 162617 | 124909 |
| Tbc1d4 | 033083 | 160297 | N/A |
| Tbc1d4 | 033083 | 159484 | N/A |
| Tbc1d4 | 033083 | 159668 | N/A |
| Tbc1d4 | 033083 | 159664 | 124734 |
| Tbc1d4 | 033083 | 100340 | 097913 |
| Tbc1d4 | 033083 | 160473 | N/A |
| Tbc1d5 | 023923 | 024717 | 024717 |
| Tbc1d5 | 023923 | 224977 | N/A |
| Tbc1d5 | 023923 | 224528 | 153172 |
| Tbc1d5 | 023923 | 225252 | N/A |
| Tbc1d5 | 023923 | 223979 | N/A |
| Tbc1d5 | 023923 | 223758 | N/A |
| Tbc1d5 | 023923 | 224547 | N/A |
| Tbc1d5 | 023923 | 224123 | N/A |
| Tbc1d5 | 023923 | 225473 | N/A |
| Tbcel | 037287 | 125995 | 114721 |
| Tbcel | 037287 | 066148 | 067882 |
| Tbcel | 037287 | 066179 | 065125 |
| Tbcel | 037287 | 142775 | N/A |
| Tbcel | 037287 | 138506 | 116616 |
| Tbcel | 037287 | 128959 | 121164 |
| Tbcel | 037287 | 134374 | 114275 |
| Tbcel | 037287 | 213428 | N/A |
| Tbr1 | 035033 | 048934 | 046787 |
| Tbr1 | 035033 | 102737 | 099798 |
| Tbr1 | 035033 | 131538 | N/A |
| Tbr1 | 035033 | 136867 | N/A |
| Tbxas1 | 029925 | 162521 | 125406 |
| Tbxas1 | 029925 | 003017 | 003017 |
| Tbxas1 | 029925 | 159226 | N/A |
| Tbxas1 | 029925 | 161781 | N/A |
| Tbxas1 | 029925 | 160963 | 124640 |
| Tbxas1 | 029925 | 162656 | N/A |
| Tbxas1 | 029925 | 161360 | N/A |
| Tceal7 | 079428 | 126811 | 122260 |
| Tceal7 | 079428 | 113116 | 108741 |
| Tcerg11 | 091002 | 162222 | N/A |
| Tcerg11 | 091002 | 161213 | N/A |
| Tcerg11 | 091002 | 160436 | 124476 |
| Tcf7l1 | 055799 | 069536 | 069403 |
| Tcf7l1 | 055799 | 114053 | 109687 |
| Tcf7l1 | 055799 | 141743 | N/A |
| Tcf7l1 | 055799 | 149446 | 115060 |
| Tcf7l1 | 055799 | 182651 | N/A |

TABLE 2-continued

| ENSEMBL IDs for mice | | | |
| --- | --- | --- | --- |
| Symbol | MUSG | MUST | MUSP |
| Tcp1l2 | 020034 | 020223 | 020223 |
| Tcp1l2 | 020034 | 162874 | N/A |
| Tcp1l2 | 020034 | 160057 | N/A |
| Tcte1 | 023949 | 113547 | 109175 |
| Tctex1d1 | 028523 | 220547 | 152803 |
| Tctex1d1 | 028523 | 223169 | 152761 |
| Tctex1d1 | 028523 | 030248 | 030248 |
| Tctex1d1 | 028523 | 125417 | 117319 |
| Tctex1d1 | 028523 | 169211 | 128228 |
| Tctex1d1 | 028523 | 140654 | 116692 |
| Tctex1d1 | 028523 | 139883 | N/A |
| Tctex1d1 | 028523 | 116317 | 112019 |
| Tdp1 | 021177 | 151019 | N/A |
| Tdp1 | 021177 | 125639 | N/A |
| Tdp1 | 021177 | 153627 | 118656 |
| Tdp1 | 021177 | 221396 | N/A |
| Tdp1 | 021177 | 137653 | 123269 |
| Tdp1 | 021177 | 126424 | N/A |
| Tdp1 | 021177 | 128739 | N/A |
| Tdp1 | 021177 | 220685 | N/A |
| Tdp1 | 021177 | 021594 | 021594 |
| Tead1 | 055320 | 084705 | 081755 |
| Tead1 | 055320 | 059768 | 060671 |
| Tead1 | 055320 | 106638 | 102249 |
| Tead1 | 055320 | 172065 | N/A |
| Tead1 | 055320 | 171373 | 131765 |
| Tead1 | 055320 | 164363 | 127574 |
| Tead1 | 055320 | 163593 | N/A |
| Tead1 | 055320 | 170352 | 129798 |
| Tead1 | 055320 | 168981 | 133025 |
| Tead1 | 055320 | 171197 | 128439 |
| Tead1 | 055320 | 165036 | 131221 |
| Tead1 | 055320 | 167060 | 130564 |
| Tead1 | 055320 | 168328 | N/A |
| Tead1 | 055320 | 210510 | N/A |
| Tead1 | 055320 | 069256 | 130459 |
| Tead4 | 030353 | 130454 | 118083 |
| Tead4 | 030353 | 006311 | 006311 |
| Tead4 | 030353 | 112157 | 107784 |
| Tead4 | 030353 | 133118 | 120941 |
| Tead4 | 030353 | 143004 | 118606 |
| Tec | 029217 | 071944 | 071836 |
| Tec | 029217 | 113594 | 109224 |
| Tec | 029217 | 126481 | 123606 |
| Tec | 029217 | 155342 | 118980 |
| Tec | 029217 | 073843 | 073509 |
| Tec | 029217 | 138842 | 120155 |
| Tec | 029217 | 149533 | 123258 |
| Tec | 029217 | 150193 | N/A |
| Tec | 029217 | 202547 | 144458 |
| Tek | 006386 | 073939 | 073595 |
| Tek | 006386 | 102798 | 099862 |
| Tek | 006386 | 071168 | 071162 |
| Tek | 006386 | 131958 | N/A |
| Tes | 029552 | 115467 | 111127 |
| Tes | 029552 | 200690 | N/A |
| Tes | 029552 | 154266 | 118791 |
| Tes | 029552 | 121170 | N/A |
| Tes | 029552 | 076654 | 075950 |
| Tesc | 029359 | 031304 | 031304 |
| Tesc | 029359 | 124648 | 138436 |
| Tesc | 029359 | 135540 | N/A |
| Tesc | 029359 | 151792 | N/A |
| Tesc | 029359 | 148777 | N/A |
| Tesc | 029359 | 145526 | N/A |
| Tex36 | 030976 | 033275 | 033275 |
| Tex52 | 079304 | 130785 | 145112 |
| Tex52 | 079304 | 100926 | 098486 |
| Tex9 | 090626 | 184312 | 138844 |
| Tex9 | 090626 | 085358 | 082467 |
| Tex9 | 090626 | 184125 | 139026 |
| Tex9 | 090626 | 183399 | N/A |
| Tex9 | 090626 | 184831 | 138999 |
| Tex9 | 090626 | 183574 | 139386 |
| Tex9 | 090626 | 183856 | 139247 |
| Tex9 | 090626 | 184557 | 139212 |

TABLE 2-continued

| ENSEMBL IDs for mice | | | |
| --- | --- | --- | --- |
| Symbol | MUSG | MUST | MUSP |
| Tex9 | 090626 | 184066 | N/A |
| Tex9 | 090626 | 184734 | N/A |
| Tex9 | 090626 | 183428 | 139326 |
| Tex9 | 090626 | 183551 | N/A |
| Tex9 | 090626 | 183501 | 138882 |
| Tex9 | 090626 | 185151 | 138929 |
| Tex9 | 090626 | 185106 | N/A |
| Tex9 | 090626 | 184624 | N/A |
| Tfap2a | 021359 | 021787 | 021787 |
| Tfap2a | 021359 | 224319 | N/A |
| Tfap2a | 021359 | 223869 | 153149 |
| Tfap2a | 021359 | 225180 | 153271 |
| Tfap2a | 021359 | 224999 | 153522 |
| Tfap2a | 021359 | 224665 | 153667 |
| Tfap2a | 021359 | 223908 | N/A |
| Tfap2a | 021359 | 224700 | N/A |
| Tfap2a | 021359 | 110193 | 105822 |
| Tfap2b | 025927 | 027059 | 027059 |
| Tfap2b | 025927 | 187754 | 140213 |
| Tfap2b | 025927 | 064976 | 064488 |
| Tfap2b | 025927 | 191068 | N/A |
| Tfap2b | 025927 | 186972 | N/A |
| Tg | 053469 | 065916 | 070239 |
| Tg | 053469 | 163495 | 129868 |
| Tg | 053469 | 167512 | N/A |
| Tg | 053469 | 171045 | 126454 |
| Tg | 053469 | 166906 | N/A |
| Tg | 053469 | 167344 | N/A |
| Tg | 053469 | 172153 | 128410 |
| Tg | 053469 | 166403 | N/A |
| Tgfb2 | 039239 | 045288 | 043849 |
| Tgfb2 | 039239 | 195201 | 142149 |
| Tgfb2 | 039239 | 191766 | N/A |
| Tgfb2 | 039239 | 194960 | N/A |
| Tgfb2 | 039239 | 194593 | N/A |
| Tgfb2 | 039239 | 193640 | N/A |
| Tgfb3 | 021253 | 003687 | 003687 |
| Th | 000214 | 000219 | 000219 |
| Th | 000214 | 105929 | 101549 |
| Th | 000214 | 124951 | 122876 |
| Th | 000214 | 138482 | 123661 |
| Th | 000214 | 123057 | 122162 |
| Th | 000214 | 140344 | 115434 |
| Thbs2 | 023885 | 170872 | 128308 |
| Thsd7b | 042581 | 148051 | N/A |
| Thsd7b | 042581 | 073527 | 073220 |
| Thsd7b | 042581 | 040311 | 041716 |
| Thsd7b | 042581 | 140629 | N/A |
| Thsd7b | 042581 | 152305 | 117750 |
| Thsd7b | 042581 | 190870 | N/A |
| Thsd7b | 042581 | 151700 | N/A |
| Thsd7b | 042581 | 140834 | N/A |
| Thsd7b | 042581 | 143130 | N/A |
| Thyn1 | 035443 | 214910 | N/A |
| Thyn1 | 035443 | 213770 | 151200 |
| Thyn1 | 035443 | 213683 | 150823 |
| Thyn1 | 035443 | 039161 | 037614 |
| Thyn1 | 035443 | 214458 | N/A |
| Thyn1 | 035443 | 217143 | N/A |
| Thyn1 | 035443 | 215024 | N/A |
| Thyn1 | 035443 | 216361 | N/A |
| Timp3 | 020044 | 020234 | 020234 |
| Timp3 | 020044 | 151134 | N/A |
| Timp3 | 020044 | 136045 | N/A |
| Timp3 | 020044 | 132307 | 133236 |
| Tlcd1 | 019437 | 098545 | 096145 |
| Tlcd1 | 019437 | 147819 | 126593 |
| Tlcd1 | 019437 | 145507 | N/A |
| Tlcd1 | 019437 | 092880 | 090556 |
| Tlcd1 | 019437 | 127587 | 114202 |
| Tlcd1 | 019437 | 141578 | N/A |
| Tlcd1 | 019437 | 108338 | 103975 |
| Tlcd1 | 019437 | 140379 | N/A |
| Tle4 | 024642 | 052011 | 057527 |
| Tle4 | 024642 | 167776 | 126249 |
| Tll1 | 053626 | 066166 | 070560 |

161

TABLE 2-continued

ENSEMBL IDs for mice

| Symbol | MUSG | MUST | MUSP |
|---|---|---|---|
| Tll1 | 053626 | 209451 | N/A |
| Tll1 | 053626 | 211755 | N/A |
| Tll1 | 053626 | 210256 | 147695 |
| Tlr3 | 031639 | 034056 | 034056 |
| Tlr3 | 031639 | 167106 | 126556 |
| Tlr3 | 031639 | 210013 | 147783 |
| Tlr3 | 031639 | 209772 | 147738 |
| Tlr3 | 031639 | 211370 | 148127 |
| Tlr3 | 031639 | 210996 | 148263 |
| Tlr3 | 031639 | 209651 | 147961 |
| Tlr3 | 031639 | 209269 | N/A |
| Tlr3 | 031639 | 210354 | N/A |
| Tmc1 | 024749 | 039500 | 040859 |
| Tmc7 | 042246 | 044195 | 046927 |
| Tmc7 | 042246 | 153635 | N/A |
| Tmc7 | 042246 | 145989 | N/A |
| Tmc7 | 042246 | 139693 | N/A |
| N/A | N/A | N/A | N/A |
| Tmem108 | 042757 | 049452 | 046021 |
| Tmem108 | 042757 | 189588 | 140027 |
| Tmem108 | 042757 | 189066 | 141160 |
| Tmem108 | 042757 | 191069 | N/A |
| Tmem108 | 042757 | 215136 | 149890 |
| Tmem108 | 042757 | 186455 | N/A |
| Tmem125 | 050854 | 060214 | 063157 |
| Tmem125 | 050854 | 128098 | 115304 |
| Tmem125 | 050854 | 150044 | 117871 |
| Tmem125 | 050854 | 156191 | 117286 |
| Tmem125 | 050854 | 154025 | N/A |
| Tmem132b | 070498 | 185104 | 139013 |
| Tmem132b | 070498 | 031446 | 031446 |
| Tmem132b | 070498 | 184422 | N/A |
| Tmem132c | 034324 | 119026 | 113090 |
| Tmem132c | 034324 | 134780 | N/A |
| Tmem132c | 034324 | 128068 | N/A |
| Tmem132c | 034324 | 132592 | N/A |
| Tmem132c | 034324 | 145748 | 121783 |
| Tmem132e | 020701 | 092852 | 090528 |
| Tmem132e | 020701 | 054245 | 052484 |
| Tmem132e | 020701 | 132477 | N/A |
| Tmem132e | 020701 | 202598 | N/A |
| Tmem150c | 050640 | 124145 | N/A |
| Tmem150c | 050640 | 165548 | N/A |
| Tmem150c | 050640 | 139520 | 114464 |
| Tmem150c | 050640 | 063192 | 057116 |
| Tmem150c | 050640 | 146731 | N/A |
| Tmem163 | 026347 | 027585 | 027585 |
| Tmem163 | 026347 | 185560 | 140828 |
| Tmem163 | 026347 | 160111 | N/A |
| Tmem163 | 026347 | 162406 | N/A |
| Tmem163 | 026347 | 160616 | 124307 |
| Tmem178 | 024245 | 025092 | 025092 |
| Tmem179 | 054013 | 066791 | 068004 |
| Tmem179 | 054013 | 222836 | 152792 |
| Tmem200a | 049420 | 217910 | N/A |
| Tmem200a | 049420 | 218232 | 151861 |
| Tmem200a | 049420 | 066049 | 064080 |
| Tmem200a | 049420 | 219651 | 151832 |
| Tmem200a | 049420 | 219338 | 151494 |
| Tmem200a | 049420 | 219872 | 151559 |
| Tmem255a | 036502 | 089056 | 086457 |
| Tmem255a | 036502 | 089054 | 086455 |
| Tmem255a | 036502 | 155848 | N/A |
| Tmem255a | 036502 | 066498 | 064511 |
| Tmem255a | 036502 | 139358 | N/A |
| Tmem266 | 032313 | 085754 | 082906 |
| Tmem266 | 032313 | 034862 | 034862 |
| Tmem266 | 032313 | 130465 | N/A |
| Tmem63a | 026519 | 161847 | 124937 |
| Tmem63a | 026519 | 162283 | 125287 |
| Tmem63a | 026519 | 027800 | 027800 |
| Tmem63a | 026519 | 159436 | 125192 |
| Tmem63a | 026519 | 161523 | 124021 |
| Tmem63a | 026519 | 160508 | 124973 |
| Tmem63a | 026519 | 160536 | 124860 |
| Tmem63a | 026519 | 161942 | N/A |

162

TABLE 2-continued

ENSEMBL IDs for mice

| Symbol | MUSG | MUST | MUSP |
|---|---|---|---|
| Tmem98 | 035413 | 040865 | 042825 |
| Tmod1 | 028328 | 107773 | 103402 |
| Tmod1 | 028328 | 156200 | 134075 |
| Tmod1 | 028328 | 128689 | N/A |
| Tmod1 | 028328 | 136553 | N/A |
| Tmod1 | 028328 | 155730 | N/A |
| Tmprss5 | 032268 | 165088 | 132181 |
| Tmprss5 | 032268 | 171217 | N/A |
| Tmprss5 | 032268 | 166272 | 130069 |
| Tmprss5 | 032268 | 070390 | 064527 |
| Tmprss5 | 032268 | 167095 | 131650 |
| Tmprss5 | 032268 | 170246 | 129482 |
| Tmprss5 | 032268 | 170426 | 128662 |
| Tmtc4 | 041594 | 037726 | 046368 |
| Tmtc4 | 041594 | 143189 | 116480 |
| Tmtc4 | 041594 | 126867 | 116379 |
| Tmtc4 | 041594 | 148661 | 121523 |
| Tmtc4 | 041594 | 126494 | N/A |
| Tmtc4 | 041594 | 228661 | N/A |
| Tmtc4 | 041594 | 125900 | N/A |
| Tmtc4 | 041594 | 135917 | N/A |
| Tmtc4 | 041594 | 227430 | N/A |
| Tmtc4 | 041594 | 128969 | 118814 |
| Tmtc4 | 041594 | 228552 | N/A |
| Tmtc4 | 041594 | 153496 | N/A |
| Tmtc4 | 041594 | 141478 | N/A |
| Tnc | 028364 | 030056 | 030056 |
| Tnc | 028364 | 107372 | 102995 |
| Tnc | 028364 | 107371 | 102994 |
| Tnc | 028364 | 107377 | 103000 |
| Tnfaip6 | 053475 | 065927 | 069231 |
| Tnfrsf13c | 068105 | 089161 | 086564 |
| Tnfrsf13c | 068105 | 109535 | 105161 |
| Tnfrsf19 | 060548 | 111236 | 106867 |
| Tnfrsf19 | 060548 | 111234 | 106865 |
| Tnfrsf19 | 060548 | 225501 | N/A |
| Tnfrsf19 | 060548 | 224371 | 153577 |
| Tnfrsf19 | 060548 | 225730 | 152920 |
| Tnk2 | 022791 | 145627 | 152338 |
| Tnk2 | 022791 | 124585 | 152549 |
| Tnk2 | 022791 | 115126 | 110779 |
| Tnk2 | 022791 | 115125 | 110778 |
| Tnk2 | 022791 | 115124 | 110777 |
| Tnk2 | 022791 | 115123 | 110776 |
| Tnk2 | 022791 | 164358 | N/A |
| Tnk2 | 022791 | 150383 | N/A |
| Tnk2 | 022791 | 156614 | N/A |
| Tnk2 | 022791 | 137044 | N/A |
| Tnk2 | 022791 | 115122 | 110775 |
| Tnk2 | 022791 | 115120 | 110773 |
| Tnk2 | 022791 | 131238 | 129382 |
| Tnk2 | 022791 | 115121 | 110774 |
| Tnk2 | 022791 | 168506 | N/A |
| Tnk2 | 022791 | 152361 | 125905 |
| Tnni1 | 026418 | 187830 | N/A |
| Tnni1 | 026418 | 132795 | 121122 |
| Tnni1 | 026418 | 152208 | 121966 |
| Tnni1 | 026418 | 137331 | N/A |
| Tnni1 | 026418 | 152075 | 121343 |
| Tnni1 | 026418 | 154463 | 122925 |
| Tnni1 | 026418 | 139986 | 123049 |
| Tnni1 | 026418 | 148201 | 123509 |
| Tnni1 | 026418 | 129217 | 119848 |
| Tnr | 015829 | 192069 | 141553 |
| Tnr | 015829 | 195199 | N/A |
| Tnr | 015829 | 193325 | 141752 |
| Tnr | 015829 | 192457 | 141509 |
| Tnr | 015829 | 111669 | 107298 |
| Tns1 | 055322 | 187584 | 140254 |
| Tns1 | 055322 | 191104 | 140317 |
| Tns1 | 055322 | 187691 | 139844 |
| Tns1 | 055322 | 185702 | 140094 |
| Tns1 | 055322 | 185331 | 140771 |
| Tns1 | 055322 | 212888 | 148638 |
| Tns1 | 055322 | 189228 | 139721 |
| Tns1 | 055322 | 191527 | N/A |

TABLE 2-continued

ENSEMBL IDs for mice

| Symbol | MUSG | MUST | MUSP |
|---|---|---|---|
| Tns1 | 055322 | 185264 | N/A |
| Tns1 | 055322 | 185529 | N/A |
| Tns1 | 055322 | 191367 | 140991 |
| Tns1 | 055322 | 188942 | N/A |
| Tns1 | 055322 | 191264 | N/A |
| Tns1 | 055322 | 186381 | N/A |
| Tns1 | 055322 | 189571 | N/A |
| Tns1 | 055322 | 190389 | 140448 |
| Tns1 | 055322 | 187281 | 139616 |
| Tns1 | 055322 | 188436 | N/A |
| Tns1 | 055322 | 191204 | 140878 |
| Tns1 | 055322 | 188208 | 140837 |
| Tns1 | 055322 | 190599 | N/A |
| Tns1 | 055322 | 169786 | 127715 |
| Tns3 | 020422 | 020695 | 020695 |
| Tns3 | 020422 | 131941 | N/A |
| Tns3 | 020422 | 134823 | N/A |
| Tns3 | 020422 | 129074 | N/A |
| Tox2 | 074607 | 109428 | 105055 |
| Tox2 | 074607 | 128999 | 122344 |
| Tox2 | 074607 | 099110 | 096710 |
| Tox2 | 074607 | 148599 | 118219 |
| Tox2 | 074607 | 165937 | 126243 |
| Tox3 | 043668 | 109621 | 105250 |
| Tox3 | 043668 | 176616 | 135697 |
| Tox3 | 043668 | 176034 | 134931 |
| Tpcn1 | 032741 | 046426 | 042188 |
| Tpcn1 | 032741 | 200708 | N/A |
| Tpcn1 | 032741 | 202072 | N/A |
| Tpcn1 | 032741 | 201601 | N/A |
| Tppp | 021573 | 140217 | N/A |
| Tppp | 021573 | 022057 | 022057 |
| Trabd2b | 070867 | 094894 | 092494 |
| Traf1 | 026875 | 172159 | 130759 |
| Traf1 | 026875 | 028234 | 028234 |
| Traf1 | 026875 | 113064 | 108687 |
| Traf1 | 026875 | 129131 | N/A |
| Traf1 | 026875 | 201690 | 144189 |
| Traf1 | 026875 | 201335 | N/A |
| Traf1 | 026875 | 141238 | N/A |
| Traf1 | 026875 | 156479 | N/A |
| Traf1 | 026875 | 135870 | N/A |
| Trhde | 050663 | 061632 | 057449 |
| Trhde | 050663 | 152702 | N/A |
| Trhde | 050663 | 152282 | N/A |
| Tril | 043496 | 127748 | 116056 |
| Trim30a | 030921 | 076922 | 076189 |
| Trim30a | 030921 | 125762 | N/A |
| Trim30a | 030921 | 142124 | N/A |
| Trim36 | 033949 | 167364 | 129771 |
| Trim36 | 033949 | 037011 | 037978 |
| Trim59 | 034317 | 107802 | 103432 |
| Trim59 | 034317 | 136512 | 120270 |
| Trim59 | 034317 | 142560 | N/A |
| Trim59 | 034317 | 153259 | N/A |
| Trim62 | 041000 | 147852 | 123646 |
| Trim62 | 041000 | 035667 | 039121 |
| Trim67 | 036913 | 167588 | 130343 |
| Trim67 | 036913 | 211867 | 148625 |
| Trim67 | 036913 | 041106 | 040601 |
| Trp53cor1 | 085912 | 133221 | N/A |
| Trpc3 | 027716 | 029271 | 029271 |
| Trpc3 | 027716 | 129322 | N/A |
| Trpc3 | 027716 | 123220 | N/A |
| Trpc3 | 027716 | 133542 | N/A |
| Trpc3 | 027716 | 146475 | N/A |
| Trpc5 | 041710 | 040184 | 049063 |
| Trpc5 | 041710 | 148240 | N/A |
| Trpc7 | 021541 | 022023 | 022023 |
| Trpc7 | 021541 | 109871 | 105497 |
| Trpc7 | 021541 | 151918 | 119809 |
| Trpc7 | 021541 | 174457 | 133305 |
| Trpc7 | 021541 | 173067 | 134481 |
| Trpc7 | 021541 | 173817 | 133411 |
| Trpc7 | 021541 | 173513 | 134662 |
| Trpc7 | 021541 | 173466 | 134285 |

TABLE 2-continued

ENSEMBL IDs for mice

| Symbol | MUSG | MUST | MUSP |
|---|---|---|---|
| Trpm2 | 009292 | 105401 | 101040 |
| Trpm2 | 009292 | 105400 | N/A |
| Trpm2 | 009292 | 140471 | N/A |
| Trpm2 | 009292 | 153842 | N/A |
| Trpm2 | 009292 | 138238 | N/A |
| Trpm2 | 009292 | 126206 | N/A |
| Trpm2 | 009292 | 217806 | N/A |
| Trpm2 | 009292 | 219997 | 151231 |
| Trpm2 | 009292 | 105399 | 101038 |
| Trpm2 | 009292 | 154996 | N/A |
| Trpv3 | 043029 | 049676 | 053755 |
| Tsc22d3 | 031431 | 112995 | N/A |
| Tsc22d3 | 031431 | 055738 | 062589 |
| Tsc22d3 | 031431 | 133023 | N/A |
| Tsc22d3 | 031431 | 112996 | 108620 |
| Tsc22d3 | 031431 | 123898 | 123569 |
| Tsc22d3 | 031431 | 152048 | N/A |
| Tshb | 027857 | 196958 | N/A |
| Tshb | 027857 | 029450 | 029450 |
| Tshb | 027857 | 170856 | 127165 |
| Tshb | 027857 | 200041 | 142782 |
| Tshb | 027857 | 197322 | 142670 |
| Tshb | 027857 | 172026 | 128440 |
| Tshz2 | 047907 | 109159 | 104787 |
| Tshz2 | 047907 | 109157 | 104785 |
| Tshz2 | 047907 | 185239 | 140884 |
| Tshz2 | 047907 | 123300 | 118550 |
| Tshz2 | 047907 | 140699 | 120013 |
| Tspan11 | 030351 | 032501 | 032501 |
| Tspan11 | 030351 | 149801 | N/A |
| Tspan14 | 037824 | 224209 | 153208 |
| Tspan14 | 037824 | 224349 | N/A |
| Tspan14 | 037824 | 047652 | 035263 |
| Tspan15 | 037031 | 047883 | 047029 |
| Tspan15 | 037031 | 218394 | N/A |
| Tspan15 | 037031 | 219106 | N/A |
| Tspan15 | 037031 | 218824 | N/A |
| Tspan15 | 037031 | 220143 | N/A |
| Tspan18 | 027217 | 111265 | 106896 |
| Tspan18 | 027217 | 028646 | 028646 |
| Tspan18 | 027217 | 154951 | N/A |
| Tspan18 | 027217 | 181716 | N/A |
| Tspan18 | 027217 | 152141 | N/A |
| Tspan2 | 027858 | 029451 | 029451 |
| Tspan2 | 027858 | 196611 | 142964 |
| Tspan2 | 027858 | 119902 | 113803 |
| Tspan2 | 027858 | 197345 | 142543 |
| Tspan5 | 028152 | 029800 | 029800 |
| Tspan5 | 028152 | 142890 | 120969 |
| Tspan5 | 028152 | 127772 | 122500 |
| Tspan5 | 028152 | 153336 | 122120 |
| Tspan5 | 028152 | 142001 | 117857 |
| Tspan5 | 028152 | 135629 | 120961 |
| Tspan5 | 028152 | 146356 | 114663 |
| Tspan5 | 028152 | 119993 | 113230 |
| Tspan5 | 028152 | 121826 | 113359 |
| Tspan6 | 067377 | 087557 | 084838 |
| Tspan6 | 067377 | 176718 | 135005 |
| Tspan6 | 067377 | 176641 | 135626 |
| Tspan6 | 067377 | 177468 | N/A |
| Tspoap1 | 034156 | 039627 | 048063 |
| Tspoap1 | 034156 | 100644 | 098209 |
| Tspoap1 | 034156 | 148422 | N/A |
| Tspoap1 | 034156 | 144502 | 122665 |
| Tspoap1 | 034156 | 142329 | 118819 |
| Tspoap1 | 034156 | 153578 | N/A |
| Tspoap1 | 034156 | 148814 | N/A |
| Tspoap1 | 034156 | 135957 | N/A |
| Tspoap1 | 034156 | 133645 | 117356 |
| Tspoap1 | 034156 | 154758 | N/A |
| Tstd2 | 035495 | 107772 | 103401 |
| Tstd2 | 035495 | 107770 | 103399 |
| Tstd2 | 035495 | 160008 | N/A |
| Tstd2 | 035495 | 137399 | N/A |
| Tstd2 | 035495 | 147837 | 115473 |
| Tstd2 | 035495 | 144495 | 117990 |

TABLE 2-continued

| ENSEMBL IDs for mice | | | |
|---|---|---|---|
| Symbol | MUSG | MUST | MUSP |
| Tstd2 | 035495 | 129929 | 125707 |
| Tstd2 | 035495 | 156021 | 117865 |
| Ttc28 | 033209 | 156290 | 137609 |
| Ttc28 | 033209 | 143505 | N/A |
| Ttc28 | 033209 | 125470 | N/A |
| Ttc28 | 033209 | 128584 | N/A |
| Ttc28 | 033209 | 129017 | N/A |
| Ttc28 | 033209 | 040111 | 136116 |
| Ttll3 | 030276 | 204026 | 145049 |
| Ttll3 | 030276 | 204683 | N/A |
| Ttll3 | 030276 | 032414 | 032414 |
| Ttll3 | 030276 | 203524 | 145329 |
| Ttll3 | 030276 | 205017 | 145044 |
| Ttll3 | 030276 | 203925 | N/A |
| Ttll3 | 030276 | 204255 | N/A |
| Ttll3 | 030276 | 203880 | N/A |
| Ttll3 | 030276 | 038889 | 037870 |
| Ttpa | 073988 | 125799 | 117031 |
| Ttpa | 073988 | 121491 | 113966 |
| Ttpa | 073988 | 117632 | 113026 |
| Ttpa | 073988 | 098244 | 095845 |
| Tuba8 | 030137 | 032233 | 032233 |
| Tubb2b | 045136 | 075774 | 075178 |
| Tubb2b | 045136 | 220744 | N/A |
| Tubb4a | 062591 | 071135 | 071135 |
| Tulp3 | 001521 | 001562 | 001562 |
| Tulp3 | 001521 | 128708 | N/A |
| Tulp3 | 001521 | 138313 | N/A |
| Tulp3 | 001521 | 133134 | 145180 |
| Tulp3 | 001521 | 203625 | N/A |
| Tulp3 | 001521 | 157005 | 145361 |
| Tusc3 | 039530 | 209440 | 148134 |
| Tusc3 | 039530 | 211241 | 148022 |
| Tusc3 | 039530 | 209970 | N/A |
| Tusc3 | 039530 | 210890 | 147691 |
| Tusc3 | 039530 | 167992 | 126080 |
| Tusc3 | 039530 | 169034 | 129916 |
| Txnip | 038393 | 074519 | 102710 |
| Txnip | 038393 | 049093 | 041467 |
| Txnip | 038393 | 151832 | N/A |
| Txnip | 038393 | 196871 | N/A |
| Txnip | 038393 | 144639 | N/A |
| Txnip | 038393 | 128221 | N/A |
| Ubash3b | 032020 | 044155 | 043865 |
| Ubash3b | 032020 | 151485 | 116038 |
| Ubash3b | 032020 | 124819 | N/A |
| Ubash3b | 032020 | 136530 | 114176 |
| Ubash3b | 032020 | 129906 | 134923 |
| Ubash3b | 032020 | 132996 | N/A |
| Ube2b | 020390 | 020657 | 020657 |
| Ube2b | 020390 | 109086 | 104714 |
| Ube2b | 020390 | 124699 | N/A |
| Ube2b | 020390 | 147833 | N/A |
| Ube2ql1 | 052981 | 065118 | 070906 |
| Ucp2 | 033685 | 126534 | 120967 |
| Ucp2 | 033685 | 207890 | N/A |
| Ucp2 | 033685 | 126381 | N/A |
| Ucp2 | 033685 | 207748 | 146337 |
| Ucp2 | 033685 | 129324 | 115648 |
| Ucp2 | 033685 | 153287 | 115953 |
| Ucp2 | 033685 | 133044 | 115598 |
| Ucp2 | 033685 | 151221 | N/A |
| Ucp2 | 033685 | 133498 | N/A |
| Ucp2 | 033685 | 138673 | N/A |
| Ucp2 | 033685 | 149808 | N/A |
| Ugt8a | 032854 | 057944 | 050852 |
| Ugt8a | 032854 | 198610 | 143605 |
| Ugt8a | 032854 | 196481 | N/A |
| Unc13c | 062151 | 184666 | 139027 |
| Unc13c | 062151 | 075245 | 074726 |
| Unc80 | 055567 | 061620 | 053692 |
| Unc80 | 055567 | 114008 | 109641 |
| Unc80 | 055567 | 136727 | N/A |
| Unc80 | 055567 | 212557 | 148517 |
| Unc80 | 055567 | 187179 | N/A |
| Unc80 | 055567 | 152844 | 117070 |

TABLE 2-continued

| ENSEMBL IDs for mice | | | |
|---|---|---|---|
| Symbol | MUSG | MUST | MUSP |
| Uncx | 029546 | 172997 | 134067 |
| Uncx | 029546 | 174792 | 139081 |
| Upp1 | 020407 | 020677 | 020677 |
| Upp1 | 020407 | 101525 | 099063 |
| Upp1 | 020407 | 170444 | 125934 |
| Upp1 | 020407 | 130522 | 123285 |
| Upp1 | 020407 | 168121 | N/A |
| Upp1 | 020407 | 172452 | 129787 |
| Upp1 | 020407 | 166455 | 129276 |
| Upp1 | 020407 | 146696 | N/A |
| Upp1 | 020407 | 164791 | 127473 |
| Usp11 | 031066 | 033383 | 033383 |
| Usp11 | 031066 | 127294 | N/A |
| Usp11 | 031066 | 137101 | N/A |
| Usp11 | 031066 | 149960 | N/A |
| Uty | 068457 | 143286 | 115113 |
| Uty | 068457 | 154666 | 122818 |
| Uty | 068457 | 069309 | 070012 |
| Uty | 068457 | 139365 | 114752 |
| Uty | 068457 | 154004 | 114910 |
| Uty | 068457 | 185837 | N/A |
| Uty | 068457 | 143958 | 120069 |
| Uty | 068457 | 137048 | 119406 |
| Uty | 068457 | 133976 | N/A |
| Uty | 068457 | 157073 | N/A |
| Uty | 068457 | 150715 | 116372 |
| Uty | 068457 | 154527 | N/A |
| Slc18a3 | 100241 | 191501 | 139829 |
| Vamp1 | 030337 | 032487 | 032487 |
| Vamp1 | 030337 | 100942 | 098503 |
| Vamp1 | 030337 | 063588 | 063466 |
| Vamp1 | 030337 | 205223 | 144835 |
| Vamp1 | 030337 | 160523 | N/A |
| Vamp1 | 030337 | 159547 | N/A |
| Vat1l | 046844 | 142591 | N/A |
| Vat1l | 046844 | 049509 | 053431 |
| Vat1l | 046844 | 150963 | 116680 |
| Vat1l | 046844 | 124143 | N/A |
| Vav2 | 009621 | 185188 | 138964 |
| Vav2 | 009621 | 056176 | 062782 |
| Vav2 | 009621 | 149758 | N/A |
| Vav2 | 009621 | 148067 | N/A |
| Vav2 | 009621 | 146843 | N/A |
| Vav2 | 009621 | 135584 | N/A |
| Vav2 | 009621 | 132642 | N/A |
| Vax2 | 034777 | 037807 | 035976 |
| Vcan | 021614 | 159910 | 125446 |
| Vcan | 021614 | 159337 | 125432 |
| Vcan | 021614 | 160029 | N/A |
| Vcan | 021614 | 109546 | 105173 |
| Vcan | 021614 | 109543 | 105170 |
| Vcan | 021614 | 109544 | 105171 |
| Vcan | 021614 | 162715 | 125521 |
| Vcan | 021614 | 160740 | 125694 |
| Vcan | 021614 | 159285 | 125674 |
| Vgll4 | 030315 | 152710 | N/A |
| Vgll4 | 030315 | 032459 | 032459 |
| Vgll4 | 030315 | 123478 | N/A |
| Vgll4 | 030315 | 155620 | N/A |
| Vgll4 | 030315 | 147639 | 123139 |
| Vgll4 | 030315 | 139640 | 118618 |
| Vgll4 | 030315 | 204693 | N/A |
| Vim | 026728 | 141365 | 114742 |
| Vim | 026728 | 028062 | 028062 |
| Vim | 026728 | 193675 | 141494 |
| Vim | 026728 | 155605 | N/A |
| Vim | 026728 | 191615 | N/A |
| Vim | 026728 | 148248 | N/A |
| Vip | 019772 | 019906 | 019906 |
| Vip | 019772 | 217331 | N/A |
| Vipr2 | 011171 | 176078 | N/A |
| Vipr2 | 011171 | 011315 | 011315 |
| Vipr2 | 011171 | 100988 | N/A |
| Vipr2 | 011171 | 175785 | N/A |
| Vipr2 | 011171 | 177199 | N/A |
| Vipr2 | 011171 | 176433 | 135149 |

TABLE 2-continued

ENSEMBL IDs for mice

| Symbol | MUSG | MUST | MUSP | Symbol | MUSG | MUST | MUSP |
|---|---|---|---|---|---|---|---|
| Vit | 024076 | 024880 | 024880 | Wscd1 | 020811 | 132095 | N/A |
| Vmp1 | 018171 | 018315 | 018315 | Wwc1 | 018849 | 018993 | 018993 |
| Vmp1 | 018171 | 123590 | N/A | Wwc1 | 018849 | 131001 | N/A |
| Vmp1 | 018171 | 145846 | N/A | Wwc1 | 018849 | 127086 | N/A |
| Vmp1 | 018171 | 150176 | N/A | Xist | 086503 | 153883 | N/A |
| Vmp1 | 018171 | 153971 | N/A | Xist | 086503 | 127786 | N/A |
| Vmp1 | 018171 | 127267 | N/A | Xist | 086503 | 185876 | N/A |
| Vmp1 | 018171 | 139040 | N/A | Xrra1 | 035211 | 036155 | 035929 |
| Vmp1 | 018171 | 143991 | 118302 | Xrra1 | 035211 | 208354 | 146815 |
| Vsig2 | 001943 | 002008 | 002008 | Xrra1 | 035211 | 207855 | 147177 |
| Vsig2 | 001943 | 215957 | 149703 | Xrra1 | 035211 | 208270 | N/A |
| Vsig2 | 001943 | 215271 | 150115 | Xrra1 | 035211 | 208449 | N/A |
| Vsig2 | 001943 | 213502 | N/A | Yes1 | 014932 | 202543 | 144001 |
| Vsig2 | 001943 | 213699 | 149098 | Yes1 | 014932 | 072311 | 072154 |
| Vsig2 | 001943 | 215710 | N/A | Yes1 | 014932 | 200779 | N/A |
| Vsnl1 | 054459 | 220506 | 152711 | Yes1 | 014932 | 168707 | 132161 |
| Vsnl1 | 054459 | 072299 | 072145 | Yes1 | 014932 | 200999 | 144355 |
| Vstm2b | 039257 | 044705 | 044002 | Zbtb16 | 066687 | 093852 | 091374 |
| Vstm2b | 039257 | 206223 | 145703 | Zbtb16 | 066687 | 216150 | 150887 |
| Vstm2b | 039257 | 186352 | 140241 | Zcchc24 | 055538 | 069180 | 068677 |
| Vstm2b | 039257 | 205845 | 146231 | Zcchc24 | 055538 | 184642 | N/A |
| Vwc2 | 050830 | 109681 | 105303 | Zdhhc14 | 034265 | 089185 | 086589 |
| Vwc2 | 050830 | 129670 | 128761 | Zdhhc2 | 039470 | 049389 | 041727 |
| Vwc2 | 050830 | 154155 | N/A | Zdhhc2 | 039470 | 131672 | N/A |
| Vwc2 | 050830 | 056344 | 049692 | Zdhhc2 | 039470 | 128166 | 123070 |
| Galnt17 | 034040 | 086023 | 083187 | Zdhhc2 | 039470 | 164934 | N/A |
| Galnt17 | 034040 | 160609 | 125395 | Zdhhc2 | 039470 | 168799 | N/A |
| Galnt17 | 034040 | 160807 | N/A | Zdhhc2 | 039470 | 167766 | 129996 |
| Galnt17 | 034040 | 161228 | N/A | Zeb2 | 026872 | 176438 | 134849 |
| Galnt17 | 034040 | 162966 | N/A | Zeb2 | 026872 | 176732 | 135393 |
| Wdr17 | 039375 | 144711 | 117710 | Zeb2 | 026872 | 028229 | 028229 |
| Wdr17 | 039375 | 127511 | 115550 | Zeb2 | 026872 | 068415 | 069685 |
| Wdr17 | 039375 | 175915 | 135805 | Zeb2 | 026872 | 200844 | 144421 |
| Wdr17 | 039375 | 128850 | N/A | Zeb2 | 026872 | 177302 | 134747 |
| Wdr17 | 039375 | 150488 | 122326 | Zeb2 | 026872 | 076836 | 076111 |
| Wdr17 | 039375 | 153074 | N/A | Zeb2 | 026872 | 201804 | 144637 |
| Wdr17 | 039375 | 144482 | 134950 | Zeb2 | 026872 | 201623 | 144075 |
| Wdr17 | 039375 | 126316 | N/A | Zeb2 | 026872 | 202432 | 144197 |
| Wdr17 | 039375 | 129132 | 134935 | Zeb2 | 026872 | 201211 | 144406 |
| Wdr17 | 039375 | 148806 | N/A | Zeb2 | 026872 | 209076 | N/A |
| Wdr17 | 039375 | 176866 | 134978 | Zeb2 | 026872 | 201413 | N/A |
| Wdr17 | 039375 | 148408 | 135523 | Zeb2 | 026872 | 201969 | 144141 |
| Wdr17 | 039375 | 176180 | N/A | Zeb2 | 026872 | 131635 | N/A |
| Wdr49 | 104301 | 193989 | 144721 | Zeb2 | 026872 | 202935 | 143841 |
| Wdr49 | 104301 | 203169 | 144789 | Zeb2 | 026872 | 202371 | N/A |
| Wdr49 | 104301 | 204982 | N/A | Zeb2 | 026872 | 145529 | N/A |
| Wdr49 | 104301 | 204341 | 145379 | Zeb2 | 026872 | 202187 | 144552 |
| Wfdc1 | 023336 | 212901 | 148437 | Zeb2 | 026872 | 127520 | 120130 |
| Wfdc1 | 023336 | 024107 | 024107 | Zeb2 | 026872 | 201490 | 143976 |
| Wfs1 | 039474 | 043964 | 048053 | Zeb2 | 026872 | 153561 | 135491 |
| Wfs1 | 039474 | 166339 | 132404 | Zeb2 | 026872 | 152232 | N/A |
| Wfs1 | 039474 | 167937 | 125779 | Zeb2 | 026872 | 124942 | N/A |
| Wifl | 020218 | 020439 | 020439 | Zeb2 | 026872 | 201982 | N/A |
| Wifl | 020218 | 175867 | 135486 | Zeb2 | 026872 | 201298 | N/A |
| Wifl | 020218 | 145691 | N/A | Zeb2 | 026872 | 202345 | N/A |
| Wipi1 | 041895 | 103060 | 099349 | Zeb2 | 026872 | 123037 | N/A |
| Wipi1 | 041895 | 047186 | 038635 | Zeb2 | 026872 | 126743 | N/A |
| Wipi1 | 041895 | 106689 | 102300 | Zfand6 | 030629 | 209117 | 146518 |
| Wipi1 | 041895 | 153738 | N/A | Zfand6 | 030629 | 069537 | 069228 |
| Wls | 028173 | 068952 | 067898 | Zfand6 | 030629 | 178385 | 135968 |
| Wls | 028173 | 198878 | 143475 | Zfand6 | 030629 | 209140 | N/A |
| Wls | 028173 | 200571 | N/A | Zfand6 | 030629 | 209165 | 146878 |
| Wls | 028173 | 197328 | N/A | Zfand6 | 030629 | 207865 | 146682 |
| Wls | 028173 | 200191 | 142774 | Zfand6 | 030629 | 208782 | 147192 |
| Wls | 028173 | 196276 | N/A | Zfand6 | 030629 | 208519 | N/A |
| Wls | 028173 | 196782 | N/A | Zfand6 | 030629 | 208831 | N/A |
| Wnt6 | 033227 | 006716 | 006716 | Zfand6 | 030629 | 207975 | 146559 |
| Wnt6 | 033227 | 189544 | N/A | Zfhx4 | 025255 | 175866 | 135827 |
| Wnt7a | 030093 | 032180 | 032180 | Zfhx4 | 025255 | 175641 | N/A |
| Wnt7a | 030093 | 133092 | N/A | Zfhx4 | 025255 | 176175 | 139253 |
| Wnt7a | 030093 | 132936 | N/A | Zfhx4 | 025255 | 176383 | 135289 |
| Wscd1 | 020811 | 150531 | 123659 | Zfhx4 | 025255 | 026284 | 026284 |
| Wscd1 | 020811 | 021168 | 021168 | Zfp36l1 | 021127 | 021552 | 021552 |
| Wscd1 | 020811 | 108511 | 104151 | Zfp36l1 | 021127 | 219642 | 151682 |
| Wscd1 | 020811 | 138339 | N/A | Zfp36l1 | 021127 | 218835 | 151269 |
| Wscd1 | 020811 | 108510 | 104150 | Zfp36l1 | 021127 | 165114 | 127522 |

TABLE 2-continued

| ENSEMBL IDs for mice | | | |
|---|---|---|---|
| Symbol | MUSG | MUST | MUSP |
| Zfp385c | 014198 | 103119 | 099408 |
| Zfp385c | 014198 | 148560 | N/A |
| Zfp385c | 014198 | 151589 | 119259 |
| Zfp385c | 014198 | 153494 | 115268 |
| Zfp395 | 034522 | 224623 | 153350 |
| Zfp395 | 034522 | 225865 | N/A |
| Zfp395 | 034522 | 066994 | 064422 |
| Zfp395 | 034522 | 224687 | 153406 |
| Zfp395 | 034522 | 225512 | N/A |
| Zfp423 | 045333 | 165770 | 129724 |
| Zfp423 | 045333 | 109655 | 105282 |
| Zfp423 | 045333 | 052250 | 052379 |
| Zfp423 | 045333 | 174764 | 134575 |
| Zfp423 | 045333 | 174249 | 134103 |
| Zfp423 | 045333 | 173725 | N/A |
| Zfp423 | 045333 | 173092 | N/A |
| Zfp462 | 060206 | 133895 | 122775 |
| Zfp462 | 060206 | 098070 | 095677 |
| Zfp462 | 060206 | 030131 | 030131 |
| Zfp462 | 060206 | 079605 | 078555 |
| Zfp521 | 024420 | 025288 | 025288 |
| Zfp608 | 052713 | 064763 | 068192 |
| Zfp804b | 092094 | 200317 | 143568 |
| Zfp804b | 092094 | 164784 | 130571 |
| Zfp831 | 050600 | 059452 | 060255 |
| Zic1 | 032368 | 034927 | 034927 |
| Zic1 | 032368 | 065360 | 068858 |
| Zic1 | 032368 | 173121 | N/A |
| Zic2 | 061524 | 075888 | 075283 |
| Zic2 | 061524 | 137059 | N/A |
| Zic3 | 067860 | 137687 | 116383 |
| Zic3 | 067860 | 088627 | 085999 |
| Zic3 | 067860 | 088631 | 086003 |
| Zic3 | 067860 | 088629 | 086001 |
| Zic4 | 036972 | 173342 | 133974 |
| Zic4 | 036972 | 172978 | N/A |
| Zic4 | 036972 | 173054 | 134364 |
| Zic4 | 036972 | 174611 | N/A |
| Zic4 | 036972 | 172646 | 134053 |
| Zic4 | 036972 | 170572 | N/A |
| Zic4 | 036972 | 174212 | 133808 |
| Zic4 | 036972 | 173933 | 133958 |
| Zic4 | 036972 | 174802 | N/A |
| Zic4 | 036972 | 172858 | N/A |
| Zic4 | 036972 | 066384 | 069568 |
| Zic4 | 036972 | 085242 | N/A |
| Zic5 | 041703 | 039118 | 035754 |
| Zic5 | 041703 | 143084 | N/A |
| Zkscan1 | 029729 | 019660 | 019660 |
| Zkscan1 | 029729 | 110963 | 106588 |
| Zkscan1 | 029729 | 110962 | 106587 |
| Zkscan1 | 029729 | 066617 | 068480 |
| Zmat4 | 037492 | 131410 | 115719 |
| Zmat4 | 037492 | 042352 | 049430 |
| Zmat4 | 037492 | 123412 | 121626 |
| Zmat4 | 037492 | 208021 | N/A |
| Zmat4 | 037492 | 207301 | 146734 |
| Zmat4 | 037492 | 135747 | 121337 |
| Zmat4 | 037492 | 146774 | N/A |

Table 2b contains further genes in mice. The table identifies unique ENSEMBL identifiers corresponding to the mouse genes (MUSG), transcripts (MUST), and proteins (if available) (MUSP) analyzed in the experiments herein. The unique identifiers for each ENSEMBL entry has been modified to remove the first five leading zeros (0) of the identifier after the ENSMUSG, ENSMUST, and ENSMUSP label. Where an ENSEMBL transcript or protein identifer was not available, GenBank transcripts (nucleic acid or protein) are included.

TABLE 2b

| ENSEMBL and GenBank IDs for mice | | | |
|---|---|---|---|
| Symbol | MUSG | MUST | MUSP |
| 1700063D05Rik | 100837 | 213914.1 | N/A |
| 1700063D05Rik | 100837 | 214568.1 | N/A |
| 1700063D05Rik | 100837 | 191461.6 | N/A |
| 1700063D05Rik | 100837 | 185590.6 | N/A |
| 1700063D05Rik | 100837 | 188499.1 | N/A |
| 1700086L19Rik | 71265 | 185822.6 | N/A |
| 1700086L19Rik | 71265 | 186463.6 | N/A |
| 1700086L19Rik | 71265 | 95617.2 | N/A |
| 1700124L16Rik | 99354 | 190077.1 | N/A |
| 1700124L16Rik | 99354 | 189308.2 | N/A |
| 1700124L16Rik | 99354 | 189129.5 | N/A |
| 2510003B16Rik | N/A | NR_131048.1.1 | N/A |
| 4930449E18Rik | N/A | NR_045319.1.1 | N/A |
| 6330403K07Rik | 18451 | 156068.2 | N/A |
| 9330117O12Rik | N/A | NR_045400.1.1 | N/A |
| 9330188P03Rik | N/A | XR_105640.1.1 | N/A |
| 9530026P05Rik | 97462 | 181145.7 | N/A |
| 9530026P05Rik | 97462 | 181121.7 | N/A |
| 9530026P05Rik | 97462 | 204449.2 | N/A |
| 9530026P05Rik | 97462 | 204609.1 | N/A |
| 9530026P05Rik | 97462 | 181840.3 | N/A |
| 9530026P05Rik | 97462 | 205093.2 | N/A |
| A230001M10Rik | 105891 | 198712.4 | N/A |
| A230001M10Rik | 105891 | 196720.4 | N/A |
| A230001M10Rik | 105891 | 196659.1 | N/A |
| A330049N07Rik | 111994 | 220010.1 | N/A |
| A330049N07Rik | 111994 | 219920.1 | N/A |
| A330049N07Rik | 111994 | 219536.1 | N/A |
| A530058N18Rik | 87694 | 147411.1 | N/A |
| A530058N18Rik | 87694 | 135729.7 | N/A |
| A530058N18Rik | 87694 | 152254.7 | N/A |
| A530058N18Rik | 87694 | 141209.7 | N/A |
| A530058N18Rik | 87694 | 128469.7 | N/A |
| A530058N18Rik | 87694 | 143993.1 | N/A |
| A530058N18Rik | 87694 | 134129.1 | N/A |
| A730017C20Rik | 50875 | 165666.8 | 125952 |
| A730017C20Rik | 50875 | 58633.8 | 56379 |
| A730017C20Rik | 50875 | 118510.7 | 113023 |
| A730017C20Rik | 50875 | 175830.1 | 135330 |
| A730017C20Rik | 50875 | 175897.7 | 135020 |
| A730017C20Rik | 50875 | 117064.7 | 113487 |
| A730017C20Rik | 50875 | 154125.1 | N/A |
| Ackr1 | 37872 | 38227.5 | 45134 |
| Ackr1 | 37872 | 194046.1 | 141765 |
| Ackr1 | 37872 | 194298.1 | N/A |
| Adarb2 | 52551 | 64473.12 | 64775 |
| Adarb2 | 52551 | 123187.1 | 120757 |
| Adarb2 | 52551 | 135574.7 | 115148 |
| Adarb2 | 52551 | 139438.1 | N/A |
| Adarb2 | 52551 | 223148.1 | N/A |
| Adarb2 | 52551 | 223223.1 | N/A |
| Adipor2 | 30168 | 32272.12 | 32272 |
| Adipor2 | 30168 | 169744.7 | 126138 |
| Adipor2 | 30168 | 189710.1 | 139895 |
| Adipor2 | 30168 | 187699.6 | 139703 |
| Adipor2 | 30168 | 188851.1 | N/A |
| AI504432 | 56145 | 70085.5 | N/A |
| Alms1-ps2 | 90098 | 160606.1 | N/A |
| Alms1-ps2 | 90098 | 161983.7 | N/A |
| Anks1b | 58589 | 182356.7 | 138234 |
| Anks1b | 58589 | 182113.7 | 138655 |
| Anks1b | 58589 | 182430.7 | 138660 |
| Anks1b | 58589 | 179337.8 | 136410 |
| Anks1b | 58589 | 179694.8 | 136146 |
| Anks1b | 58589 | 182284.7 | 138794 |
| Anks1b | 58589 | 99366.1 | 96967 |
| Anks1b | 58589 | 183156.7 | 138539 |
| Anks1b | 58589 | 182595.7 | 138314 |
| Anks1b | 58589 | 182960.7 | 138222 |
| Anks1b | 58589 | 182786.7 | 138720 |
| Anks1b | 58589 | 99368.1 | 96968 |
| Anks1b | 58589 | 183136.7 | 138738 |
| Anks1b | 58589 | 183109.1 | 138667 |
| Anks1b | 58589 | 182550.7 | 138643 |
| Anks1b | 58589 | 182936.7 | 138209 |
| Anks1b | 58589 | 182600.7 | 138650 |

TABLE 2b-continued

| ENSEMBL and GenBank IDs for mice | | | |
|---|---|---|---|
| Symbol | MUSG | MUST | MUSP |
| Anks1b | 58589 | 182053.7 | 138644 |
| Anks1b | 58589 | 182966.7 | 138610 |
| Anks1b | 58589 | 99364.11 | 96965 |
| Anks1b | 58589 | 182427.7 | 138480 |
| Anks1b | 58589 | 182202.7 | 138398 |
| Anks1b | 58589 | 183024.1 | 138256 |
| Anks1b | 58589 | 182045.1 | 138679 |
| Anks1b | 58589 | 182192.7 | 138701 |
| Anks1b | 58589 | 182083.1 | 138576 |
| Anks1b | 58589 | 182907.7 | 138614 |
| Anks1b | 58589 | 182003.1 | N/A |
| Anks1b | 58589 | 182632.7 | N/A |
| Anks1b | 58589 | 183012.1 | N/A |
| Anks1b | 58589 | 183145.1 | N/A |
| Anks1b | 58589 | 183051.7 | N/A |
| Anks1b | 58589 | 183002.1 | N/A |
| Apoe | 2985 | 174064.8 | 133302 |
| Apoe | 2985 | 173739.7 | 133371 |
| Apoe | 2985 | 3066.15 | 3066 |
| Apoe | 2985 | 174355.7 | 134160 |
| Apoe | 2985 | 172983.7 | 133359 |
| Apoe | 2985 | 174144.7 | 134622 |
| Apoe | 2985 | 174710.1 | 134429 |
| Apoe | 2985 | 174191.1 | 133447 |
| Apoe | 2985 | 172808.1 | 134558 |
| Apoe | 2985 | 167646.8 | N/A |
| Apoe | 2985 | 207525.1 | N/A |
| Arhgap26 | 36452 | 97593.8 | 95200 |
| Arhgap26 | 36452 | 137497.7 | 121197 |
| Arhgap26 | 36452 | 154551.7 | 123145 |
| Arhgap26 | 36452 | 155576.7 | 122371 |
| Arhgap26 | 36452 | 141058.7 | 119865 |
| Arhgap26 | 36452 | 148850.7 | 121894 |
| Arhgap26 | 36452 | 187912.1 | 141188 |
| Arhgap26 | 36452 | 151757.7 | 122448 |
| Arhgap26 | 36452 | 145090.7 | N/A |
| Arhgap26 | 36452 | 115580.1 | N/A |
| Arhgap26 | 36452 | 148399.1 | N/A |
| Arhgap26 | 36452 | 123820.1 | N/A |
| Arhgap26 | 36452 | 127448.7 | N/A |
| Arhgap26 | 36452 | 149112.1 | N/A |
| Arhgap26 | 36452 | 156167.1 | N/A |
| Arhgap26 | 36452 | 134388.1 | N/A |
| Arhgap26 | 36452 | 133247.1 | N/A |
| Arhgap26 | 36452 | 115574.1 | N/A |
| Arl4c | 49866 | 159814.1 | 124344 |
| Arl4c | 49866 | 187810.1 | 139499 |
| Arl4c | 49866 | 51236.1 | 57085 |
| Arrdc2 | 2910 | 2989.1 | 2989 |
| Arrdc2 | 2910 | 212405.1 | 148405 |
| Arrdc2 | 2910 | 212855.1 | N/A |
| Arrdc2 | 2910 | 212898.1 | N/A |
| Arrdc2 | 2910 | 213095.1 | N/A |
| Arrdc2 | 2910 | 212770.1 | N/A |
| Arrdc2 | 2910 | 212508.1 | N/A |
| Asphdl | 46378 | 106340.7 | 101947 |
| Asphdl | 46378 | 52937.11 | 49848 |
| Asphdl | 46378 | 106339.1 | 101946 |
| Atp6ap1l | 78958 | 109541.3 | 105168 |
| Atp6ap1l | 78958 | 183162.7 | 138517 |
| Atp6ap1l | 78958 | 182104.1 | 138331 |
| Atp6ap1l | 78958 | 182446.1 | 138791 |
| Atp6ap1l | 78958 | 182932.1 | N/A |
| AU022751 | 73294 | 117544.1 | 114041 |
| AU022751 | 73294 | 101698.3 | 99222 |
| B3galt5 | 74892 | 113800.8 | 109431 |
| B3galt5 | 74892 | 99497.3 | 97096 |
| B3galt5 | 74892 | 134058.7 | N/A |
| B3galt5 | 74892 | 153586.1 | N/A |
| Bcl2l15 | 44165 | 106822.1 | 102435 |
| Bcl2l15 | 44165 | 62945.11 | 52210 |
| Bcl2l15 | 44165 | 196184.1 | N/A |
| Bcl2l15 | 44165 | 199772.1 | N/A |
| Bmp4 | 21835 | 74077.11 | 73720 |
| Bmp4 | 21835 | 100676.2 | 98242 |
| Bmp4 | 21835 | 135408.1 | N/A |

TABLE 2b-continued

| ENSEMBL and GenBank IDs for mice | | | |
|---|---|---|---|
| Symbol | MUSG | MUST | MUSP |
| Bmp4 | 21835 | 226759.1 | N/A |
| Btg1-ps1 | 68173 | 184432.2 | 139062 |
| Btg1-ps1 | 68173 | 89286.11 | N/A |
| Bzrap1 | N/A | NM_172449.2.1 | NP_766037.2 |
| C030029H02Rik | 110027 | 210356.1 | N/A |
| C030029H02Rik | 110027 | 210438.1 | N/A |
| C030029H02Rik | 110027 | 210209.1 | N/A |
| C130030K03Rik | N/A | NR_046212.1.1 | N/A |
| Cacna1d | 15968 | 112250.4 | 107869 |
| Cacna1d | 15968 | 223803.1 | 153586 |
| Cacna1d | 15968 | 112249.8 | 107868 |
| Cacna1d | 15968 | 224785.1 | 153293 |
| Cacna1d | 15968 | 224198.1 | 153250 |
| Cacna1d | 15968 | 224395.1 | 152953 |
| Cacna1d | 15968 | 224912.1 | 153689 |
| Cacna1d | 15968 | 224073.1 | N/A |
| Cacna1d | 15968 | 225717.1 | N/A |
| Cacna1d | 15968 | 223573.1 | N/A |
| Cacna1d | 15968 | 223985.1 | N/A |
| Cacna1d | 15968 | 225353.1 | N/A |
| Calcrl | 59588 | 74262.8 | 73875 |
| Calcrl | 59588 | 99944.3 | 97527 |
| Calcrl | 59588 | 151295.1 | N/A |
| Ccdc190 | 70532 | 94348.3 | 91908 |
| Ccdc190 | 70532 | 175731.2 | 135819 |
| Ccdc78 | 71202 | 95500.4 | 93155 |
| Ccp110 | 33904 | 106557.7 | 102167 |
| Ccp110 | 33904 | 38650.8 | 38881 |
| Ccp110 | 33904 | 123178.7 | 147070 |
| Ccp110 | 33904 | 208766.1 | 146903 |
| Ccp110 | 33904 | 149056.7 | N/A |
| Ccp110 | 33904 | 140831.1 | N/A |
| Cdh22 | 53166 | 65438.12 | 66864 |
| Cdh22 | 53166 | 138643.1 | 120785 |
| Celrr | 97881 | 181433.7 | N/A |
| Celrr | 97881 | 181183.2 | N/A |
| Celrr | 97881 | 185678.1 | N/A |
| Celrr | 97881 | 190612.1 | N/A |
| Chadl | 63765 | 72910.5 | 72682 |
| Chadl | 63765 | 173598.7 | 133834 |
| Chadl | 63765 | 173898.1 | 133981 |
| Chd3os | 43419 | 129321.1 | 146712 |
| Chd3os | 43419 | 218008.1 | 151352 |
| Chd3os | 43419 | 151617.2 | 147159 |
| Cntn2 | 53024 | 86521.1 | 83707 |
| Cntn2 | 53024 | 188943.1 | 139795 |
| Cntn2 | 53024 | 186530.2 | 139897 |
| Cntn2 | 53024 | 188065.6 | 140306 |
| Cntn2 | 53024 | 189528.6 | 141179 |
| Cntn2 | 53024 | 186487.6 | N/A |
| Cntn2 | 53024 | 190601.6 | N/A |
| Cntn2 | 53024 | 188143.1 | N/A |
| Cntnap5b | 67028 | 86738.9 | 83944 |
| Cntnap5b | 67028 | 188735.1 | 139877 |
| Cntnap5b | 67028 | 185484.1 | N/A |
| Cntnap5c | 38048 | 76038.6 | 75416 |
| Col18a1 | 1435 | 81654.12 | 80358 |
| Col18a1 | 1435 | 105409.7 | 101049 |
| Col18a1 | 1435 | 72755.11 | 72538 |
| Col18a1 | 1435 | 156009.1 | 122580 |
| Col18a1 | 1435 | 218407.1 | 151291 |
| Cplx2 | 25867 | 26985.8 | 26985 |
| Cpne2 | 34361 | 48653.9 | 45755 |
| Cpne2 | 34361 | 109537.1 | 105163 |
| Cpne2 | 34361 | 212550.1 | 148447 |
| Cpne2 | 34361 | 136550.7 | N/A |
| Cpne2 | 34361 | 156377.1 | N/A |
| Cpne2 | 34361 | 156894.1 | N/A |
| Cyp2j12 | 81225 | 97972.4 | 133811 |
| Cyp2j12 | 81225 | 121694.2 | 134394 |
| D430036J16Rik | 97466 | 181447.7 | N/A |
| D430036J16Rik | 97466 | 181893.7 | N/A |
| D430036J16Rik | 97466 | 180663.7 | N/A |
| D430036J16Rik | 97466 | 183536.7 | N/A |
| D430036J16Rik | 97466 | 183781.1 | N/A |
| Dbpht2 | 29878 | 221311.1 | N/A |

TABLE 2b-continued

| Symbol | MUSG | MUST | MUSP |
|---|---|---|---|
| Dbpht2 | 29878 | 72100.3 | N/A |
| Defb23 | 74681 | 99206.2 | 96812 |
| Diras2 | 47842 | 57442.7 | 55416 |
| Dnah11 | 18581 | 84806.6 | 81867 |
| Dnah11 | 18581 | 176756.8 | 135748 |
| Dnah11 | 18581 | 176239.1 | N/A |
| Dnah11 | 18581 | 175662.7 | N/A |
| Dock10 | 38608 | 77946.11 | 77099 |
| Dock10 | 38608 | 187774.6 | 140085 |
| Dock10 | 38608 | 190983.6 | 140719 |
| Dock10 | 38608 | 190595.6 | 139567 |
| Dock10 | 38608 | 189486.6 | 140868 |
| Dock10 | 38608 | 186087.6 | 140102 |
| Dock10 | 38608 | 191449.1 | 140513 |
| Dock10 | 38608 | 191505.1 | N/A |
| Dock10 | 38608 | 186835.1 | N/A |
| Dock10 | 38608 | 187698.1 | N/A |
| Dock10 | 38608 | 187885.1 | N/A |
| Dscam | 50272 | 56102.7 | 56040 |
| Elfn2 | 43460 | 88592.4 | 85960 |
| Epb41l2 | 19978 | 53748.15 | 55122 |
| Epb41l2 | 19978 | 92645.6 | 90314 |
| Epb41l2 | 19978 | 220290.1 | 151707 |
| Epb41l2 | 19978 | 218903.1 | 151685 |
| Epb41l2 | 19978 | 217929.1 | 151875 |
| Epb41l2 | 19978 | 219900.1 | 151332 |
| Epb41l2 | 19978 | 219805.1 | 151233 |
| Epb41l2 | 19978 | 219967.1 | 151632 |
| Epb41l2 | 19978 | 219166.1 | 151702 |
| Epb41l2 | 19978 | 217943.1 | 152003 |
| Epb41l2 | 19978 | 219224.1 | 151926 |
| Epb41l2 | 19978 | 219372.1 | 151258 |
| Epb41l2 | 19978 | 220121.1 | N/A |
| Epb41l2 | 19978 | 219138.1 | N/A |
| Epb41l2 | 19978 | 217844.1 | N/A |
| Epb41l2 | 19978 | 220335.1 | N/A |
| Epb41l2 | 19978 | 219201.1 | N/A |
| Epb41l2 | 19978 | 219941.1 | N/A |
| Epb41l2 | 19978 | 218345.1 | N/A |
| Epb41l2 | 19978 | 219390.1 | N/A |
| Epn2 | 1036 | 179936.7 | 136950 |
| Epn2 | 1036 | 178202.7 | 136553 |
| Epn2 | 1036 | 1063.14 | 1063 |
| Epn2 | 1036 | 108713.7 | 104353 |
| Epn2 | 1036 | 108712.7 | 104352 |
| Epn2 | 1036 | 108711.7 | 104351 |
| Epn2 | 1036 | 148956.7 | 122514 |
| Epn2 | 1036 | 147501.7 | 117389 |
| Epn2 | 1036 | 146455.7 | 123675 |
| Epn2 | 1036 | 153984.1 | 122666 |
| Epn2 | 1036 | 137525.1 | N/A |
| Epn2 | 1036 | 141335.1 | N/A |
| Epn2 | 1036 | 151545.1 | N/A |
| Erbin | 21709 | 91269.1 | 88813 |
| Erbin | 21709 | 191275.6 | 140536 |
| Erbin | 21709 | 169083.7 | 127607 |
| Erbin | 21709 | 188997.6 | 140931 |
| Erbin | 21709 | 22222.11 | 22222 |
| Erbin | 21709 | 53927.11 | 57956 |
| Erbin | 21709 | 189323.1 | N/A |
| Fam107a | 21750 | 121887.7 | 114015 |
| Fam107a | 21750 | 36070.14 | 45513 |
| Fam107a | 21750 | 120411.7 | 112769 |
| Fam107a | 21750 | 137133.1 | 120854 |
| Fam173a | 57411 | 72735.7 | 72518 |
| Fam21 | N/A | NM_026585.3.1 | NP_080861.2 |
| Fam3c | 29672 | 165576.7 | 127709 |
| Fam3c | 29672 | 163963.7 | 127559 |
| Fam3c | 29672 | 81288.13 | 80040 |
| Fam3c | 29672 | 168965.2 | 128135 |
| Fam3c | 29672 | 163371.7 | 128855 |
| Fam3c | 29672 | 164669.3 | N/A |
| Far2 | 30303 | 32443.13 | 32443 |
| Far2 | 30303 | 111607.3 | 107234 |
| Far2 | 30303 | 203278.1 | N/A |
| Fbxw15 | 74060 | 56745.11 | 58175 |

TABLE 2b-continued

| Symbol | MUSG | MUST | MUSP |
|---|---|---|---|
| Fbxw15 | 74060 | 198397.4 | 143385 |
| Fbxw15 | 74060 | 198112.1 | 142894 |
| Frmpd3 | 42425 | 208130.1 | 146983 |
| Frmpd3 | 42425 | 44702.6 | 42515 |
| Frmpd3 | 42425 | 141660.7 | 119016 |
| Fzd7 | 41075 | 114246.3 | 109884 |
| G0s2 | 9633 | 9777.3 | 9777 |
| Gap43 | 47261 | 102817.4 | 99881 |
| Gap43 | 47261 | 125187.1 | N/A |
| Gbp11 | 92021 | 171587.1 | 132552 |
| Gbp11 | 92021 | 100960.1 | 98520 |
| Gdpd5 | 35314 | 37528.9 | 36175 |
| Gdpd5 | 35314 | 213887.1 | 150361 |
| Gdpd5 | 35314 | 208800.1 | 146372 |
| Gdpd5 | 35314 | 207617.1 | 147184 |
| Gdpd5 | 35314 | 207530.1 | 146887 |
| Gdpd5 | 35314 | 208947.1 | N/A |
| Gdpd5 | 35314 | 208061.1 | N/A |
| Gdpd5 | 35314 | 207238.1 | N/A |
| Gfra1 | 25089 | 26076.13 | 26076 |
| Gfra1 | 25089 | 129100.7 | 117196 |
| Gfra1 | 25089 | 169850.7 | 130128 |
| Gfra1 | 25089 | 152507.7 | 120333 |
| Gfra1 | 25089 | 131877.1 | 122810 |
| Gfra1 | 25089 | 138530.7 | 115239 |
| Gfra1 | 25089 | 135730.1 | 121447 |
| Gfra1 | 25089 | 123957.1 | 120058 |
| Gfra1 | 25089 | 140141.7 | 123022 |
| Glce | 32252 | 185675.6 | 139949 |
| Glce | 32252 | 34785.7 | 34785 |
| Glce | 32252 | 185873.1 | 140671 |
| Glce | 32252 | 185510.1 | N/A |
| Glce | 32252 | 186514.1 | N/A |
| Gm10471 | 73116 | 94946.4 | 92553 |
| Gm11780 | 85155 | 136880.1 | N/A |
| Gm14204 | 86496 | 123944.1 | N/A |
| Gm14204 | 86496 | 145773.1 | N/A |
| Gm14204 | 86496 | 155319.1 | N/A |
| Gm14204 | 86496 | 123016.1 | N/A |
| Gm1979 | 91049 | 168875.7 | 130718 |
| Gm1979 | 91049 | 170224.2 | 130782 |
| Gm21671 | 95550 | 162387.5 | 133924 |
| Gm2694 | 97248 | 180700.8 | N/A |
| Gm2694 | 97248 | 180806.8 | N/A |
| Gm2694 | 97248 | 211631.1 | N/A |
| Gm2694 | 97248 | 181898.1 | N/A |
| Gm2694 | 97248 | 210935.1 | N/A |
| Gm2694 | 97248 | 181159.7 | N/A |
| Gm2694 | 97248 | 182174.7 | N/A |
| Gm2694 | 97248 | 211487.1 | N/A |
| Gm2694 | 97248 | 182758.1 | N/A |
| Gm2694 | 97248 | 182650.7 | N/A |
| Gm2694 | 97248 | 210170.1 | N/A |
| Gm30731 | 107859 | 203909 | N/A |
| Gm5803 | N/A | NM_001165971.1.1 | N/A |
| Gm5862 | 67700 | 72286.6 | 72133 |
| Gm6277 | 97440 | 224036.1 | N/A |
| Gm6277 | 97440 | 180860.2 | N/A |
| Gm9895 | N/A | NR_045687.1.1 | N/A |
| Gpr12 | 41468 | 36211.7 | 38245 |
| Gpr12 | 41468 | 197431.1 | 142889 |
| Gpr12 | 41468 | 197825.1 | 143415 |
| Gpr12 | 41468 | 200112.1 | 143653 |
| Gpr12 | 41468 | 196096.1 | N/A |
| Grm4 | 63239 | 118161.1 | 113819 |
| Grm4 | 63239 | 118489.7 | 112578 |
| Grm4 | 63239 | 146277.7 | N/A |
| Grm4 | 63239 | 147865.1 | N/A |
| H2-Bl | 73406 | 173080.9 | 134155 |
| H2-Bl | 73406 | 183560.7 | 138812 |
| H2-Bl | 73406 | 183999.7 | 139165 |
| H2-Bl | 73406 | 184502.7 | 139275 |
| H2-Bl | 73406 | 184850.7 | N/A |
| H2-Bl | 73406 | 185087.7 | 139166 |
| H2-Bl | 73406 | 185167.7 | 139373 |
| H2-Bl | 73406 | 192532.1 | 142113 |

TABLE 2b-continued | | | | | TABLE 2b-continued | | |
|---|---|---|---|---|---|---|---|---|
| ENSEMBL and GenBank IDs for mice | | | | | ENSEMBL and GenBank IDs for mice | | |
| Symbol | MUSG | MUST | MUSP | | Symbol | MUSG | MUST | MUSP |
| H2-Bl | 73406 | 194244.5 | 141809 | | Lrp8 | 28613 | 147319 | N/A |
| H2-Bl | 73406 | 195833.5 | 141271 | | Lrp8 | 28613 | 135591 | N/A |
| H2-Bl | 73406 | 195838.5 | 141253 | | Lrp8 | 28613 | 135022 | N/A |
| Hecw1 | 21301 | 110516.2 | 106145 | | Mbp | 41607 | 91789 | 89393 |
| Hecw1 | 21301 | 220718.1 | 152215 | | Mbp | 41607 | 114676 | 110324 |
| Hecw1 | N/A | 221274.1 | 152351 | | Mbp | 41607 | 47865 | 46185 |
| Hecw1 | N/A | 221863.1 | N/A | | Mbp | 41607 | 143506 | 138313 |
| Hecw1 | N/A | 222241.1 | N/A | | Mbp | 41607 | 152071 | 115409 |
| Hecw1 | N/A | 222904.1 | N/A | | Mbp | 41607 | 142850 | 115082 |
| Hecw1 | N/A | 223189.1 | 152279 | | Mbp | 41607 | 133193 | 116019 |
| Hecw1 | N/A | 223283.1 | N/A | | Mbp | 41607 | 123251 | 121855 |
| Hecw1 | N/A | 223317.1 | N/A | | Mbp | 41607 | 153478 | 114630 |
| Hecw1 | N/A | 223550.1 | 152688 | | Mbp | 41607 | 132369 | 114230 |
| Hpcal1 | 71379 | 71858 | 71756 | | Mbp | 41607 | 150952 | N/A |
| Hpcal1 | 71379 | 222944 | 152772 | | Mbp | 41607 | 62446 | 53495 |
| Icmt | 39662 | 48892 | 43390 | | Mbp | 41607 | 102812 | 99876 |
| Icmt | 39662 | 151372 | 133950 | | Mbp | 41607 | 75372 | 74836 |
| Icmt | 39662 | 125617 | N/A | | Mbp | 41607 | 80658 | 79488 |
| Icmt | 39662 | 134242 | N/A | | Mbp | 41607 | 114674 | 110322 |
| Id2 | 20644 | 221761 | 152052 | | Mir124a-1hg | 97545 | 185812 | N/A |
| Id2 | 20644 | 222667 | 152069 | | Mir124a-1hg | 97545 | 180610 | N/A |
| Id2 | 20644 | 20974 | 20974 | | Mir124a-1hg | 97545 | 181808 | N/A |
| Ifitm7 | 65968 | 117803 | 113641 | | Mir124a-1hg | 97545 | 186703 | N/A |
| Ifitm7 | 65968 | 178021 | 136512 | | Mir6390 | 98780 | 184405 | N/A |
| Kalrn | 61751 | 114960 | 110611 | | Mmp16 | 28226 | 183662 | 139102 |
| Kalrn | 61751 | 151491 | 123416 | | Mmp16 | 28226 | 142434 | 121087 |
| Kalrn | 61751 | 114949 | 110599 | | Mmp16 | 28226 | 29881 | 29881 |
| Kalrn | 61751 | 89655 | 87084 | | Mmp16 | 28226 | 133416 | N/A |
| Kalrn | 61751 | 114953 | 110603 | | Mmp16 | 28226 | 149353 | 116930 |
| Kalrn | 61751 | 137216 | N/A | | Mmp16 | 28226 | 139418 | N/A |
| Kalrn | 61751 | 114954 | 110604 | | Mt1 | 31765 | 34215 | 34215 |
| Kalrn | 61751 | 132569 | N/A | | Mt1 | 31765 | 212291 | 148443 |
| Kalrn | 61751 | 142817 | 116188 | | Mt1 | 31765 | 211807 | 148764 |
| Kalrn | 61751 | 114963 | 110614 | | Mt2 | 31762 | 34214 | 34214 |
| Kalrn | 61751 | 76810 | 76088 | | Mt2 | 31762 | 212806 | 148308 |
| Kalrn | 61751 | 114961 | 110612 | | Mthfd2 | 5667 | 5810 | 5810 |
| Kalrn | 61751 | 114966 | 110617 | | Mthfd2 | 5667 | 203847 | 145266 |
| Kalrn | 61751 | 114964 | 110615 | | Mthfd2 | 5667 | 141044 | N/A |
| Kalrn | 61751 | 114973 | 110624 | | Mthfd2 | 5667 | 139802 | N/A |
| Kalrn | 61751 | 132002 | N/A | | Mthfd2 | 5667 | 141193 | N/A |
| Kalrn | 61751 | 156668 | N/A | | Mthfd2 | 5667 | 203375 | N/A |
| Kalrn | 61751 | 114947 | 110597 | | Mthfd2 | 5667 | 204472 | 145222 |
| Kalrn | 61751 | 124430 | N/A | | Myrip | 41794 | 133173 | 122046 |
| Kcnd2 | 60882 | 81542 | 80257 | | Myrip | 41794 | 48121 | 46891 |
| Kcnj6 | 43301 | 95873 | 93558 | | Myrip | 41794 | 214784 | 149149 |
| Kcnj6 | 43301 | 99508 | 97108 | | Myrip | 41794 | 139665 | N/A |
| Kcnj6 | 43301 | 165538 | 130321 | | Myrip | 41794 | 129168 | N/A |
| Kcnk12 | 50138 | 55221 | 53595 | | Myt1l | 61911 | 218583 | 151588 |
| Kcnk9 | 36760 | 44624 | 38729 | | Myt1l | 61911 | 49784 | 58264 |
| Kcns2 | 50963 | 72868 | 72645 | | Myt1l | 61911 | 219060 | N/A |
| Kcns2 | 50963 | 228725 | 153984 | | Myt1l | 61911 | 219899 | N/A |
| Kirrel3 | 32036 | 184203 | 139393 | | Myt1l | 61911 | 219231 | N/A |
| Kirrel3 | 32036 | 183580 | N/A | | Myt1l | 61911 | 21009 | 21009 |
| Kirrel3 | 32036 | 187625 | 139951 | | Myt1l | 61911 | 219463 | N/A |
| Kirrel3 | 32036 | 190519 | 139714 | | Myt1l | 61911 | 217961 | N/A |
| Kirrel3 | 32036 | 45091 | 48863 | | Myt1l | 61911 | 218198 | 151919 |
| Kirrel3 | 32036 | 188933 | 139418 | | Myt1l | 61911 | 220072 | N/A |
| Kirrel3 | 32036 | 187182 | 140219 | | Myt1l | 61911 | 219744 | 151977 |
| Kirrel3 | 32036 | 188658 | 140086 | | Nat8 | 30004 | 32073 | 32073 |
| Kirrel3 | 32036 | 115148 | 110801 | | Neat1 | 92274 | 173672 | N/A |
| Lhfpl3 | 106379 | 197992 | 143576 | | Neat1 | 92274 | 174287 | N/A |
| Lhfpl3 | 106379 | 196406 | 142837 | | Neat1 | 92274 | 174829 | N/A |
| Limd1 | 25239 | 26269 | 26269 | | Nhlrc4 | 90113 | 85027 | 82102 |
| Limd1 | 25239 | 216352 | N/A | | Nhlrc4 | 90113 | 159540 | N/A |
| Limd1 | 25239 | 217639 | 150888 | | Nhlrc4 | 90113 | 162078 | N/A |
| Limd1 | 25239 | 213278 | N/A | | Nhsl2 | 79481 | 125115 | N/A |
| Limd1 | 25239 | 214309 | N/A | | Nhsl2 | 79481 | 124279 | 116112 |
| Lrp8 | 28613 | 143601 | 115854 | | Nhsl2 | 79481 | 101339 | 98893 |
| Lrp8 | 28613 | 106732 | 102343 | | Nhsl2 | 79481 | 155477 | N/A |
| Lrp8 | 28613 | 106731 | 102342 | | Nhsl2 | 79481 | 144753 | 143176 |
| Lrp8 | 28613 | 123140 | N/A | | Nhsl2 | 79481 | 144397 | N/A |
| Lrp8 | 28613 | 145832 | N/A | | Nhsl2 | 79481 | 129185 | N/A |
| Lrp8 | 28613 | 30356 | 30356 | | Nos1 | 29361 | 171055 | 127432 |
| Lrp8 | 28613 | 106733 | 102344 | | Nos1 | 29361 | 138554 | N/A |
| Lrp8 | 28613 | 126573 | 118020 | | Nos1 | 29361 | 102557 | 99617 |
| Lrp8 | 28613 | 146552 | N/A | | Nos1 | 29361 | 86451 | 138506 |

TABLE 2b-continued

ENSEMBL and GenBank IDs for mice

| Symbol | MUSG | MUST | MUSP |
|---|---|---|---|
| Nos1 | 29361 | 142742 | 120421 |
| Nos1 | 29361 | 138579 | 138176 |
| Nos1 | 29361 | 124194 | N/A |
| Nrep | 42834 | 51087 | 58132 |
| Nrep | 42834 | 171533 | 127787 |
| Nrep | 42834 | 168890 | 130297 |
| Nrn1 | 39114 | 224323 | 153099 |
| Nrn1 | 39114 | 37623 | 40900 |
| Nrn1 | 39114 | 223611 | 153395 |
| Nrn1 | 39114 | 122286 | 113721 |
| Nrn1 | 39114 | 224960 | 153173 |
| Nxph1 | 46178 | 162942 | N/A |
| Nxph1 | 46178 | 160300 | 125274 |
| Nxph1 | 46178 | 60369 | 60926 |
| Olfm2 | 32172 | 34692 | 34692 |
| Olfm2 | 32172 | 215999 | 149231 |
| Olfm2 | 32172 | 217198 | 151018 |
| Olfm2 | 32172 | 215039 | N/A |
| Opcml | 62257 | 134002 | N/A |
| Opcml | 62257 | 115243 | 110898 |
| Opcml | 62257 | 214395 | N/A |
| Opcml | 62257 | 123779 | N/A |
| Opcml | 62257 | 133142 | N/A |
| Opcml | 62257 | 73822 | 73493 |
| Opcml | 62257 | 126673 | N/A |
| Opcml | 62257 | 150098 | N/A |
| Opcml | 62257 | 126845 | N/A |
| Pagrla | 30680 | 200948 | 144469 |
| Pagrla | 30680 | 162069 | 123889 |
| Pagrla | 30680 | 206416 | 146318 |
| Patj | 61859 | 141796 | N/A |
| Patj | 61859 | 41284 | 49176 |
| Patj | 61859 | 107033 | 102648 |
| Patj | 61859 | 107034 | 102649 |
| Patj | 61859 | 107030 | 102645 |
| Patj | 61859 | 136675 | N/A |
| Patj | 61859 | 141965 | N/A |
| Patj | 61859 | 142103 | 116021 |
| Patj | 61859 | 107029 | 102644 |
| Patj | 61859 | 135606 | N/A |
| Patj | 61859 | 134901 | 115936 |
| Patj | 61859 | 102792 | 99854 |
| Patj | 61859 | 30290 | 30290 |
| Pcdh7 | 29108 | 191837 | 142319 |
| Pcdh7 | 29108 | 68110 | 66306 |
| Pcdh7 | 29108 | 94783 | 92376 |
| Pcdh7 | 29108 | 192287 | 142276 |
| Pcdh7 | 29108 | 195156 | 141378 |
| Pcdh7 | 29108 | 199310 | 143387 |
| Pcdh7 | 29108 | 192048 | 141505 |
| Phlda1 | 20205 | 164773 | 132815 |
| Phlda1 | 20205 | 186359 | N/A |
| Pkib | 19876 | 95668 | 93329 |
| Pkib | 19876 | 75992 | 75374 |
| Pkib | 19876 | 177299 | N/A |
| Pkib | 19876 | 176225 | N/A |
| Pkib | 19876 | 177438 | 135774 |
| Pkib | 19876 | 176741 | N/A |
| Pkib | 19876 | 177325 | 135280 |
| Pkib | 19876 | 177473 | 135835 |
| Pkib | 19876 | 66028 | 67532 |
| Pkib | 19876 | 175852 | 135666 |
| Pkib | 19876 | 176354 | N/A |
| Plcxd3 | 49148 | 130332 | N/A |
| Plcxd3 | 49148 | 61925 | 53553 |
| Pnpla7 | 36833 | 45295 | 44078 |
| Pnpla7 | 36833 | 137913 | 141577 |
| Pnpla7 | 36833 | 153618 | 117428 |
| Pnpla7 | 36833 | 152777 | 122394 |
| Pnpla7 | 36833 | 139031 | N/A |
| Pnpla7 | 36833 | 139643 | N/A |
| Pnpla7 | 36833 | 142139 | N/A |
| Pnpla7 | 36833 | 145508 | N/A |
| Pnpla7 | 36833 | 146153 | 117907 |
| Pnpla7 | 36833 | 132082 | N/A |
| Pnpla7 | 36833 | 154359 | N/A |

TABLE 2b-continued

ENSEMBL and GenBank IDs for mice

| Symbol | MUSG | MUST | MUSP |
|---|---|---|---|
| Pnpla7 | 36833 | 155601 | 115952 |
| Pnpla7 | 36833 | 128517 | N/A |
| Pnpla7 | 36833 | 138536 | N/A |
| Pnpla7 | 36833 | 141584 | N/A |
| Prdm8 | 35456 | 210477 | 147333 |
| Prdm8 | 35456 | 112959 | 108583 |
| Proca1 | 44122 | 78099 | 86022 |
| Proca1 | 44122 | 60539 | 50319 |
| Proca1 | 44122 | 108317 | 103953 |
| Proca1 | 44122 | 124772 | N/A |
| Prodh | 3526 | 139861 | 123223 |
| Prodh | 3526 | 3620 | 3620 |
| Prodh | 3526 | 136776 | 117597 |
| Prodh | 3526 | 141635 | 122889 |
| Prodh | 3526 | 126087 | 121736 |
| Prodh | 3526 | 123969 | N/A |
| Prodh | 3526 | 132241 | 118264 |
| Prodh | 111321 | 217439 | 149450 |
| Prodh | 111321 | 216391 | 149861 |
| Prodh | 111321 | 214498 | 149004 |
| Prodh | 111321 | 215115 | 149538 |
| Prodh | 111321 | 215314 | 150544 |
| Prodh | 111321 | 216479 | N/A |
| Prodh | 111321 | 216846 | 151119 |
| Prr18 | 55945 | 163887 | 127393 |
| Prr18 | 55945 | 69742 | 69019 |
| Prr36 | 64125 | 168386 | 133114 |
| Prr36 | 64125 | 177491 | 135130 |
| Prr36 | 64125 | 175906 | 135713 |
| Prr36 | 64125 | 176227 | 135166 |
| Ptch2 | 28681 | 30443 | 30443 |
| Ptch2 | 28681 | 144620 | 122548 |
| Ptch2 | 28681 | 156989 | N/A |
| Ptch2 | 28681 | 137209 | 114461 |
| Ptch2 | 28681 | 135133 | N/A |
| Ptch2 | 28681 | 123226 | N/A |
| Ptgds | 15090 | 114251 | 109889 |
| Ptgds | 15090 | 144016 | N/A |
| Ptgds | 15090 | 137417 | N/A |
| Ptgds | 15090 | 15234 | 15234 |
| Ptgds | 15090 | 114259 | 109897 |
| Rab34 | 2059 | 2128 | 2128 |
| Rab34 | 2059 | 150941 | 123033 |
| Rab34 | 2059 | 108322 | 103958 |
| Rab34 | 2059 | 56241 | 59769 |
| Rab34 | 2059 | 207728 | 146997 |
| Rab34 | 2059 | 148603 | N/A |
| Rab34 | 2059 | 126864 | N/A |
| Rab34 | 2059 | 156435 | 122848 |
| Rab34 | 2059 | 154542 | N/A |
| Rasgrp3 | 71042 | 164192 | 129393 |
| Rasgrp3 | 71042 | 95204 | 92828 |
| Rgs8 | 42671 | 41776 | 45715 |
| Rgs8 | 42671 | 124500 | 122518 |
| Rgs8 | 42671 | 111815 | 107446 |
| Rgs8 | 42671 | 152114 | 121910 |
| Rgs8 | 42671 | 111812 | 107443 |
| Rgs8 | 42671 | 147700 | 123565 |
| Rgs8 | 42671 | 147482 | 118365 |
| Rgs8 | 42671 | 111814 | 107445 |
| Rgs8 | 42671 | 111810 | 107441 |
| Rgs8 | 42671 | 147794 | N/A |
| Ror1 | 35305 | 39630 | 48171 |
| Rora | 32238 | 140351 | N/A |
| Rora | 32238 | 34766 | 34766 |
| Rora | 32238 | 174296 | 134291 |
| Rora | 32238 | 143507 | N/A |
| Rora | 32238 | 132355 | N/A |
| Rora | 32238 | 113624 | 109254 |
| Rtl4 | 71679 | 112843 | 108462 |
| Rtl4 | 71679 | 96301 | 108463 |
| S100a3 | 1021 | 199225 | N/A |
| S100a3 | 1021 | 200508 | 142747 |
| S100a3 | 1021 | 200290 | 142334 |
| S100a3 | 1021 | 1047 | 1047 |
| S100a3 | 1021 | 196635 | N/A |

TABLE 2b-continued

TABLE 2b-continued

ENSEMBL and GenBank IDs for mice

ENSEMBL and GenBank IDs for mice

| Symbol | MUSG | MUST | MUSP | Symbol | MUSG | MUST | MUSP |
|---|---|---|---|---|---|---|---|
| S1pr5 | 45087 | 122088 | 113843 | Stxbp5l | 22829 | 23526 | 23526 |
| Scn2a | 75318 | 144254 | 117955 | Stxbp5l | 22829 | 114787 | 110435 |
| Scn2a | 75318 | 28377 | 28377 | Sv2b | 53025 | 165175 | 127245 |
| Scn2a | 75318 | 201378 | N/A | Sv2b | 53025 | 85164 | 82254 |
| Scn2a | 75318 | 202653 | N/A | Sv2b | 53025 | 206344 | 146049 |
| Scn2a | 75318 | 200829 | 143882 | Sv2b | 53025 | 207001 | 146277 |
| Scn2a | 75318 | 138368 | N/A | Sv2b | 53025 | 206845 | N/A |
| Scn2a | 75318 | 202508 | 143958 | Sv2b | 53025 | 206675 | N/A |
| Scn2a | 75318 | 202162 | 143888 | Sv2b | 53025 | 206236 | N/A |
| Scn2a | 75318 | 100067 | 97645 | Syt1 | 35864 | 105276 | 100912 |
| Sema5b | 52133 | 50625 | 57494 | Syt1 | 35864 | 64054 | 63293 |
| Sema5b | 52133 | 133554 | N/A | Syt1 | 35864 | 147593 | N/A |
| Sema5b | 52133 | 120756 | 112536 | Syt1 | 35864 | 156979 | N/A |
| Sema5b | 52133 | 149097 | N/A | Syt1 | 35864 | 146618 | N/A |
| Sema5b | 52133 | 128966 | N/A | Syt1 | 35864 | 126278 | N/A |
| Sema5b | 52133 | 128347 | 121703 | Tbata | 20096 | 122261 | 113902 |
| Sema5b | 52133 | 149855 | 115969 | Tbata | 20096 | 121297 | 113253 |
| Sema5b | 52133 | 139805 | N/A | Tbata | 20096 | 35894 | 36422 |
| Sh3pxd2b | 40711 | 38753 | 44276 | Tbata | 20096 | 131879 | 118942 |
| Sh3pxd2b | 40711 | 138771 | N/A | Tbata | 20096 | 143207 | 151724 |
| Shf | 33256 | 48635 | 45135 | Tbata | 20096 | 148181 | 151940 |
| Shf | 33256 | 151130 | 114524 | Tbata | 20096 | 151886 | 151775 |
| Shf | 33256 | 125826 | 117099 | Tbata | 20096 | 140456 | 151410 |
| Shf | 33256 | 110532 | 106161 | Tbata | 20096 | 126831 | 119957 |
| Shf | 33256 | 139819 | 119980 | Tbata | 20096 | 79235 | 78227 |
| Shf | 33256 | 135848 | N/A | Tenm1 | 16150 | 126161 | N/A |
| Shf | 33256 | 110530 | 106159 | Tenm1 | 16150 | 115059 | 110711 |
| Shf | 33256 | 121237 | 113923 | Tenm1 | 16150 | 125231 | N/A |
| Shf | 33256 | 143484 | 120732 | Tenm1 | 16150 | 154433 | N/A |
| Shf | 33256 | 110531 | 106160 | Tenm1 | 16150 | 115058 | 110710 |
| Slain1 | 55717 | 69443 | 70592 | Tenm1 | 16150 | 16294 | 16294 |
| Slain1 | 55717 | 160805 | 125128 | Tmem100 | 69763 | 92788 | 90464 |
| Slain1 | 55717 | 159456 | 125685 | Tmem151b | 96847 | 180252 | 136337 |
| Slain1 | 55717 | 162818 | 123742 | Tmem176b | 29810 | 166247 | 131064 |
| Slc1a2 | 5089 | 80210 | 79100 | Tmem176b | 29810 | 164733 | 128705 |
| Slc1a2 | 5089 | 111212 | 106843 | Tmem176b | 29810 | 101429 | 98972 |
| Slc1a2 | 5089 | 5220 | 5220 | Tmem176b | 29810 | 203355 | 145395 |
| Slc1a2 | 5089 | 111213 | 106844 | Tmem176b | 29810 | 204073 | 144864 |
| Slc1a2 | 5089 | 125085 | N/A | Tmem176b | 29810 | 204783 | 144810 |
| Slc1a2 | 5089 | 137466 | N/A | Tmem176b | 29810 | 205159 | 144949 |
| Slc1a2 | 5089 | 136221 | N/A | Tmem176b | 29810 | 203229 | 144865 |
| Slc1a2 | 5089 | 145921 | N/A | Tmem176b | 29810 | 205147 | 145235 |
| Slc1a2 | 5089 | 128622 | N/A | Tmem176b | 29810 | 203265 | 144869 |
| Slc1a2 | 5089 | 154446 | 117549 | Tmem176b | 29810 | 203501 | 144742 |
| Slc1a2 | 5089 | 123759 | 115129 | Tmem176b | 29810 | 203618 | N/A |
| Slc1a2 | 5089 | 136488 | 122094 | Tmem229a | 48022 | 127247 | 116234 |
| Slc38a3 | 10064 | 167868 | 130414 | Tmem88b | 73680 | 97742 | 95349 |
| Slc38a3 | 10064 | 10208 | 10208 | Trf | 32554 | 112645 | 108264 |
| Slc38a3 | 10064 | 194895 | N/A | Trf | 32554 | 35158 | 35158 |
| Slc38a3 | 10064 | 193932 | 142087 | Trf | 32554 | 190051 | N/A |
| Slc38a3 | 10064 | 177567 | 137561 | Trf | 32554 | 168142 | 128609 |
| Slc38a3 | 10064 | 195739 | 141484 | Trf | 32554 | 170904 | 128390 |
| Slc38a3 | 10064 | 192211 | 141569 | Trf | 32554 | 164377 | 128647 |
| Slc38a3 | 10064 | 194230 | N/A | Trf | 32554 | 112503 | N/A |
| Slc38a3 | 10064 | 195033 | N/A | Trf | 32554 | 165296 | 129013 |
| Slc38a3 | 10064 | 191923 | N/A | Trf | 32554 | 126359 | 120472 |
| Slc38a3 | 10064 | 192323 | 141850 | Tspyl4 | 39485 | 47935 | 36360 |
| Slc38a3 | 10064 | 192990 | 141528 | Tspyl4 | 39485 | 213791 | N/A |
| Slc38a3 | 10064 | 195843 | 141552 | Ttyh1 | 30428 | 130150 | N/A |
| Slc38a3 | 10064 | 193495 | N/A | Ttyh1 | 30428 | 126971 | N/A |
| Slitrk4 | 46699 | 69926 | 64443 | Ttyh1 | 30428 | 119661 | 113937 |
| Slitrk4 | 46699 | 114679 | 110327 | Ttyh1 | 30428 | 129423 | 120182 |
| Slitrk4 | 46699 | 156121 | 122648 | Ttyh1 | 30428 | 148760 | N/A |
| Snx22 | 39452 | 44711 | 44389 | Ttyh1 | 30428 | 79415 | 78384 |
| Snx22 | 39452 | 214332 | N/A | Ttyh1 | 30428 | 206987 | 146170 |
| Speer4a | 73119 | 79447 | 78415 | Ttyh1 | 30428 | 153673 | 115623 |
| Sstr1 | 35431 | 110671 | 106299 | Ttyh1 | 30428 | 32594 | 32594 |
| Sstr1 | 35431 | 44299 | 37045 | Ttyh1 | 30428 | 151959 | N/A |
| Stxbp5l | 22829 | 114782 | 110430 | Ttyh1 | 30428 | 134536 | N/A |
| Stxbp5l | 22829 | 149790 | N/A | Ttyh1 | 30428 | 206869 | 146131 |
| Stxbp5l | 22829 | 123629 | N/A | Ttyh1 | 30428 | 205971 | N/A |
| Stxbp5l | 22829 | 114780 | 110428 | Ttyh1 | 30428 | 132400 | N/A |
| Stxbp5l | 22829 | 114781 | 110429 | Ttyh1 | 30428 | 148951 | N/A |
| Stxbp5l | 22829 | 149984 | N/A | Ttyh1 | 30428 | 128317 | N/A |
| Stxbp5l | 22829 | 114775 | 110423 | Ttyh1 | 30428 | 139789 | N/A |
| Stxbp5l | 22829 | 151910 | N/A | Ttyh1 | 30428 | 140637 | N/A |

TABLE 2b-continued

| Symbol | MUSG | MUST | MUSP |
|---|---|---|---|
| Unc5d | 63626 | 168630 | 128521 |
| Unc5d | 63626 | 210785 | 147721 |
| Unc5d | 63626 | 211448 | 147306 |
| Unc5d | 63626 | 210298 | 148236 |
| Unc5d | 63626 | 209401 | 148043 |
| Usp54 | 34235 | 22356 | 22356 |
| Usp54 | 34235 | 123287 | 117503 |
| Usp54 | 34235 | 143267 | N/A |
| Usp54 | 34235 | 127342 | N/A |
| Usp54 | 34235 | 35340 | 36214 |
| Wscd2 | 63430 | 138757 | N/A |
| Wscd2 | 63430 | 94452 | 92021 |
| Wscd2 | 63430 | 181650 | N/A |
| Wscd2 | 63430 | 180565 | N/A |
| Wscd2 | 63430 | 181294 | N/A |
| Wscd2 | 63430 | 198673 | N/A |
| Xylt1 | 30657 | 160035 | N/A |
| Xylt1 | 30657 | 32892 | 32892 |
| Xylt1 | 30657 | 161889 | N/A |
| Zdhhc23 | 36304 | 36321 | 44744 |
| Zdhhc23 | 36304 | 165648 | 128650 |
| Zfand4 | 42213 | 222819 | 152213 |
| Zfand4 | 42213 | 220845 | 152078 |
| Zfand4 | 42213 | 36503 | 40057 |
| Zfand4 | 42213 | 223495 | 152064 |
| Zfand4 | 42213 | 222494 | 152710 |
| Zfand4 | 42213 | 221239 | N/A |
| Zfand4 | 42213 | 222144 | N/A |
| Zfand4 | 42213 | 221069 | 152313 |
| Zfand4 | 42213 | 221824 | N/A |
| Zfand4 | 42213 | 112900 | 108521 |
| Zfp488 | 44519 | 166737 | 132436 |

For rats, Table 3 provides the unique ENSEMBL identifiers corresponding to the rat genes (MUSG), transcripts (MUST), and proteins (if available) (MUSP) analyzed in the experiments herein. The unique identifiers for each ENSEMBL entry has been modified to remove the first five leading zeros (0) of the identifier after the ENSMUSG, ENSMUST, and ENSMUSP label.

TABLE 3

ENSEMBL IDs for rats

| Symbol | MUSG | MUST | MUSP |
|---|---|---|---|
| 1700047M11Rik | 100147 | 189594 | N/A |
| 1700047M11Rik | 100147 | 185216 | N/A |
| 2410124H12Rik | 051297 | 160494 | N/A |
| 3110039M20Rik | 104861 | 127041 | N/A |
| 3110039M20Rik | 104861 | 145291 | N/A |
| 8030451O07Rik | N/A | N/A | N/A |
| 9530059O14Rik | 097736 | 181682 | N/A |
| 9530059O14Rik | 097736 | 181107 | N/A |
| 9530059O14Rik | 097736 | 215759 | N/A |
| 9530059O14Rik | 097736 | 181719 | N/A |
| A230077H06Rik | 100600 | 189574 | N/A |
| A230077H06Rik | 100600 | 188579 | N/A |
| A230077H06Rik | 100600 | 189855 | N/A |
| A230077H06Rik | 100600 | 205953 | N/A |
| A2m | 030111 | 204850 | 144862 |
| A2m | 030111 | 032203 | 032203 |
| A2m | 030111 | 203413 | N/A |
| A730036I17Rik | 056738 | 143346 | N/A |
| A730036I17Rik | 056738 | 148548 | N/A |
| A730036I17Rik | 056738 | 165505 | N/A |
| Aass | 029695 | 031707 | 031707 |
| Aass | 029695 | 138063 | N/A |
| Aass | 029695 | 149864 | 115079 |
| Aass | 029695 | 152280 | N/A |
| Aatk | 025375 | 103020 | 099309 |
| Aatk | 025375 | 064307 | 067181 |

TABLE 3-continued

ENSEMBL IDs for rats

| Symbol | MUSG | MUST | MUSP |
|---|---|---|---|
| Aatk | 025375 | 103019 | 099308 |
| Aatk | 025375 | 150730 | N/A |
| Aatk | 025375 | 142959 | N/A |
| Aatk | 025375 | 134319 | N/A |
| Aatk | 025375 | 132575 | N/A |
| Aatk | 025375 | 136386 | N/A |
| Aatk | 025375 | 128836 | N/A |
| Abat | 057880 | 065987 | 063548 |
| Abat | 057880 | 140795 | N/A |
| Abat | 057880 | 115838 | 111504 |
| Abat | 057880 | 144444 | 121881 |
| Abat | 057880 | 115839 | 111505 |
| Abat | 057880 | 128459 | N/A |
| Abat | 057880 | 138987 | 116686 |
| Abca1 | 015243 | 030010 | 030010 |
| Abca1 | 015243 | 149127 | N/A |
| Abcc8 | 040136 | 210655 | 148169 |
| Abcc8 | 040136 | 209432 | 147431 |
| Abcc8 | 040136 | 210770 | 147925 |
| Abcc8 | 040136 | 210637 | N/A |
| Abcc8 | 040136 | 033123 | 033123 |
| Abcc8 | 040136 | 210110 | 147479 |
| Abcc8 | 040136 | 210986 | N/A |
| Abcc8 | 040136 | 210511 | 148198 |
| Abcg2 | 029802 | 147213 | 120940 |
| Abcg2 | 029802 | 204924 | N/A |
| Abcg2 | 029802 | 148008 | 114454 |
| Abcg2 | 029802 | 031822 | 031822 |
| Abcg2 | 029802 | 124542 | N/A |
| Abcg2 | 029802 | 145161 | 122924 |
| Abcg2 | 029802 | 143752 | 138608 |
| Abcg2 | 029802 | 203146 | 145435 |
| Abcg2 | 029802 | 114294 | 109933 |
| Abcg2 | 029802 | 204948 | 144876 |
| Abcg2 | 029802 | 143447 | N/A |
| Abcg2 | 029802 | 145685 | 138703 |
| Abcg2 | 029802 | 134426 | N/A |
| Abhd2 | 039202 | 037315 | 038361 |
| Abhd2 | 039202 | 135333 | N/A |
| Abhd5 | 032540 | 156520 | 122274 |
| Abhd5 | 032540 | 035128 | 135538 |
| Abhd5 | 032540 | 111497 | 107123 |
| Abhd5 | 032540 | 176005 | N/A |
| Abhd5 | 032540 | 175973 | 135807 |
| Abhd5 | 032540 | 214061 | N/A |
| Abhd5 | 032540 | 216775 | N/A |
| Abhd5 | 032540 | 154161 | 122939 |
| Abi3bp | 035258 | 048471 | 036257 |
| Abi3bp | 035258 | 096013 | 093712 |
| Abi3bp | 035258 | 096012 | 093711 |
| Abi3bp | 035258 | 171000 | 128818 |
| Ablim1 | 025085 | 079360 | 078336 |
| Ablim1 | 025085 | 111529 | 107154 |
| Ablim1 | 025085 | 099294 | 096897 |
| Ablim1 | 025085 | 111559 | 107184 |
| Ablim1 | 025085 | 111528 | 107153 |
| Ablim1 | 025085 | 111526 | 107151 |
| Ablim1 | 025085 | 111550 | 107175 |
| Ablim1 | 025085 | 111558 | 107183 |
| Ablim1 | 025085 | 111555 | 107180 |
| Ablim1 | 025085 | 111546 | 107172 |
| Ablim1 | 025085 | 111544 | 107169 |
| Ablim1 | 025085 | 156316 | N/A |
| Ablim1 | 025085 | 137389 | N/A |
| Ablim1 | 025085 | 127198 | N/A |
| Ablim1 | 025085 | 133782 | N/A |
| Ablim1 | 025085 | 134430 | N/A |
| Ablim1 | 025085 | 150425 | N/A |
| Ablim1 | 025085 | 128212 | N/A |
| Ablim1 | 025085 | 111524 | 107149 |
| Ablim1 | 025085 | 133369 | 117798 |
| Ablim1 | 025085 | 104902 | 127818 |
| Ablim2 | 029095 | 101280 | 098838 |
| Ablim2 | 029095 | 054598 | 050571 |
| Ablim2 | 029095 | 114205 | 109843 |
| Ablim2 | 029095 | 114210 | 109848 |

TABLE 3-continued

| ENSEMBL IDs for rats | | | |
|---|---|---|---|
| Symbol | MUSG | MUST | MUSP |
| Ablim2 | 029095 | 114206 | 109844 |
| Ablim2 | 029095 | 114204 | 109842 |
| Ablim2 | 029095 | 129347 | 123525 |
| Ablim2 | 029095 | 130233 | 118159 |
| Ablim2 | 029095 | 114203 | 109841 |
| Ablim2 | 029095 | 150146 | 144134 |
| Ablim2 | 029095 | 151636 | 123616 |
| Ablim2 | 029095 | 135885 | N/A |
| Ablim2 | 029095 | 151322 | 114616 |
| Ablim2 | 029095 | 125378 | 115931 |
| Ablim2 | 029095 | 153025 | N/A |
| Ablim2 | 029095 | 130209 | N/A |
| Ablim2 | 029095 | 153529 | 118019 |
| Ablim3 | 032735 | 049378 | 041243 |
| Ablim3 | 032735 | 166783 | 125836 |
| Abtb2 | 032724 | 076212 | 075566 |
| Abtb2 | 032724 | 131122 | N/A |
| Abtb2 | 032724 | 138580 | N/A |
| Acad8 | 031969 | 129490 | N/A |
| Acad8 | 031969 | 120367 | 112908 |
| Acad8 | 031969 | 151075 | N/A |
| Acad8 | 031969 | 215693 | 150728 |
| Acad8 | 031969 | 128923 | 122444 |
| Acad8 | 031969 | 132293 | 123012 |
| Acad8 | 031969 | 138102 | N/A |
| Acad8 | 031969 | 060513 | 054370 |
| Acer3 | 030760 | 033020 | 033020 |
| Acer3 | 030760 | 120520 | 112884 |
| Acer3 | 030760 | 151258 | 116127 |
| Acer3 | 030760 | 206182 | N/A |
| Acer3 | 030760 | 137899 | 120334 |
| Aco2 | 022477 | 023116 | 023116 |
| Aco2 | 022477 | 157003 | N/A |
| Aco2 | 022477 | 135198 | N/A |
| Aco2 | 022477 | 126352 | N/A |
| Aco2 | 022477 | 155704 | N/A |
| Aco2 | 022477 | 144324 | N/A |
| Acot11 | 034853 | 102762 | 099823 |
| Acot11 | 034853 | 065253 | 069636 |
| Acot11 | 034853 | 140541 | 124567 |
| Acot11 | 034853 | 144809 | N/A |
| Acot11 | 034853 | 156567 | 123942 |
| Acot11 | 034853 | 145061 | 125123 |
| Acot11 | 034853 | 148688 | 124385 |
| Acsbg1 | 032281 | 034822 | 034822 |
| Acsbg1 | 032281 | 138315 | 118133 |
| Acsbg1 | 032281 | 128163 | 119551 |
| Acsbg1 | 032281 | 128624 | 121622 |
| Acsbg1 | 032281 | 132914 | N/A |
| Acsm5 | 030972 | 207796 | 146520 |
| Acsm5 | 030972 | 066465 | 063416 |
| Acsm5 | 030972 | 207307 | 146737 |
| Acsm5 | 030972 | 207440 | 146938 |
| Acsm5 | 030972 | 207381 | 146715 |
| Acsm5 | 030972 | 207387 | 146357 |
| Acsm5 | 030972 | 207813 | 147176 |
| Actb | 029580 | 100497 | 098066 |
| Actb | 029580 | 196997 | N/A |
| Actb | 029580 | 167721 | 127663 |
| Actb | 029580 | 171419 | 130611 |
| Actb | 029580 | 167386 | N/A |
| Actb | 029580 | 163829 | 132135 |
| Actb | 029580 | 106216 | 101823 |
| Actb | 029580 | 165629 | N/A |
| Actb | 029580 | 164765 | N/A |
| Actbl2 | 055194 | 054716 | 052086 |
| Actr3b | 056367 | 128727 | 121629 |
| Actr3b | 056367 | 088244 | 085578 |
| Actr3b | 056367 | 198693 | N/A |
| Adam11 | 020926 | 103081 | 099370 |
| Adam11 | 020926 | 068150 | 069466 |
| Adam11 | 020926 | 124879 | N/A |
| Adam11 | 020926 | 141563 | N/A |
| Adam11 | 020926 | 142912 | N/A |
| Adam11 | 020926 | 126024 | N/A |
| Adam11 | 020926 | 134296 | N/A |

TABLE 3-continued

| ENSEMBL IDs for rats | | | |
|---|---|---|---|
| Symbol | MUSG | MUST | MUSP |
| Adam11 | 020926 | 143269 | N/A |
| Adam11 | 020926 | 135513 | N/A |
| Adam12 | 054555 | 067680 | 065213 |
| Adam12 | 054555 | 138363 | 114874 |
| Adam12 | 054555 | 134504 | 123161 |
| Adam12 | 054555 | 127524 | 120094 |
| Adam12 | 054555 | 206313 | N/A |
| Adam12 | 054555 | 206426 | N/A |
| Adam12 | 054555 | 154144 | N/A |
| Adamts10 | 024299 | 174666 | N/A |
| Adamts10 | 024299 | 173972 | N/A |
| Adamts10 | 024299 | 174104 | N/A |
| Adamts10 | 024299 | 173813 | N/A |
| Adamts10 | 024299 | 174348 | 133856 |
| Adamts10 | 024299 | 172922 | 133891 |
| Adamts10 | 024299 | 173013 | 134181 |
| Adamts10 | 024299 | 173030 | 134549 |
| Adamts10 | 024299 | 174170 | N/A |
| Adamts10 | 024299 | 173241 | 134298 |
| Adamts10 | 024299 | 087623 | 084905 |
| Adamts10 | 024299 | 173931 | 133434 |
| Adamts15 | 033453 | 065112 | 067022 |
| Adamts15 | 033453 | 217070 | N/A |
| Adamts15 | 033453 | 216215 | 150677 |
| Adamts16 | 049538 | 080145 | 079041 |
| Adamts16 | 049538 | 123552 | 122031 |
| Adamts16 | 049538 | 109694 | 105316 |
| Adamts16 | 049538 | 130726 | N/A |
| Adamts18 | 053399 | 093113 | 090801 |
| Adamts18 | 053399 | 212665 | 148330 |
| Adamts18 | 053399 | 212437 | 148288 |
| Adamts18 | 053399 | 213076 | N/A |
| Adamts18 | 053399 | 213061 | N/A |
| Adamts18 | 053399 | 213078 | N/A |
| Adamts18 | 053399 | 212527 | N/A |
| Adamts2 | 036545 | 040523 | 040171 |
| Adamts2 | 036545 | 142118 | N/A |
| Adamts2 | 036545 | 125988 | N/A |
| Adamts2 | 036545 | 127534 | N/A |
| Adamts6 | 046169 | 224784 | 153665 |
| Adamts6 | 046169 | 223562 | 153504 |
| Adamts6 | 046169 | 224742 | 152936 |
| Adamts6 | 046169 | 224208 | 153359 |
| Adamts6 | 046169 | 224303 | 153431 |
| Adamts6 | 046169 | 224504 | 153194 |
| Adamts6 | 046169 | 065766 | 064570 |
| Adamts9 | 030022 | 113438 | 109065 |
| Adamts9 | 030022 | 125490 | N/A |
| Adamts9 | 030022 | 130314 | N/A |
| Adamts9 | 030022 | 203690 | N/A |
| Adamts9 | 030022 | 136751 | N/A |
| Adamts9 | 030022 | 167391 | 126498 |
| Adamtsl4 | 015850 | 117782 | 113424 |
| Adamtsl4 | 015850 | 015994 | 015994 |
| Adamtsl4 | 015850 | 151054 | N/A |
| Adamtsl4 | 015850 | 124410 | N/A |
| Adamtsl4 | 015850 | 148854 | 120844 |
| Adcy1 | 020431 | 020706 | 020706 |
| Adcy1 | 020431 | 135398 | N/A |
| Adcyap1r1 | 029778 | 070736 | 063784 |
| Adcyap1r1 | 029778 | 070756 | 066902 |
| Adcyap1r1 | 029778 | 166962 | 130742 |
| Adcyap1r1 | 029778 | 167484 | 131641 |
| Adcyap1r1 | 029778 | 172084 | 127319 |
| Adcyap1r1 | 029778 | 165857 | 129614 |
| Adcyap1r1 | 029778 | 167234 | 126994 |
| Adcyap1r1 | 029778 | 165786 | 130923 |
| Add2 | 030000 | 203529 | N/A |
| Add2 | 030000 | 204059 | 145160 |
| Add2 | 030000 | 203366 | 144849 |
| Add2 | 030000 | 203445 | 145494 |
| Add2 | 030000 | 205034 | 145034 |
| Add2 | 030000 | 203724 | 145296 |
| Add2 | 030000 | 203196 | 145104 |
| Add2 | 030000 | 203786 | 144694 |
| Add2 | 030000 | 203279 | 145452 |

TABLE 3-continued

| ENSEMBL IDs for rats | | | |
| --- | --- | --- | --- |
| Symbol | MUSG | MUST | MUSP |
| Add2 | 030000 | 032069 | 032069 |
| Adgra1 | 025475 | 026548 | 026548 |
| Adgra1 | 025475 | 137584 | N/A |
| Adgra1 | 025475 | 129454 | N/A |
| Adgra3 | 029090 | 030971 | 030971 |
| Adgra3 | 029090 | 196177 | N/A |
| Adgra3 | 029090 | 198818 | N/A |
| Adgra3 | 029090 | 196229 | N/A |
| Adgra3 | 029090 | 198868 | N/A |
| Adgra3 | 029090 | 196915 | N/A |
| Adgra3 | 029090 | 199132 | N/A |
| Adgrg1 | 031785 | 211850 | N/A |
| Adgrg1 | 031785 | 212581 | 148742 |
| Adgrg1 | 031785 | 179619 | 137520 |
| Adgrg1 | 031785 | 212660 | 148644 |
| Adgrg1 | 031785 | 093271 | 090959 |
| Adgrg1 | 031785 | 211944 | 148386 |
| Adgrg1 | 031785 | 212799 | 148349 |
| Adgrg1 | 031785 | 212141 | 148331 |
| Adgrg1 | 031785 | 212976 | 148439 |
| Adgrg1 | 031785 | 212995 | 148309 |
| Adgrg1 | 031785 | 212956 | 148374 |
| Adgrg1 | 031785 | 212531 | 148650 |
| Adgrg1 | 031785 | 211984 | 148412 |
| Adgrg1 | 031785 | 212118 | 148304 |
| Adgrg1 | 031785 | 211806 | N/A |
| Adgrg1 | 031785 | 211911 | N/A |
| Adgrv1 | 069170 | 128120 | 122358 |
| Adgrv1 | 069170 | 095585 | 093245 |
| Adgrv1 | 069170 | 224088 | 153419 |
| Adgrv1 | 069170 | 125698 | 120136 |
| Adgrv1 | 069170 | 156631 | N/A |
| Adgrv1 | 069170 | 109565 | 105193 |
| Adgrv1 | 069170 | 129725 | N/A |
| Adgrv1 | 069170 | 156627 | N/A |
| Adgrv1 | 069170 | 146141 | N/A |
| Adgrv1 | 069170 | 125663 | N/A |
| Adgrv1 | 069170 | 126444 | 123552 |
| Adgrv1 | 069170 | 128585 | 121899 |
| Adgrv1 | 069170 | 146749 | 114579 |
| Adgrv1 | 069170 | 132045 | N/A |
| Adm | 030790 | 033054 | 033054 |
| Adm | 030790 | 185766 | N/A |
| Adora1 | 042429 | 086465 | 083656 |
| Adora1 | 042429 | 038191 | 043522 |
| Adora1 | 042429 | 187631 | 140801 |
| Adora1 | 042429 | 169927 | 132105 |
| Adra1a | 045875 | 159365 | 124322 |
| Adra1a | 045875 | 054661 | 053703 |
| Adra1a | 045875 | 160647 | N/A |
| Adra1a | 045875 | 225182 | 153103 |
| Adra1a | 045875 | 159068 | 124570 |
| Adra1a | 045875 | 161339 | 125354 |
| Adra1b | 050541 | 067258 | 070200 |
| Adra1b | 050541 | 139906 | 123435 |
| Adra1b | 050541 | 124306 | N/A |
| Adra1b | 050541 | 167574 | 129200 |
| Adra2b | 058620 | 104934 | 100539 |
| Adra2b | 058620 | 071902 | 071798 |
| Adrb2 | 045730 | 053640 | 062256 |
| AF529169 | 039313 | 044491 | 046111 |
| AF529169 | 039313 | 191465 | 140942 |
| Afap1 | 029094 | 064571 | 067779 |
| Afap1 | 029094 | 146300 | N/A |
| Afap1 | 029094 | 141824 | 119364 |
| Afap1 | 029094 | 212374 | 148414 |
| Afap1 | 029094 | 201482 | N/A |
| Afap1l1 | 033032 | 154876 | 121278 |
| Afap1l1 | 033032 | 120472 | 113286 |
| Afap1l1 | 033032 | 147278 | N/A |
| Aff2 | 031189 | 033532 | 033532 |
| Aff2 | 031189 | 143097 | N/A |
| Aff2 | 031189 | 151662 | N/A |
| Aff2 | 031189 | 139977 | N/A |
| Afp | 054932 | 042755 | 041006 |
| Afp | 054932 | 200693 | 144019 |

TABLE 3-continued

| ENSEMBL IDs for rats | | | |
| --- | --- | --- | --- |
| Symbol | MUSG | MUST | MUSP |
| Afp | 054932 | 201061 | N/A |
| Afp | 054932 | 200728 | N/A |
| Afp | 054932 | 202209 | N/A |
| Agap1 | 055013 | 027521 | 027521 |
| Agap1 | 055013 | 190096 | 140599 |
| Agap1 | 055013 | 185417 | N/A |
| Agap1 | 055013 | 074945 | 074478 |
| Agap1 | 055013 | 212721 | 148732 |
| Agap1 | 055013 | 212924 | 148317 |
| Agpat3 | 001211 | 001240 | 001240 |
| Agpat3 | 001211 | 105389 | 101028 |
| Agpat3 | 001211 | 105390 | 101029 |
| Agpat3 | 001211 | 105388 | 101027 |
| Agpat3 | 001211 | 105387 | 101026 |
| Agpat3 | 001211 | 146296 | N/A |
| Agpat3 | 001211 | 219907 | N/A |
| Agpat3 | 001211 | 219932 | 151528 |
| Agpat3 | 001211 | 139282 | 119713 |
| Agpat3 | 001211 | 150828 | 114885 |
| Agpat3 | 001211 | 138035 | 121052 |
| Agpat3 | 001211 | 146899 | 114657 |
| Agpat3 | 001211 | 166360 | 132954 |
| Agpat4 | 023827 | 164143 | 128085 |
| Agpat4 | 023827 | 024594 | 024594 |
| Agpat4 | 023827 | 172259 | N/A |
| Agpat4 | 023827 | 167792 | 127477 |
| Agpat4 | 023827 | 170858 | 127417 |
| Agpat4 | 023827 | 167905 | N/A |
| Agrn | 041936 | 154494 | N/A |
| Agrn | 041936 | 105574 | 101199 |
| Agrn | 041936 | 071248 | 071229 |
| Agrn | 041936 | 105575 | 101200 |
| Agrn | 041936 | 181062 | N/A |
| Agrn | 041936 | 180572 | 137931 |
| Agrn | 041936 | 144749 | N/A |
| AI464131 | 046312 | 054920 | 059038 |
| AI464131 | 046312 | 149596 | 122357 |
| AI593442 | 078307 | 213937 | 149532 |
| AI593442 | 078307 | 213843 | 149128 |
| AI593442 | 078307 | 098768 | 096365 |
| Ak4 | 028527 | 102780 | 099841 |
| Ak4 | 028527 | 106946 | 102559 |
| Ak4 | 028527 | 106945 | 102558 |
| Ak4 | 028527 | 131397 | 115456 |
| Ak4 | 028527 | 133055 | 115454 |
| Ak4 | 028527 | 151561 | N/A |
| Ak4 | 028527 | 155749 | 121112 |
| Akain1 | 091636 | 169935 | 131134 |
| Akna | 039158 | 035724 | 041614 |
| Akna | 039158 | 140586 | N/A |
| Aldh1a1 | 053279 | 224807 | N/A |
| Aldh1a1 | 053279 | 225337 | 153410 |
| Aldh1a1 | 053279 | 224358 | N/A |
| Aldh1a1 | 053279 | 225313 | 153011 |
| Aldh1a1 | 053279 | 225249 | N/A |
| Aldh1a1 | 053279 | 087638 | 084918 |
| Aldh1a1 | 053279 | 224807 | N/A |
| Aldh1a1 | 053279 | 225337 | 153410 |
| Aldh1a1 | 053279 | 224358 | N/A |
| Aldh1a1 | 053279 | 225313 | 153011 |
| Aldh1a1 | 053279 | 225249 | N/A |
| Aldh1a1 | 053279 | 087638 | 084918 |
| Aldh1l1 | 030088 | 127199 | N/A |
| Aldh1l1 | 030088 | 130418 | 114304 |
| Aldh1l1 | 030088 | 032175 | 032175 |
| Aldh1l1 | 030088 | 203111 | 145233 |
| Aldh1l1 | 030088 | 204796 | 145380 |
| Aldh1l1 | 030088 | 152436 | N/A |
| Aldh1l1 | 030088 | 137669 | N/A |
| Aldh1l2 | 020256 | 020497 | 020497 |
| Aldh1l2 | 020256 | 146640 | 117076 |
| Aldh1l2 | 020256 | 147381 | N/A |
| Aldh1l2 | 020256 | 141184 | N/A |
| Aldh1l2 | 020256 | 138858 | N/A |
| Aldh1l2 | 020256 | 143793 | N/A |
| Aldh1l2 | 020256 | 125193 | N/A |

TABLE 3-continued

| ENSEMBL IDs for rats | | | |
| --- | --- | --- | --- |
| Symbol | MUSG | MUST | MUSP |
| Aldoc | 017390 | 102478 | 099536 |
| Aldoc | 017390 | 128032 | N/A |
| Aldoc | 017390 | 124090 | N/A |
| Aldoc | 017390 | 156039 | N/A |
| Aldoc | 017390 | 148689 | N/A |
| Aldoc | 017390 | 017534 | 017534 |
| Als2 | 026024 | 027178 | 027178 |
| Als2 | 026024 | 163058 | 125753 |
| Als2 | 026024 | 159166 | N/A |
| Als2 | 026024 | 160945 | 140990 |
| Als2 | 026024 | 188469 | N/A |
| Amz1 | 050022 | 126975 | N/A |
| Amz1 | 050022 | 060918 | 053110 |
| Amz1 | 050022 | 177057 | N/A |
| Amz1 | 050022 | 120630 | 113911 |
| Amz1 | 050022 | 156006 | N/A |
| Amz1 | 050022 | 155644 | N/A |
| Amz1 | 050022 | 176035 | 135504 |
| Angpt1 | 022309 | 022921 | 022921 |
| Angpt1 | 022309 | 227738 | N/A |
| Angptl3 | 028553 | 030280 | 030280 |
| Angptl3 | 028553 | 136091 | N/A |
| Angptl3 | 028553 | 125546 | N/A |
| Ankrd33b | 022237 | 123325 | 118984 |
| Ankrd33b | 022237 | 156679 | 117974 |
| Ankrd33b | 022237 | 044324 | 037918 |
| Ankrd33b | 022237 | 110410 | 106040 |
| Ankrd33b | 022237 | 227867 | N/A |
| Ankrd33b | 022237 | 076942 | 076209 |
| Ankrd33b | 022237 | 227391 | N/A |
| Anln | 036777 | 040912 | 045873 |
| Anln | 036777 | 215006 | 149721 |
| Anln | 036777 | 217010 | N/A |
| Anln | 036777 | 216897 | N/A |
| Anln | 036777 | 216793 | 149740 |
| Anln | 036777 | 215486 | N/A |
| Ano4 | 035189 | 182462 | 138440 |
| Ano4 | 035189 | 182341 | 138193 |
| Ano4 | 035189 | 182613 | 138268 |
| Ano4 | 035189 | 182790 | 138325 |
| Ano4 | 035189 | 182598 | 138174 |
| Ano4 | 035189 | 182888 | N/A |
| Ano4 | 035189 | 182041 | N/A |
| Ano4 | 035189 | 182419 | 138435 |
| Ano4 | 035189 | 183268 | 138627 |
| Ano4 | 035189 | 181976 | 138792 |
| Ano4 | 035189 | 182624 | 138525 |
| Ano4 | 035189 | 180843 | N/A |
| Ano6 | 064210 | 071874 | 071770 |
| Ano6 | 064210 | 226936 | N/A |
| Ano6 | 064210 | 227791 | 153954 |
| Ano6 | 064210 | 226682 | N/A |
| Ano6 | 064210 | 227151 | 153853 |
| Ano6 | 064210 | 226932 | N/A |
| Ano6 | 064210 | 226793 | 154532 |
| Ano6 | 064210 | 226761 | N/A |
| Aox1 | 063558 | 001027 | 001027 |
| Aox1 | 063558 | 160168 | N/A |
| Apba2 | 030519 | 032732 | 032732 |
| Apba2 | 030519 | 205613 | 146269 |
| Apba2 | 030519 | 205604 | 146279 |
| Apba2 | 030519 | 206246 | 146038 |
| Apba2 | 030519 | 205551 | N/A |
| Apba2 | 030519 | 206061 | N/A |
| Apba2 | 030519 | 206630 | 146108 |
| Apbb2 | 029207 | 162955 | N/A |
| Apbb2 | 029207 | 162366 | 125116 |
| Apbb2 | 029207 | 160870 | 123978 |
| Apbb2 | 029207 | 159512 | 124807 |
| Apbb2 | 029207 | 159786 | 125211 |
| Apbb2 | 029207 | 201776 | N/A |
| Apbb2 | 029207 | 160775 | N/A |
| Apbb2 | 029207 | 162349 | 123752 |
| Apbb2 | 029207 | 160063 | 123778 |
| Apbb2 | 029207 | 161771 | N/A |
| Apbb2 | 029207 | 162401 | N/A |

TABLE 3-continued

| ENSEMBL IDs for rats | | | |
| --- | --- | --- | --- |
| Symbol | MUSG | MUST | MUSP |
| Apbb2 | 029207 | 160185 | N/A |
| Apbb2 | 029207 | 162382 | 124139 |
| Apbb2 | 029207 | 161879 | 125550 |
| Apbb2 | 029207 | 160103 | 123766 |
| Apbb2 | 029207 | 162994 | 125603 |
| Apbb2 | 029207 | 159357 | 124127 |
| Apbb2 | 029207 | 161716 | 124350 |
| Apbb2 | 029207 | 161936 | N/A |
| Apbb2 | 029207 | 159847 | N/A |
| Apbb2 | 029207 | 087256 | 084511 |
| Apcdd1 | 071847 | 096554 | 094302 |
| Apcdd1 | 071847 | 163716 | 125868 |
| Aplp1 | 006651 | 006828 | 006828 |
| Aplp1 | 006651 | 208792 | N/A |
| Aplp1 | 006651 | 208404 | N/A |
| Aplp1 | 006651 | 207514 | N/A |
| Aplp1 | 006651 | 209054 | N/A |
| Apod | 022548 | 130560 | 119827 |
| Apod | 022548 | 115230 | 110885 |
| Apod | 022548 | 023207 | N/A |
| Apod | 022548 | 156456 | N/A |
| Apod | 022548 | 155682 | N/A |
| Apod | 022548 | 145837 | N/A |
| Appl2 | 020263 | 020500 | 020500 |
| Appl2 | 020263 | 177187 | 135157 |
| Appl2 | 020263 | 176675 | 135672 |
| Appl2 | 020263 | 141048 | N/A |
| Appl2 | 020263 | 130285 | N/A |
| Appl2 | 020263 | 148096 | N/A |
| Appl2 | 020263 | 147582 | N/A |
| Appl2 | 020263 | 150351 | N/A |
| Appl2 | 020263 | 127788 | N/A |
| Appl2 | 020263 | 147118 | N/A |
| Appl2 | 020263 | 146876 | 121336 |
| Appl2 | 020263 | 150685 | 115903 |
| Appl2 | 020263 | 133719 | N/A |
| Appl2 | 020263 | 176294 | 135645 |
| Aqp4 | 024411 | 079081 | 078088 |
| Aqp7 | 028427 | 030136 | 030136 |
| Aqp7 | 028427 | 054945 | 093007 |
| Aqp7 | 028427 | 144201 | N/A |
| Aqp7 | 028427 | 149517 | N/A |
| Ar | 046532 | 052837 | 052648 |
| Arhgap10 | 037148 | 076316 | 075658 |
| Arhgap10 | 037148 | 210922 | 147485 |
| Arhgap10 | 037148 | 210519 | 147493 |
| Arhgap15 | 049744 | 055776 | 056461 |
| Arhgap15 | 049744 | 112824 | 108443 |
| Arhgap15 | 049744 | 112822 | 108441 |
| Arhgap15 | 049744 | 140528 | N/A |
| Arhgap15 | 049744 | 128630 | N/A |
| Arhgap20 | 053199 | 130405 | 120124 |
| Arhgap20 | 053199 | 065496 | 065633 |
| Arhgap20 | 053199 | 146509 | N/A |
| Arhgap20 | 053199 | 124907 | N/A |
| Arhgap20 | 053199 | 126567 | N/A |
| Arhgap20 | 053199 | 149754 | N/A |
| Arhgap22 | 063506 | 165792 | 153801 |
| Arhgap22 | 063506 | 111956 | 107587 |
| Arhgap22 | 063506 | 131086 | 154002 |
| Arhgap22 | 063506 | 137590 | N/A |
| Arhgap22 | 063506 | 111955 | 107586 |
| Arhgap22 | 063506 | 140711 | 154670 |
| Arhgap22 | 063506 | 140166 | N/A |
| Arhgap22 | 063506 | 132659 | N/A |
| Arhgap23 | 049807 | 121799 | 112999 |
| Arhgap23 | 049807 | 152933 | N/A |
| Arhgap23 | 049807 | 142465 | 123191 |
| Arhgap23 | 049807 | 093940 | 091472 |
| Arhgap23 | 049807 | 107601 | 103227 |
| Arhgap24 | 057315 | 094559 | 092138 |
| Arhgap24 | 057315 | 126125 | N/A |
| Arhgap24 | 057315 | 112854 | 108475 |
| Arhgap24 | 057315 | 112853 | 108474 |
| Arhgap24 | 057315 | 112852 | 108473 |
| Arhgap24 | 057315 | 130222 | N/A |

TABLE 3-continued

| | ENSEMBL IDs for rats | | |
|---|---|---|---|
| Symbol | MUSG | MUST | MUSP |
| Arhgap24 | 057315 | 070000 | 070048 |
| Arhgap24 | 057315 | 073302 | 073028 |
| Arhgap25 | 030047 | 145128 | N/A |
| Arhgap25 | 030047 | 113637 | 109267 |
| Arhgap25 | 030047 | 101197 | 098758 |
| Arhgap25 | 030047 | 071024 | 068964 |
| Arhgap25 | 030047 | 203559 | N/A |
| Arhgef10l | 040964 | 069623 | 066249 |
| Arhgef10l | 040964 | 097820 | 095431 |
| Arhgef10l | 040964 | 105799 | 101425 |
| Arhgef10l | 040964 | 105798 | 101424 |
| Arhgef10l | 040964 | 105797 | 101423 |
| Arhgef10l | 040964 | 138493 | 119471 |
| Arhgef10l | 040964 | 039204 | 040531 |
| Arhgef10l | 040964 | 154979 | 122667 |
| Arhgef10l | 040964 | 147426 | 123642 |
| Arhgef10l | 040403 | 140403 | 117038 |
| Arhgef10l | 040964 | 125045 | N/A |
| Arhgef10l | 040964 | 143614 | 120437 |
| Arhgef2 | 028059 | 212392 | N/A |
| Arhgef2 | 028059 | 176226 | N/A |
| Arhgef2 | 028059 | 175749 | N/A |
| Arhgef2 | 028059 | 175903 | 135168 |
| Arhgef2 | 028059 | 176514 | N/A |
| Arhgef2 | 028059 | 177023 | 134859 |
| Arhgef2 | 028059 | 176539 | 135612 |
| Arhgef2 | 028059 | 177498 | 134840 |
| Arhgef2 | 028059 | 176500 | 134834 |
| Arhgef2 | 028059 | 175779 | 135177 |
| Arhgef2 | 028059 | 029694 | 029694 |
| Arhgef2 | 028059 | 176804 | 135397 |
| Arhgef2 | 028059 | 177418 | N/A |
| Arhgef2 | 028059 | 107510 | 103134 |
| Arhgef2 | 028059 | 170653 | 127843 |
| Arhgef2 | 028059 | 176401 | N/A |
| Arhgef2 | 028059 | 176400 | N/A |
| Arhgef2 | 028059 | 177303 | 135131 |
| Arhgef2 | 028059 | 176307 | 134843 |
| Arhgef2 | 028059 | 175911 | 135428 |
| Arhgef2 | 028059 | 176243 | 135771 |
| Arhgef2 | 028059 | 176316 | 135808 |
| Arhgef2 | 028059 | 177120 | N/A |
| Arhgef2 | 028059 | 176879 | 134766 |
| Arhgef2 | 028059 | 175745 | 135044 |
| Arhgef2 | 028059 | 176528 | N/A |
| Arhgef2 | 028059 | 176079 | N/A |
| Arhgef2 | 028059 | 176123 | N/A |
| Arhgef2 | 028059 | 177091 | N/A |
| Arhgef2 | 028059 | 176301 | N/A |
| Arhgef2 | 028059 | 177099 | N/A |
| Arhgef2 | 028059 | 176272 | N/A |
| Arhgef26 | 036885 | 079300 | 078281 |
| Arhgef26 | 036885 | 163008 | N/A |
| Arhgef26 | 036885 | 161493 | N/A |
| Arhgef26 | 036885 | 159746 | N/A |
| Arhgef26 | 036885 | 161057 | 124392 |
| Arhgef26 | 036885 | 192138 | N/A |
| Arhgef28 | 021662 | 109426 | 105053 |
| Arhgef28 | 021662 | 225884 | 153423 |
| Arhgef28 | 021662 | 225663 | N/A |
| Arhgef28 | 021662 | 225269 | N/A |
| Arhgef28 | 021662 | 223849 | 153000 |
| Arhgef28 | 021662 | 224926 | N/A |
| Arhgef28 | 021662 | 224866 | 153114 |
| Arhgef33 | 054901 | 223878 | 153224 |
| Arhgef33 | 054901 | 224391 | 153551 |
| Arhgef33 | 054901 | 225018 | N/A |
| Arhgef33 | 054901 | 224631 | N/A |
| Arhgef33 | 054901 | 224676 | N/A |
| Arhgef33 | 054901 | 224002 | N/A |
| Arhgef33 | 054901 | 225658 | 153062 |
| Arhgef33 | 054901 | 224966 | 153018 |
| Arhgef33 | 054901 | 225223 | 153484 |
| Arhgef33 | 054901 | 225548 | 153111 |
| Arhgef33 | 054901 | 226013 | N/A |
| Arhgef33 | 054901 | 068175 | 063284 |

TABLE 3-continued

| | ENSEMBL IDs for rats | | |
|---|---|---|---|
| Symbol | MUSG | MUST | MUSP |
| Arhgef37 | 045094 | 171629 | 130560 |
| Arhgef4 | 037509 | 159747 | 124213 |
| Arhgef4 | 037509 | 162599 | 124906 |
| Arhgef4 | 037509 | 159021 | 124467 |
| Arhgef4 | 037509 | 047664 | 035980 |
| Arhgef4 | 037509 | 162760 | N/A |
| Arhgef4 | 037509 | 159059 | N/A |
| Arhgef4 | 037509 | 160855 | 124213 |
| Ahgef4 | 037509 | 211073 | 148067 |
| Arl4a | 047446 | 101472 | 099013 |
| Arl4a | 047446 | 136441 | 122987 |
| Arl4a | 047446 | 144910 | 122126 |
| Arl4a | 047446 | 138572 | N/A |
| Arl4a | 047446 | 146905 | 114458 |
| Arnt2 | 015709 | 085077 | 082154 |
| Arnt2 | 015709 | 209133 | 147129 |
| Arnt2 | 015709 | 208232 | 146413 |
| Arnt2 | 015709 | 208564 | 146989 |
| Arnt2 | 015709 | 207459 | N/A |
| Arnt2 | 015709 | 208129 | 146614 |
| Arnt2 | 015709 | 208936 | N/A |
| Arnt2 | 015709 | 207759 | N/A |
| Arnt2 | 015709 | 208204 | 146781 |
| Arnt2 | 015709 | 208995 | 146599 |
| Arnt2 | 015709 | 207769 | 146414 |
| Arnt2 | 015709 | 208392 | 146776 |
| Arnt2 | 015709 | 208863 | 146868 |
| Arrb1 | 018909 | 098266 | 095866 |
| Arrb1 | 018909 | 032995 | 032995 |
| Arrb1 | 018909 | 162404 | 124351 |
| Arrb1 | 018909 | 161525 | 124483 |
| Arrb1 | 018909 | 161268 | N/A |
| Arrb1 | 018909 | 162043 | N/A |
| Arrb1 | 018909 | 159642 | N/A |
| Arrb1 | 018909 | 162933 | N/A |
| Arrb1 | 018909 | 162290 | 125056 |
| Arrb1 | 018909 | 179755 | 136963 |
| Arrdc3 | 074794 | 159090 | N/A |
| Arrdc3 | 074794 | 159690 | 124418 |
| Arrdc3 | 074794 | 099356 | 096957 |
| Arrdc3 | 074794 | 161441 | 125455 |
| Arrdc3 | 074794 | 159856 | N/A |
| Arrdc3 | 074794 | 162904 | N/A |
| Arsg | 020604 | 106697 | 102308 |
| Arsg | 020604 | 106696 | 102307 |
| Arsg | 020604 | 152252 | N/A |
| Arsg | 020604 | 136336 | N/A |
| Arsg | 020604 | 020928 | 020928 |
| Arx | 035277 | 187010 | N/A |
| Arx | 035277 | 046565 | 049039 |
| Arx | 035277 | 113947 | 109580 |
| Asap3 | 036995 | 047526 | 041899 |
| Ascl1 | 020052 | 020243 | 020243 |
| Asgr1 | 020884 | 146411 | 121842 |
| Asgr1 | 020884 | 108585 | 104226 |
| Asgr1 | 020884 | 018699 | 018699 |
| Asgr1 | 020884 | 092959 | 090637 |
| Asgr1 | 020884 | 123369 | 137469 |
| Asic1 | 023017 | 023758 | 023758 |
| Asic1 | 023017 | 226291 | N/A |
| Asic1 | 023017 | 228012 | N/A |
| Asic1 | 023017 | 228185 | 154379 |
| Asic1 | 023017 | 228610 | N/A |
| Asic1 | 023017 | 227670 | N/A |
| Asic2 | 020704 | 021045 | 021045 |
| Asic2 | 020704 | 066197 | 067095 |
| Asns | 029752 | 115542 | 111204 |
| Asns | 029752 | 031766 | 031766 |
| Asns | 029752 | 140097 | N/A |
| Asns | 029752 | 133972 | N/A |
| Asns | 029752 | 126303 | 115415 |
| Asns | 029752 | 139596 | 120489 |
| Asns | 029752 | 148349 | 118003 |
| Aspa | 020774 | 021119 | 021119 |
| Aspa | 020774 | 184572 | 139318 |
| Aspa | 020774 | 155630 | 139131 |

TABLE 3-continued

| ENSEMBL IDs for rats | | | |
| --- | --- | --- | --- |
| Symbol | MUSG | MUST | MUSP |
| Aspa | 020774 | 132774 | N/A |
| Aspa | 020774 | 134079 | 121135 |
| Aspa | 020774 | 141898 | 118109 |
| Astn2 | 028373 | 068214 | 065786 |
| Astn2 | 028373 | 084496 | 081540 |
| Atl2 | 059811 | 068282 | 064758 |
| Atl2 | 059811 | 223273 | N/A |
| Atl2 | 059811 | 221286 | N/A |
| Atl2 | 059811 | 222193 | 152340 |
| Atl2 | 059811 | 222415 | 152866 |
| Atl2 | 059811 | 221666 | N/A |
| Atl2 | 059811 | 222243 | N/A |
| Atl2 | 059811 | 112437 | 108056 |
| Atl3 | 024759 | 170373 | 132619 |
| Atl3 | 024759 | 025668 | 025668 |
| Atp13a4 | 038094 | 182573 | 138700 |
| Atp13a4 | 038094 | 182627 | 138479 |
| Atp13a4 | 038094 | 057018 | 060987 |
| Atp13a4 | 038094 | 182676 | N/A |
| Atp13a4 | 038094 | 182013 | 138583 |
| Atp13a4 | 038094 | 182094 | N/A |
| Atp13a4 | 038094 | 182357 | N/A |
| Atp13a4 | 038094 | 182168 | 138515 |
| Atp13a4 | 038094 | 039090 | 048753 |
| Atp13a4 | 038094 | 182824 | N/A |
| Atp13a4 | 038094 | 182694 | N/A |
| Atp1a1 | 033161 | 036493 | 039657 |
| Atp1a1 | 033161 | 130649 | N/A |
| Atp1a1 | 033161 | 136340 | N/A |
| Atp1a2 | 007097 | 085913 | 083077 |
| Atp1a2 | 007097 | 131751 | N/A |
| Atp1a2 | 007097 | 191781 | N/A |
| Atp1a2 | 007464 | 097464 | 095072 |
| Atp1a2 | 007097 | 137679 | N/A |
| Atp1a3 | 040907 | 102858 | 099922 |
| Atp1a3 | 040907 | 080882 | 079691 |
| Atp1a3 | 040907 | 196684 | 143735 |
| Atp1a3 | 040907 | 146595 | N/A |
| Atp1a3 | 040907 | 125444 | N/A |
| Atp1b1 | 026576 | 027863 | 027863 |
| Atp1b1 | 026576 | 193980 | N/A |
| Atp1b1 | 026576 | 193367 | 141777 |
| Atp1b1 | 026576 | 192522 | N/A |
| Atp1b2 | 041329 | 047889 | 047353 |
| Atp1b2 | 041329 | 130394 | N/A |
| Atp1b2 | 041329 | 138694 | 116290 |
| Atp1b2 | 041329 | 144425 | N/A |
| Atp1b2 | 041329 | 153198 | N/A |
| Atp2a3 | 020788 | 108486 | 104126 |
| Atp2a3 | 020788 | 108484 | 104124 |
| Atp2a3 | 020788 | 149493 | N/A |
| Atp2a3 | 020788 | 135234 | N/A |
| Atp2a3 | 020788 | 163326 | 127036 |
| Atp2a3 | 020785 | 108485 | 104125 |
| Atp2a3 | 020788 | 021142 | 021142 |
| Atp2b2 | 030302 | 101045 | 098606 |
| Atp2b2 | 030302 | 089003 | 086398 |
| Atp2b2 | 030302 | 152831 | 138165 |
| Atp2b2 | 030302 | 205052 | 145174 |
| Atp2b2 | 030302 | 101044 | 098605 |
| Atp2b2 | 030302 | 135199 | N/A |
| Atp2b2 | 030302 | 144507 | N/A |
| Atp2b2 | 030302 | 154738 | N/A |
| Atp2b3 | 031376 | 033744 | 033744 |
| Atp2b3 | 031376 | 088429 | 085775 |
| Atp2b3 | 031376 | 114479 | 110123 |
| Atp8a1 | 037685 | 135930 | 118379 |
| Atp8a1 | 037685 | 037380 | 042215 |
| Atp8a1 | 037685 | 072971 | 072738 |
| Atp8a1 | 037685 | 200955 | 144465 |
| Atp8a1 | 037685 | 149501 | N/A |
| Atp8a1 | 037685 | 155911 | N/A |
| Atp8a1 | 037685 | 152433 | N/A |
| Atp8a1 | 037685 | 130652 | N/A |
| Atp8a1 | 037685 | 113652 | 109282 |
| Atp8a1 | 037685 | 113651 | 109281 |

TABLE 3-continued

| ENSEMBL IDs for rats | | | |
| --- | --- | --- | --- |
| Symbol | MUSG | MUST | MUSP |
| Atp8a1 | 037685 | 143013 | N/A |
| Atp8a1 | 037685 | 202248 | N/A |
| Atp8a1 | 037685 | 128726 | N/A |
| Atp8a1 | 037685 | 141443 | 121630 |
| Atp8b1 | 039529 | 025482 | 025482 |
| Atrnl1 | 054843 | 077282 | 076514 |
| Atxn1 | 046876 | 091628 | 089217 |
| Atxn1 | 046876 | 167708 | 129890 |
| Atxn1 | 046876 | 180110 | 137439 |
| Atxn1 | 046876 | 221082 | N/A |
| Atxn1 | 046876 | 222943 | N/A |
| Atxn1 | 046876 | 222610 | N/A |
| Axl | 002602 | 002677 | 002677 |
| Axl | 002602 | 085948 | 083110 |
| Axl | 002602 | 124442 | N/A |
| Axl | 002602 | 137211 | N/A |
| Axl | 002602 | 132989 | N/A |
| Axl | 002602 | 132038 | 114907 |
| Axl | 002602 | 147680 | N/A |
| Axl | 002602 | 137383 | N/A |
| B230209E15Rik | 109006 | 209115 | N/A |
| B230209E15Rik | 109006 | 211785 | N/A |
| B3gat2 | 026156 | 144602 | 115870 |
| B3gat2 | 026156 | 063663 | 066582 |
| B3gat2 | 026156 | 140583 | 117089 |
| B3glct | 051950 | 100404 | 097972 |
| B3glct | 051950 | 202302 | N/A |
| B3glct | 051950 | 201088 | N/A |
| B3gnt5 | 022686 | 121344 | 112624 |
| B3gnt5 | 022686 | 079780 | 078712 |
| B3gnt5 | 022686 | 152845 | N/A |
| B3gnt5 | 022686 | 131557 | N/A |
| B3gnt5 | 022686 | 155780 | N/A |
| B3gnt5 | 022686 | 119468 | 113145 |
| B3gnt5 | 022686 | 161397 | 126157 |
| B3gnt7 | 079445 | 189618 | N/A |
| B3gnt7 | 079445 | 113306 | 108931 |
| B3gnt7 | 079445 | 188695 | 140392 |
| B4galt6 | 056124 | 070080 | 066515 |
| Bach2 | 040270 | 108180 | 103815 |
| Bach2 | 040270 | 037416 | 043693 |
| Bach2 | 040270 | 149201 | N/A |
| Bach2 | 040270 | 156430 | N/A |
| Bach2 | 040270 | 146748 | N/A |
| Bach2 | 040270 | 125263 | N/A |
| Bach2 | 040270 | 171600 | 131592 |
| Baiap2 | 025372 | 026436 | 026436 |
| Baiap2 | 025372 | 106231 | 101838 |
| Baiap2 | 025372 | 075180 | 074674 |
| Baiap2 | 025372 | 103021 | 099310 |
| Baiap2 | 025372 | 106233 | 101840 |
| Baiap2 | 025372 | 146566 | N/A |
| Baiap2 | 025372 | 146960 | N/A |
| Baiap2 | 025372 | 152523 | N/A |
| Baiap2 | 025372 | 131580 | N/A |
| Barhl2 | 034384 | 086795 | 084005 |
| Basp1 | 045763 | 058845 | 053943 |
| Basp1 | 045763 | 228597 | 154675 |
| Bbs2 | 031755 | 034206 | 034206 |
| Bbs2 | 031755 | 170208 | N/A |
| Bbs2 | 031755 | 172347 | N/A |
| BC052040 | 040282 | 110918 | 106543 |
| BC052040 | 040282 | 147968 | N/A |
| BC052040 | 040282 | 166472 | 126772 |
| Bcar1 | 031955 | 166232 | 129584 |
| Bcar1 | 031955 | 212349 | 148364 |
| Bcar1 | 031955 | 212147 | N/A |
| Bche | 027792 | 029367 | 029367 |
| Bche | 027792 | 133690 | N/A |
| Bche | 027792 | 138216 | 141329 |
| Bche | 027792 | 153917 | N/A |
| Bcl11a | 000861 | 118955 | 112948 |
| Bcl11a | 000861 | 127494 | N/A |
| Bcl11a | 000861 | 000881 | 000881 |
| Bcl11a | 000861 | 124148 | N/A |
| Bcl11a | 000861 | 109516 | 105142 |

TABLE 3-continued

| ENSEMBL IDs for rats | | | |
| --- | --- | --- | --- |
| Symbol | MUSG | MUST | MUSP |
| Bcl11a | 000861 | 109514 | 105140 |
| Bcl11b | 048251 | 066060 | 068258 |
| Bcl11b | 048251 | 109887 | 105513 |
| Bcl11b | 048251 | 109891 | 105517 |
| Bcl11b | 048251 | 066060 | 068258 |
| Bcl11b | 048251 | 109887 | 105513 |
| Bcl11b | 048251 | 109891 | 105517 |
| Bean1 | 031872 | 164076 | 132056 |
| Bean1 | 031872 | 093245 | 090931 |
| Bean1 | 031872 | 212979 | 148571 |
| Bean1 | 031872 | 213077 | 148283 |
| Bean1 | 031872 | 171018 | 129403 |
| Bean1 | 031872 | 167633 | 131530 |
| Bhlhe22 | 025128 | 026120 | 026120 |
| Bicd1 | 003452 | 203502 | N/A |
| Bicd1 | 003452 | 086829 | 084039 |
| Bicd1 | 003452 | 111513 | 107138 |
| Bicd1 | 003452 | 130270 | N/A |
| Bicd1 | 003452 | 003544 | 003544 |
| Bicd1 | 003452 | 173408 | 133727 |
| Bicd1 | 003452 | 174886 | N/A |
| Bicd1 | 003452 | 172926 | 133986 |
| Bicd1 | 003452 | 140759 | N/A |
| Bicd2 | 037933 | 048544 | 039394 |
| Bicd2 | 037933 | 110084 | 105711 |
| Bicd2 | 037933 | 110085 | 105712 |
| Bicd2 | 037933 | 220723 | 152090 |
| Blm | 030528 | 206901 | 146062 |
| Blm | 030528 | 081314 | 080062 |
| Blm | 030528 | 170315 | 127995 |
| Blm | 030528 | 206518 | N/A |
| Blm | 030528 | 206948 | N/A |
| Blm | 030528 | 206989 | 146098 |
| Blm | 030528 | 205730 | 145573 |
| Blm | 030528 | 205263 | N/A |
| Blm | 030528 | 205713 | N/A |
| Blm | 030528 | 205584 | N/A |
| Bmp2k | 034663 | 112974 | 108598 |
| Bmp2k | 034663 | 035635 | 037970 |
| Bnc2 | 028487 | 102820 | 099884 |
| Bnc2 | 028487 | 107198 | 102816 |
| Bnc2 | 028487 | 176612 | 135778 |
| Bnc2 | 028487 | 176971 | 135607 |
| Bnc2 | 028487 | 176691 | 135375 |
| Bnc2 | 028487 | 177277 | 135580 |
| Bnc2 | 028487 | 176702 | 134774 |
| Bnc2 | 028487 | 176998 | 135283 |
| Bnc2 | 028487 | 176601 | 135480 |
| Bnc2 | 028487 | 175800 | 134795 |
| Bnc2 | 028487 | 176418 | 135569 |
| Bnc2 | 028487 | 175757 | N/A |
| Bnc2 | 028487 | 176947 | 135411 |
| Bnc2 | 028487 | 175969 | 135656 |
| Bnc2 | 028487 | 176476 | N/A |
| Bnc2 | 028487 | 123276 | N/A |
| Bnc2 | 028487 | 176346 | 134942 |
| Bnc2 | 028487 | 177256 | N/A |
| Bnc2 | 028487 | 175756 | 135499 |
| Bnc2 | 028487 | 177040 | 135089 |
| Bnc2 | 028487 | 176264 | N/A |
| Bnc2 | 028487 | 176370 | 134953 |
| Boc | 022687 | 114634 | 110281 |
| Brinp2 | 004031 | 195271 | 141709 |
| Brinp2 | 004031 | 004133 | 004133 |
| Brinp2 | 004031 | 194578 | N/A |
| Brinp2 | 004031 | 192709 | N/A |
| Brinp3 | 035131 | 074622 | 074201 |
| Brinp3 | 035131 | 132847 | 118552 |
| Brinp3 | 035131 | 128345 | 116763 |
| Brinp3 | 035131 | 125331 | N/A |
| Brinp3 | 035131 | 166814 | 126074 |
| Bsg | 023175 | 179781 | 136487 |
| Bsg | 023175 | 067036 | 070751 |
| Bsg | 023175 | 179201 | N/A |
| Bsg | 023175 | 178383 | 137126 |
| Bsg | 023175 | 105381 | 101020 |

TABLE 3-continued

| ENSEMBL IDs for rats | | | |
| --- | --- | --- | --- |
| Symbol | MUSG | MUST | MUSP |
| Bsg | 023175 | 180235 | N/A |
| Bsn | 032589 | 035208 | 035208 |
| Bsn | 032589 | 124763 | 139053 |
| Btbd1 | 025103 | 026093 | 026093 |
| Btbd1 | 025103 | 208114 | N/A |
| Btbd1 | 025103 | 208178 | N/A |
| Btbd1 | 025103 | 208566 | N/A |
| Btbd11 | 020042 | 105307 | 100944 |
| Btbd11 | 020042 | 020231 | 020231 |
| Btbd11 | 020042 | 105306 | 100943 |
| Btbd11 | 020042 | 135235 | N/A |
| Btbd11 | 020042 | 145323 | N/A |
| Btbd11 | 020042 | 128338 | N/A |
| Btbd11 | 020042 | 156123 | N/A |
| Btbd11 | 020042 | 145433 | N/A |
| Btbd17 | 000202 | 156053 | N/A |
| Btbd17 | 000202 | 000206 | 000206 |
| Btbd17 | 000202 | 156192 | N/A |
| Btbd17 | 000202 | 141481 | N/A |
| Btbd17 | 000202 | 146853 | N/A |
| Btbd17 | 000202 | 141386 | N/A |
| Btbd17 | 000202 | 137965 | N/A |
| 2410131K14Rik | 032840 | 049138 | 043410 |
| 3632451O06Rik | 036242 | 036972 | 036220 |
| 3632451O06Rik | 036242 | 118129 | 113609 |
| 3632451O06Rik | 036242 | 177321 | N/A |
| 1700025G04Rik | 032666 | 187603 | 140950 |
| 1700025G04Rik | 032666 | 044581 | 036406 |
| 1700025G04Rik | 032666 | 128433 | N/A |
| 1700025G04Rik | 032666 | 121533 | 113971 |
| C1ql1 | 045532 | 057849 | 050469 |
| C1ql2 | 036907 | 037286 | 037257 |
| C1qtnf4 | 040794 | 111466 | 107091 |
| C1qtnf4 | 110961 | 214937 | 150588 |
| 2810459M11Rik | 026227 | 027429 | 027429 |
| 2810459M11Rik | 026227 | 165824 | 131459 |
| C3 | 024164 | 024988 | 024988 |
| C3 | 024164 | 177425 | 135663 |
| C3 | 024164 | 177046 | 135560 |
| C3 | 024164 | 176457 | N/A |
| A830018L16Rik | 057715 | 048613 | 043857 |
| A830018L16Rik | 057715 | 150870 | N/A |
| A830018L16Rik | 057715 | 142117 | N/A |
| A830018L16Rik | 057715 | 141512 | 139635 |
| A830018L16Rik | 057715 | 135014 | 119143 |
| A830018L16Rik | 057715 | 137824 | 117421 |
| A830018L16Rik | 057715 | 179089 | 137287 |
| A830018L16Rik | 057715 | 141339 | 121311 |
| A830018L16Rik | 057715 | 191437 | N/A |
| A830018L16Rik | 057715 | 171690 | 132334 |
| 3110035E14Rik | 067879 | 088666 | 086041 |
| 3110043O21Rik | 028300 | 084724 | 081775 |
| 3110043O21Rik | 028300 | 108126 | 103761 |
| 3110043O21Rik | 028300 | 108127 | 103762 |
| 3110043O21Rik | 028300 | 142628 | N/A |
| 3110043O21Rik | 028300 | 156472 | N/A |
| 3110043O21Rik | 028300 | 130538 | N/A |
| 3110043O21Rik | 028300 | 149138 | N/A |
| Cab39l | 021981 | 225149 | N/A |
| Cab39l | 021981 | 224281 | N/A |
| Cab39l | 021981 | 022553 | 022553 |
| Cab39l | 021981 | 225595 | 153643 |
| Cab39l | 021981 | 223678 | 153281 |
| Cab39l | 021981 | 224893 | 153449 |
| Abl1 | 026842 | 146537 | N/A |
| Abl1 | 026842 | 156736 | N/A |
| Abl1 | 026842 | 075759 | 075167 |
| Abl1 | 026842 | 142554 | 142123 |
| Abl1 | 026842 | 123471 | 142297 |
| Abl1 | 026842 | 135233 | 141320 |
| Abl1 | 026842 | 028190 | 028190 |
| Abl1 | 026842 | 124089 | 117748 |
| Abl1 | 026842 | 127714 | N/A |
| Abl1 | 026842 | 124726 | N/A |
| Cables1 | 040957 | 171109 | 129463 |
| Cables1 | 040957 | 046948 | 040639 |

TABLE 3-continued

| ENSEMBL IDs for rats | | | |
| --- | --- | --- | --- |
| Symbol | MUSG | MUST | MUSP |
| Cables1 | 040957 | 225430 | N/A |
| Cabp1 | 029544 | 031519 | 031519 |
| Cabp1 | 029544 | 112113 | 107741 |
| Cabp1 | 029544 | 112109 | N/A |
| Cabp1 | 029544 | 112112 | 107740 |
| Cabp1 | 029544 | 145197 | 138183 |
| Cabp1 | 029544 | 151775 | N/A |
| Cabp1 | 029544 | 201900 | N/A |
| Cachd1 | 028532 | 030257 | 030257 |
| Cachd1 | 028532 | 097955 | 095568 |
| Cachd1 | 028532 | 123475 | N/A |
| Cachd1 | 028532 | 136430 | N/A |
| Cacna1a | 034656 | 135382 | N/A |
| Cacna1a | 034656 | 121390 | 112436 |
| Cacna1a | 034656 | 122053 | 114055 |
| Cacna1a | 034656 | 215756 | 149242 |
| Cacna1a | 034656 | 129620 | N/A |
| Cacna1a | 034656 | 126302 | N/A |
| Cacna1a | 034656 | 143215 | N/A |
| Cacna1a | 034656 | 141981 | N/A |
| Cacna1a | 034656 | 144879 | N/A |
| Cacna1a | 034656 | 153691 | N/A |
| Cacna1a | 034656 | 130507 | N/A |
| Cacna1b | 004113 | 070864 | 063236 |
| Cacna1b | 004113 | 102939 | 100003 |
| Cacna1b | 004113 | 131861 | 141653 |
| Cacna1b | 004113 | 041342 | 037416 |
| Cacna1b | 004113 | 114447 | 110090 |
| Cacna1b | 004113 | 133892 | 115285 |
| Cacna1b | 004113 | 125798 | 141767 |
| Cacna1b | 004113 | 155356 | 116674 |
| Cacna1b | 004113 | 124183 | 114605 |
| Cacna1b | 004113 | 100348 | 097920 |
| Cacna1e | 004110 | 187541 | 140937 |
| Cacna1e | 004110 | 211821 | 148507 |
| Cacna1e | 004110 | 226546 | 153897 |
| Cacna1e | 004110 | 188384 | N/A |
| Cacna1e | 004110 | 188965 | N/A |
| Cacna1e | 004110 | 188321 | N/A |
| Cacna1e | 004110 | 186256 | N/A |
| Cacna1e | 004110 | 004214 | 004214 |
| Cacna1g | 020866 | 107786 | 103415 |
| Cacna1g | 020866 | 107791 | 103420 |
| Cacna1g | 020866 | 103166 | 099455 |
| Cacna1g | 020866 | 107792 | 103421 |
| Cacna1g | 020866 | 100561 | 098127 |
| Cacna1g | 020866 | 107793 | 103422 |
| Cacna1g | 020866 | 107788 | 103417 |
| Cacna1g | 020866 | 107790 | 103419 |
| Cacna1g | 020866 | 107789 | 103418 |
| Cacna1g | 020866 | 107785 | 103414 |
| Cacna1g | 020866 | 133331 | N/A |
| Cacna1g | 020866 | 146160 | N/A |
| Cacna1g | 020866 | 142190 | N/A |
| Cacna1g | 020866 | 133000 | N/A |
| Cacna1g | 020866 | 152811 | N/A |
| Cacna1g | 020866 | 021234 | 021234 |
| Cacna2d1 | 040118 | 101581 | 099117 |
| Cacna2d1 | 040118 | 039370 | 049457 |
| Cacna2d1 | 040118 | 199704 | 142881 |
| Cacna2d1 | 040118 | 180204 | 136260 |
| Cacna2d1 | 040118 | 078272 | 077391 |
| Cacna2d1 | 040118 | 196750 | 143082 |
| Cacna2d1 | 040118 | 200270 | N/A |
| Cacna2d1 | 040118 | 200158 | N/A |
| Cacna2d1 | 040118 | 200294 | N/A |
| Cacna2d1 | 040118 | 199236 | N/A |
| Cacna2d1 | 040118 | 115281 | 110936 |
| Cacna2d1 | 040118 | 167946 | 131507 |
| Cacna2d2 | 010066 | 010210 | 010210 |
| Cacna2d2 | 010066 | 168532 | 132512 |
| Cacna2d2 | 010066 | 085092 | 082173 |
| Cacna2d2 | 010066 | 166799 | 126029 |
| Cacna2d2 | 010066 | 170737 | 125943 |
| Cacna2d2 | 010066 | 169354 | N/A |
| Cacna2d2 | 010066 | 171809 | N/A |

TABLE 3-continued

| ENSEMBL IDs for rats | | | |
| --- | --- | --- | --- |
| Symbol | MUSG | MUST | MUSP |
| Cacna2d2 | 010066 | 194842 | N/A |
| Cacna2d2 | 010066 | 168959 | N/A |
| Cacna2d2 | 010066 | 164988 | 130451 |
| Cacna2d3 | 021991 | 022567 | 022567 |
| Cacna2d3 | 021991 | 225985 | 152967 |
| Cacna2d3 | 021991 | 225668 | 153037 |
| Cacna2d3 | 021991 | 225733 | 153143 |
| Cacna2d3 | 021991 | 225863 | 153444 |
| Cacna2d3 | 021991 | 224950 | N/A |
| Cacna2d3 | 021991 | 226048 | N/A |
| Cacna2d3 | 021991 | 225953 | N/A |
| Cacna2d3 | 021991 | 224128 | N/A |
| Cacnb4 | 017412 | 102760 | 099821 |
| Cacnb4 | 017412 | 102761 | 099822 |
| Cacnb4 | 017412 | 078324 | 077438 |
| Cacnb4 | 017412 | 132322 | N/A |
| Cacnb4 | 017412 | 148837 | N/A |
| Cacnb4 | 017412 | 178799 | 136811 |
| Cacng3 | 066189 | 084615 | 081664 |
| Cacng3 | 066189 | 182563 | 138495 |
| Cacng3 | 066189 | 182095 | 138755 |
| Cacng4 | 020723 | 021066 | 021066 |
| Cacng4 | 020723 | 134076 | N/A |
| Cacng5 | 040373 | 039071 | 047888 |
| Cacng5 | 040373 | 106742 | 102353 |
| Cadm3 | 005338 | 111220 | 106851 |
| Cadm3 | 005338 | 005470 | 005470 |
| Cadm3 | 005338 | 136540 | N/A |
| Cadm3 | 005338 | 157032 | N/A |
| Cadm3 | 005338 | 126963 | N/A |
| Cadps2 | 017978 | 115358 | 111015 |
| Cadps2 | 017978 | 018122 | 018122 |
| Cadps2 | 017978 | 142913 | 138167 |
| Cadps2 | 017978 | 115361 | 111018 |
| Cadps2 | 017978 | 156986 | N/A |
| Cadps2 | 017978 | 125350 | 115866 |
| Cadps2 | 017978 | 069074 | 064876 |
| Cadps2 | 017978 | 152131 | N/A |
| Cadps2 | 017978 | 115356 | 111013 |
| Cadps2 | 017978 | 136279 | N/A |
| Cadps2 | 017978 | 115355 | N/A |
| Cadps2 | 017978 | 166458 | 125972 |
| Cadps2 | 017978 | 163871 | 128905 |
| Calb1 | 028222 | 029876 | 029876 |
| Calb1 | 028222 | 136266 | N/A |
| Calb1 | 028222 | 141336 | N/A |
| Calb2 | 003657 | 212297 | 148680 |
| Calb2 | 003657 | 003754 | 003754 |
| Caln1 | 060371 | 086029 | 083193 |
| Caln1 | 060371 | 202728 | 143823 |
| Caln1 | 060371 | 141131 | 144225 |
| Caln1 | 060371 | 111287 | 106918 |
| Caln1 | 060371 | 111288 | 106919 |
| Camk1g | 016179 | 169907 | 128143 |
| Camk1g | 016179 | 016323 | 016323 |
| Camk1g | 016179 | 163202 | 131451 |
| Camk1g | 016179 | 165718 | N/A |
| Camk2a | 024617 | 102888 | 099952 |
| Camk2a | 024617 | 134496 | N/A |
| Camk2a | 024617 | 025519 | 025519 |
| Camk2a | 024617 | 115297 | 110952 |
| Camk2a | 024617 | 137805 | 123480 |
| Camk2a | 024617 | 115295 | 110950 |
| Camk2a | 024617 | 039904 | 048325 |
| Camk2g | 021820 | 100837 | 098398 |
| Camk2g | 021820 | 071816 | 071720 |
| Camk2g | 021820 | 080440 | 079298 |
| Camk2g | 021820 | 223863 | 153007 |
| Camk2g | 021820 | 226630 | 154158 |
| Camk2g | 021820 | 225328 | 152992 |
| Camk2g | 021820 | 224887 | 153165 |
| Camk2g | 021820 | 223712 | 153471 |
| Camk2g | 021820 | 225609 | 152903 |
| Camk2g | 021820 | 225463 | 153453 |
| Camk2g | 021820 | 225660 | N/A |
| Camk2g | 021820 | 225958 | N/A |

TABLE 3-continued

| ENSEMBL IDs for rats | | | |
|---|---|---|---|
| Symbol | MUSG | MUST | MUSP |
| Camk2g | 021820 | 224245 | N/A |
| Camk2g | 021820 | 225800 | N/A |
| Camk2g | 021820 | 224566 | N/A |
| Camk2g | 021820 | 224804 | N/A |
| Camk2g | 021820 | 225635 | N/A |
| Camk4 | 038128 | 042868 | 046539 |
| Camkv | 032936 | 035700 | 040430 |
| Camkv | 032936 | 192318 | N/A |
| Camkv | 032936 | 193533 | 141347 |
| Camkv | 032936 | 195219 | 142005 |
| Camkv | 032936 | 194206 | 141444 |
| Cap2 | 021373 | 021802 | 021802 |
| Cap2 | 021373 | 119341 | 112952 |
| Cap2 | 021373 | 225824 | 153125 |
| Cap2 | 021373 | 225444 | N/A |
| Cap2 | 021373 | 126687 | 153072 |
| Capn5 | 035547 | 040971 | 048183 |
| Capn5 | 035547 | 107112 | 102729 |
| Capn5 | 035547 | 134638 | N/A |
| Capn5 | 035547 | 155056 | 116697 |
| Capn5 | 035547 | 129430 | 121200 |
| Capzb | 028745 | 102508 | 099566 |
| Capzb | 028745 | 131912 | 114973 |
| Capzb | 028745 | 102507 | 099565 |
| Capzb | 028745 | 131793 | N/A |
| Capzb | 028745 | 150077 | N/A |
| Capzb | 028745 | 030518 | 030518 |
| Capzb | 028745 | 156760 | N/A |
| Capzb | 028745 | 145368 | 119252 |
| Capzb | 028745 | 138045 | 122077 |
| Capzb | 028745 | 042675 | 038011 |
| Capzb | 028745 | 132385 | N/A |
| Car12 | 032373 | 071889 | 071786 |
| Car12 | 032373 | 152011 | N/A |
| Car12 | 032373 | 123195 | N/A |
| Car12 | 032373 | 217394 | N/A |
| Car12 | 032373 | 085420 | 082541 |
| Car12 | 032373 | 134829 | 118030 |
| Car14 | 038526 | 036181 | 036983 |
| Car14 | 038526 | 147962 | 117464 |
| Car14 | 038526 | 149202 | N/A |
| Car14 | 038526 | 126722 | N/A |
| Car2 | 027562 | 192609 | 141876 |
| Car2 | 027562 | 029078 | 029078 |
| Car2 | 027562 | 195520 | N/A |
| Car4 | 000805 | 139416 | N/A |
| Car4 | 000805 | 103194 | 099483 |
| Car4 | 000805 | 138331 | N/A |
| Car4 | 000805 | 150596 | 121381 |
| Car4 | 000805 | 127827 | 115878 |
| Car4 | 000805 | 108076 | 103711 |
| Car7 | 031883 | 212942 | N/A |
| Car7 | 031883 | 159416 | 125112 |
| Car7 | 031883 | 056051 | 052136 |
| Car7 | 031883 | 162761 | 125404 |
| Car7 | 031883 | 162399 | N/A |
| Car8 | 041261 | 066674 | 063511 |
| Carmil1 | 021338 | 125901 | 126522 |
| Carmil1 | 021338 | 151566 | 120971 |
| Carmil1 | 021338 | 072889 | 072662 |
| Carmil1 | 021338 | 110398 | 106028 |
| Carmil1 | 021338 | 147261 | N/A |
| Carmil1 | 021338 | 142171 | N/A |
| Carmil1 | 021338 | 128416 | N/A |
| Carmil1 | 021338 | 125420 | N/A |
| Carmil1 | 021338 | 144159 | N/A |
| Carmil1 | 021338 | 140042 | 127121 |
| Carmil1 | 021338 | 123076 | 130100 |
| Carmil1 | 021338 | 136517 | N/A |
| Carns1 | 075289 | 167055 | 131624 |
| Casp12 | 025887 | 027009 | 027009 |
| Casp12 | 025887 | 151788 | 121565 |
| Casp12 | 025887 | 149520 | N/A |
| Casp12 | 025887 | 138308 | N/A |
| Casp12 | 025887 | 151332 | 122201 |
| Casq2 | 027861 | 029454 | 029454 |

TABLE 3-continued

| ENSEMBL IDs for rats | | | |
|---|---|---|---|
| Symbol | MUSG | MUST | MUSP |
| Casq2 | 027861 | 165540 | 130482 |
| Casq2 | 027861 | 164123 | 131232 |
| Casq2 | 027861 | 159521 | N/A |
| Casq2 | 027861 | 159833 | N/A |
| Cav1 | 007655 | 007799 | 007799 |
| Cav1 | 007655 | 115456 | 111116 |
| Cav1 | 007655 | 115455 | 111115 |
| Cav1 | 007655 | 130505 | N/A |
| Cav1 | 007655 | 177234 | 135875 |
| Cav1 | 007655 | 150901 | 135374 |
| Cav1 | 007655 | 123439 | 120252 |
| Cav1 | 007655 | 115454 | 111114 |
| Cav1 | 007655 | 115453 | 111113 |
| Cav1 | 007655 | 133065 | N/A |
| Cav2 | 000058 | 000058 | 000058 |
| Cav2 | 000058 | 115459 | 111119 |
| Cav2 | 000058 | 115462 | 111122 |
| Cbfb | 031885 | 052209 | 059382 |
| Cbfb | 031885 | 109392 | 105019 |
| Cbfb | 031885 | 109395 | 105022 |
| Cbfb | 031885 | 109394 | 105021 |
| Cbfb | 031885 | 186070 | N/A |
| Cbfb | 031885 | 190915 | N/A |
| Cbfb | 031885 | 187323 | N/A |
| Cbln1 | 031654 | 034076 | 034076 |
| Cbln1 | 031654 | 211279 | N/A |
| Cbln1 | 031654 | 169693 | 126575 |
| Cbln2 | 024647 | 068423 | 068863 |
| Cbln2 | 024647 | 122464 | 113996 |
| Cbln2 | 024647 | 122079 | 113695 |
| Cbln2 | 024647 | 169470 | 126810 |
| Cbln3 | 040380 | 063871 | 070494 |
| Cbln3 | 040380 | 172378 | 127798 |
| Ccdc13 | 079235 | 135986 | 114787 |
| Ccdc13 | 079235 | 155511 | 128061 |
| Ccdc13 | 079235 | 126851 | N/A |
| Ccdc13 | 079235 | 142783 | 130887 |
| Ccdc13 | 079235 | 140929 | N/A |
| Ccdc13 | 079235 | 146716 | N/A |
| Ccdc152 | 091119 | 226261 | 153730 |
| Ccdc152 | 091119 | 228405 | 153740 |
| Ccdc152 | 091119 | 165386 | 129305 |
| Ccdc175 | 021086 | 021494 | 021494 |
| Ccdc180 | 035539 | 127261 | N/A |
| Ccdc180 | 035539 | 149903 | 119784 |
| Ccdc180 | 035539 | 151024 | 122332 |
| Ccdc180 | 035539 | 178561 | 136714 |
| Ccdc80 | 022665 | 139509 | N/A |
| Ccdc80 | 022665 | 138048 | N/A |
| Ccdc80 | 022665 | 155800 | N/A |
| Ccdc80 | 022665 | 099498 | 097097 |
| Ccdc80 | 022665 | 134924 | N/A |
| Ccdc80 | 022665 | 061050 | 058752 |
| Ccdc85a | 032878 | 160016 | 125648 |
| Ccdc85a | 032878 | 140601 | 124184 |
| Ccdc85a | 032878 | 093253 | 090941 |
| Ccdc85a | 032878 | 146385 | 124972 |
| Ccdc85a | 032878 | 042534 | 044649 |
| Ccdc85a | 032878 | 109501 | N/A |
| Ccdc85a | 032878 | 109502 | 105128 |
| Ccdc88a | 032740 | 040182 | 048978 |
| Ccdc88a | 032740 | 123561 | 119173 |
| Ccdc88a | 032740 | 155854 | 115117 |
| Ccdc88a | 032740 | 140194 | 114942 |
| Ccdc88a | 032740 | 137227 | N/A |
| Ccdc88a | 032740 | 144450 | N/A |
| Ccdc88a | 032740 | 109477 | 105103 |
| Cck | 032532 | 216176 | 149163 |
| Cck | 032532 | 216138 | 150080 |
| Cck | 032532 | 035120 | 035120 |
| Cck | 032532 | 215228 | 149679 |
| Cck | 032532 | 213106 | 149410 |
| Cck | 032532 | 217581 | 150557 |
| Cckbr | 030898 | 033189 | 033189 |
| Cckbr | 030898 | 181339 | 138052 |
| Ccnd1 | 070348 | 093962 | 091495 |

TABLE 3-continued

| ENSEMBL IDs for rats | | | |
|---|---|---|---|
| Symbol | MUSG | MUST | MUSP |
| Ccnd1 | 070348 | 208193 | N/A |
| Ccnd1 | 070348 | 135985 | N/A |
| Ccnd2 | 000184 | 000188 | 000188 |
| Ccnd2 | 000184 | 201564 | N/A |
| Ccnd2 | 000184 | 201985 | N/A |
| Ccnd2 | 000184 | 201902 | 144006 |
| Ccnd2 | 000184 | 202363 | N/A |
| Ccnd2 | 000184 | 201066 | 144095 |
| Ccnd2 | 000184 | 201637 | 144245 |
| Ccnd2 | 000184 | 201857 | N/A |
| Cd70 | 019489 | 019633 | 019633 |
| Cd82 | 027215 | 099696 | 097287 |
| Cd82 | 027215 | 028644 | 028644 |
| Cd82 | 027215 | 126772 | N/A |
| Cd82 | 027215 | 111257 | 106888 |
| Cd82 | 027215 | 123565 | 114762 |
| Cd82 | 027215 | 145553 | 115310 |
| Cd82 | 027215 | 150508 | 120183 |
| Cd82 | 027215 | 111256 | 106887 |
| Cd82 | 027215 | 144168 | N/A |
| Cd82 | 027215 | 124804 | 115349 |
| Cd82 | 027215 | 116457 | 112158 |
| Cd9 | 030342 | 032492 | 032492 |
| Cd9 | 030342 | 130132 | N/A |
| Cd9 | 030342 | 140024 | N/A |
| Cdc14b | 033102 | 221634 | 152388 |
| Cdc14b | 033102 | 039318 | 046003 |
| Cdc14b | 033102 | 221139 | 152843 |
| Cdc14b | 033102 | 109769 | 105391 |
| Cdc14b | 033102 | 221788 | N/A |
| Cdc14b | 033102 | 222713 | 152246 |
| Cdc14b | 033102 | 221217 | 152736 |
| Cdc14b | 033102 | 222766 | 152870 |
| Cdc14b | 033102 | 223116 | N/A |
| Cdc14b | 033102 | 221437 | N/A |
| Cdc14b | 033102 | 109770 | 105392 |
| Cdc42ep1 | 049521 | 059619 | 060930 |
| Cdc42ep4 | 041598 | 106616 | 102227 |
| Cdc42ep4 | 041598 | 053536 | 060227 |
| Cdc42ep4 | 041598 | 131488 | 114599 |
| Cdc42ep4 | 041598 | 153453 | 120316 |
| Cdh1 | 000303 | 000312 | 000312 |
| Cdh1 | 000303 | 136580 | N/A |
| Cdh1 | 000303 | 167688 | 132112 |
| Cdh10 | 022321 | 166873 | 128782 |
| Cdh10 | 022321 | 176801 | N/A |
| Cdh10 | 022321 | 176593 | N/A |
| Cdh10 | 022321 | 040562 | 042199 |
| Cdh10 | 022321 | 176146 | 135546 |
| Cdh10 | 022321 | 176409 | N/A |
| Cdh11 | 031673 | 075190 | 074681 |
| Cdh11 | 031673 | 210578 | N/A |
| Cdh11 | 031673 | 210425 | N/A |
| Cdh13 | 031841 | 117160 | 113527 |
| Cdh13 | 031841 | 145849 | N/A |
| Cdh13 | 031841 | 142551 | N/A |
| Cdh13 | 031841 | 129548 | N/A |
| Cdh13 | 031841 | 148836 | N/A |
| Cdh13 | 031841 | 123567 | N/A |
| Cdh13 | 031841 | 212476 | N/A |
| Cdh13 | 031841 | 151842 | N/A |
| Cdh15 | 031962 | 034443 | 034443 |
| Cdh19 | 047216 | 094626 | 092210 |
| Cdh19 | 047216 | 187555 | N/A |
| Cdh2 | 024304 | 025166 | 025166 |
| Cdh2 | 024304 | 152779 | N/A |
| Cdh2 | 024304 | 115850 | 111516 |
| Cdh4 | 000305 | 000314 | 000314 |
| Cdh4 | 000305 | 108911 | 104539 |
| Cdh4 | 000305 | 124708 | N/A |
| Cdh4 | 000305 | 136411 | N/A |
| Cdh4 | 000305 | 129659 | N/A |
| Cdh4 | 000305 | 098996 | 096594 |
| Cdh8 | 036510 | 155527 | 123619 |
| Cdh8 | 036510 | 142129 | 114507 |
| Cdh8 | 036510 | 093249 | 090935 |
| Cdh8 | 036510 | 145601 | 122493 |
| Cdh8 | 036510 | 128860 | 117326 |
| Cdh8 | 036510 | 126895 | N/A |
| Cdh8 | 036510 | 142475 | 115977 |
| Cdhrl | 021803 | 022337 | 022337 |
| Cdk14 | 028926 | 115451 | 111111 |
| Cdk14 | 028926 | 030763 | 030763 |
| Cdk14 | 028926 | 115450 | 111110 |
| Cdk14 | 028926 | 115452 | 111112 |
| Cdk14 | 028926 | 199623 | N/A |
| Cdk14 | 028926 | 133465 | N/A |
| Cdk14 | 028926 | 156660 | N/A |
| Cdk14 | 028926 | 134867 | N/A |
| Cdk14 | 028926 | 132390 | N/A |
| Cdk14 | 028926 | 153331 | N/A |
| Cdk14 | 028926 | 171119 | N/A |
| Cdk14 | 028926 | 131392 | 114741 |
| Cdk14 | 028926 | 167567 | 130895 |
| Cdk14 | 028926 | 137554 | N/A |
| Cdk14 | 028926 | 200637 | N/A |
| Cdk18 | 026437 | 027697 | 027697 |
| Cdk18 | 026437 | 188387 | N/A |
| Cdk18 | 026437 | 185601 | 140034 |
| Cdk18 | 026437 | 189733 | N/A |
| Cdk18 | 026437 | 112362 | 107981 |
| Cdk5rap2 | 039298 | 124251 | N/A |
| Cdk5rap2 | 039298 | 144099 | 119891 |
| Cdk5rap2 | 039298 | 076541 | 075856 |
| Cdk5rap2 | 039298 | 126416 | N/A |
| Cdk5rap2 | 039298 | 138561 | 116928 |
| Cdk5rap2 | 039298 | 140108 | 119151 |
| Cdkl1 | 020990 | 021377 | 021377 |
| Cdkl1 | 020990 | 221646 | 152086 |
| Cdo1 | 033022 | 035804 | 046517 |
| Cdyl | 059288 | 075220 | 074707 |
| Cdyl | 059288 | 225602 | 153274 |
| Cdyl | 059288 | 163595 | 131784 |
| Cdyl | 059288 | 226071 | N/A |
| Cebpb | 056501 | 070642 | 069850 |
| Cep126 | 040729 | 037397 | 042904 |
| Cep126 | 040729 | 217241 | N/A |
| Cep126 | 040729 | 214150 | N/A |
| Cep76 | 073542 | 097542 | 095149 |
| Cept1 | 040774 | 068301 | 065743 |
| Cept1 | 040774 | 121231 | 112509 |
| Cept1 | 040774 | 039153 | 037277 |
| Cept1 | 040774 | 192438 | 142097 |
| Cept1 | 040774 | 148269 | 118343 |
| Cept1 | 040774 | 137530 | 115898 |
| Cept1 | 040774 | 141525 | 122460 |
| Cercam | 039787 | 154464 | 119476 |
| Cercam | 039787 | 047521 | 041622 |
| Cercam | 039787 | 134152 | 115902 |
| Cercam | 039787 | 153863 | N/A |
| Cercam | 039787 | 155355 | N/A |
| Cerkl | 075256 | 156731 | 121353 |
| Cerkl | 075256 | 099974 | N/A |
| Cerkl | 075256 | 147402 | N/A |
| Cerkl | 075256 | 143974 | 114325 |
| Cerkl | 075256 | 152549 | N/A |
| Cerkl | 075256 | 143602 | N/A |
| Cerkl | 075256 | 123859 | N/A |
| Cerkl | 075256 | 153602 | N/A |
| Cerkl | 075256 | 156830 | N/A |
| Cerkl | 075256 | 130499 | N/A |
| Cerkl | 075256 | 145766 | N/A |
| Cerkl | 075256 | 152413 | N/A |
| Cers4 | 008206 | 177010 | N/A |
| Cers4 | 008206 | 176042 | 135594 |
| Cers4 | 008206 | 008350 | 008350 |
| Cers4 | 008206 | 176267 | N/A |
| Cers4 | 008206 | 175781 | N/A |
| Cers4 | 008206 | 176837 | N/A |
| Cers4 | 008206 | 176932 | N/A |
| Cers4 | 008206 | 176705 | N/A |
| Cers4 | 008206 | 176130 | 135652 |

TABLE 3-continued

| | ENSEMBL IDs for rats | | |
|---|---|---|---|
| Symbol | MUSG | MUST | MUSP |
| Cfap161 | 011154 | 119134 | 114051 |
| Cfap161 | 011154 | 011298 | 011298 |
| Cfap161 | 011154 | 208785 | N/A |
| Cfap161 | 011154 | 149671 | 115281 |
| Cfap20 | 031796 | 212731 | N/A |
| Cfap20 | 031796 | 034249 | 034249 |
| Cfap20 | 031796 | 213086 | 148651 |
| Cfap20 | 031796 | 212579 | N/A |
| Cfap20 | 031796 | 212684 | 148527 |
| Cfap20 | 031796 | 211908 | 148668 |
| Cfap20 | 031796 | 212807 | N/A |
| Cfap20 | 031796 | 212131 | 148415 |
| Cgn | 068876 | 107272 | 102893 |
| Cgn | 068876 | 107273 | 102894 |
| Cgn | 068876 | 153263 | 143156 |
| Cgn | 068876 | 155485 | 142809 |
| Cgnl1 | 032232 | 121322 | 113917 |
| Cgnl1 | 032232 | 152224 | N/A |
| Cgnl1 | 032232 | 122065 | 112479 |
| Cgnl1 | 032232 | 136044 | N/A |
| Cgnl1 | 032232 | 146567 | N/A |
| Cgnl1 | 032232 | 072899 | 072672 |
| Chac1 | 027313 | 028780 | 028780 |
| Chd7 | 041235 | 170457 | N/A |
| Chd7 | 041235 | 127476 | 118711 |
| Chd7 | 041235 | 051558 | 059079 |
| Chd7 | 041235 | 129655 | 123241 |
| Chd7 | 041235 | 170391 | 127007 |
| Chd7 | 041235 | 130709 | N/A |
| Chd7 | 041235 | 222546 | 152166 |
| Chd7 | 041235 | 039267 | 043903 |
| Chdh | 015970 | 067620 | 065542 |
| Chdh | 015970 | 125796 | N/A |
| Chdh | 015970 | 118917 | 112916 |
| Chgb | 027350 | 028826 | 028826 |
| Chid1 | 025512 | 153191 | 114693 |
| Chid1 | 025512 | 118694 | 112891 |
| Chid1 | 025512 | 209452 | 147938 |
| Chid1 | 025512 | 147610 | N/A |
| Chid1 | 025512 | 064642 | 065953 |
| Chid1 | 025512 | 155305 | N/A |
| Chid1 | 025512 | 143561 | 115174 |
| Chid1 | 025512 | 133359 | N/A |
| Chid1 | 025512 | 166082 | 130360 |
| Chid1 | 025512 | 026586 | 026586 |
| Chl1 | 030077 | 203912 | 145026 |
| Chl1 | 030077 | 203489 | N/A |
| Chl1 | 030077 | 066905 | 063933 |
| Chl1 | 030077 | 203830 | 144758 |
| Chl1 | 030077 | 204321 | 144725 |
| Chl1 | 030077 | 205098 | 144739 |
| Chn2 | 004633 | 138930 | N/A |
| Chn2 | 004633 | 046856 | 035908 |
| Chn2 | 004633 | 133315 | 145072 |
| Chn2 | 004633 | 114403 | N/A |
| Chn2 | 004633 | 127323 | 118990 |
| Chn2 | 004633 | 204410 | N/A |
| Chn2 | 004633 | 146114 | 114476 |
| Chn2 | 004633 | 114402 | 110044 |
| Chn2 | 004633 | 114401 | 110043 |
| Chn2 | 004633 | 067741 | 066078 |
| Chn2 | 004633 | 204921 | 145231 |
| Chn2 | 004633 | 203091 | 145008 |
| Chn2 | 004633 | 204115 | 145507 |
| Chn2 | 004633 | 203941 | 145314 |
| Chn2 | 004633 | 204746 | 144983 |
| Chodl | 022860 | 023568 | 023568 |
| Chodl | 022860 | 069148 | 063961 |
| Chodl | 022860 | 114216 | 109854 |
| Chrm1 | 032773 | 177197 | 135356 |
| Chrm1 | 032773 | 035444 | 042632 |
| Chrm1 | 032773 | 163785 | 126103 |
| Chrm3 | 046159 | 187510 | 140131 |
| Chrm3 | 046159 | 223242 | N/A |
| Chrm3 | 046159 | 190395 | N/A |
| Chrm3 | 046159 | 063093 | 055579 |

TABLE 3-continued

| | ENSEMBL IDs for rats | | |
|---|---|---|---|
| Symbol | MUSG | MUST | MUSP |
| Chst1 | 027221 | 065797 | 064246 |
| Chst10 | 026080 | 027249 | 027249 |
| Chst10 | 026080 | 193441 | 142028 |
| Chst10 | 026080 | 192948 | 141470 |
| Chst10 | 026080 | 194361 | 141295 |
| Chst10 | 026080 | 194657 | 141481 |
| Chst10 | 026080 | 193435 | 141604 |
| Chst10 | 026080 | 192175 | N/A |
| Chst10 | 026080 | 195731 | N/A |
| Chst11 | 034612 | 040110 | 045349 |
| Chst15 | 030930 | 077472 | 076682 |
| Chst15 | 030930 | 080215 | 079105 |
| Chst15 | 030930 | 132508 | N/A |
| Chst15 | 030930 | 207068 | N/A |
| Chst8 | 060402 | 078686 | 077752 |
| Chst8 | 060402 | 205259 | 145646 |
| Chst8 | 060402 | 154629 | 123498 |
| Chst8 | 060402 | 135295 | N/A |
| Chst8 | 060402 | 206207 | N/A |
| Chst8 | 060402 | 205390 | N/A |
| Chst9 | 047161 | 053017 | 049975 |
| Chst9 | 047161 | 130553 | 121484 |
| Chsy1 | 032640 | 036372 | 047487 |
| Chsy3 | 058152 | 080721 | 079546 |
| Chtf18 | 019214 | 170575 | 131366 |
| Chtf18 | 019214 | 048054 | 043896 |
| Chtf18 | 019214 | 168914 | N/A |
| Chtf18 | 019214 | 167940 | 131349 |
| Chtf18 | 019214 | 169767 | 129694 |
| Chtf18 | 019214 | 168060 | N/A |
| Chtf18 | 019214 | 170070 | 131768 |
| Cipc | 034157 | 189246 | 140266 |
| Cipc | 034157 | 185434 | 140769 |
| Cipc | 034157 | 191032 | 140097 |
| Cipc | 034157 | 187814 | 141049 |
| Cipc | 034157 | 188901 | N/A |
| Cipc | 034157 | 188046 | 139742 |
| Cipc | 034157 | 185783 | 140830 |
| Cipc | 034157 | 186499 | 139553 |
| Cipc | 034157 | 190588 | 140595 |
| Cipc | 034157 | 191463 | 140683 |
| Cipc | 034157 | 038369 | 038630 |
| Cit | 029516 | 147330 | N/A |
| Cit | 029516 | 137952 | 122745 |
| Cit | 029516 | 148245 | 119769 |
| Cit | 029516 | 146387 | N/A |
| Cit | 029516 | 141101 | 115802 |
| Cit | 029516 | 051704 | 062049 |
| Cit | 029516 | 112008 | 107639 |
| Cit | 029516 | 102560 | 099620 |
| Cit | 029516 | 153407 | N/A |
| Cit | 029516 | 127976 | N/A |
| Cit | 029516 | 202734 | N/A |
| Cit | 029516 | 128702 | N/A |
| Cit | 029516 | 145363 | N/A |
| Cit | 029516 | 147479 | N/A |
| Cit | 029516 | 139881 | N/A |
| Cit | 029516 | 122877 | N/A |
| Cit | 029516 | 136780 | N/A |
| Cit | 029516 | 123736 | 134875 |
| Cit | 029516 | 134609 | N/A |
| Clasrp | 061028 | 086041 | 083205 |
| Clasrp | 061028 | 208427 | N/A |
| Clasrp | 061028 | 208464 | N/A |
| Clasrp | 061028 | 208716 | N/A |
| Clasrp | 061028 | 207253 | N/A |
| Clasrp | 061028 | 207907 | 146982 |
| Clasrp | 061028 | 207663 | 147069 |
| Clasrp | 061028 | 208068 | 147103 |
| Clasrp | 061028 | 207447 | N/A |
| Clasrp | 061028 | 207524 | 146794 |
| Clasrp | 061028 | 207264 | N/A |
| Clasrp | 061028 | 209059 | N/A |
| Clasrp | 061028 | 207325 | N/A |
| Clcn1 | 029862 | 031894 | 031894 |
| Clcn1 | 029862 | 164091 | 131354 |

TABLE 3-continued

| ENSEMBL IDs for rats | | | |
|---|---|---|---|
| Symbol | MUSG | MUST | MUSP |
| Clcn1 | 029862 | 170028 | 132154 |
| Clcn1 | 029862 | 163936 | 130148 |
| Clcn1 | 029862 | 165780 | 130550 |
| Clcn1 | 029862 | 169024 | 130968 |
| Clcn1 | 029862 | 168660 | 126045 |
| Clcn1 | 029862 | 114684 | N/A |
| Clcn1 | 029862 | 163235 | 132387 |
| Clcn1 | 029862 | 169902 | N/A |
| Clcn5 | 004317 | 004428 | 004428 |
| Clcn5 | 004317 | 154382 | N/A |
| Clcn5 | 004317 | 128319 | 122555 |
| Clcn5 | 004317 | 115746 | 111412 |
| Clcn5 | 004317 | 132126 | N/A |
| Cldn11 | 037625 | 046174 | 042181 |
| Clec2l | 079598 | 114874 | 110524 |
| Clec7a | 079293 | 195589 | 141234 |
| Clec7a | 079293 | 184581 | 139167 |
| Clec7a | 079293 | 184861 | N/A |
| Clec7a | 079293 | 112076 | 107707 |
| Clic6 | 022949 | 023670 | 023670 |
| Clic6 | 022949 | 162181 | 124498 |
| Clmn | 021097 | 109936 | 105562 |
| Clmn | 021097 | 109937 | 105563 |
| Clmn | 021097 | 223103 | 152228 |
| Clmn | 021097 | 223342 | 152070 |
| Clmn | 021097 | 223177 | 152097 |
| Clmn | 021097 | 222323 | 152467 |
| Clmn | 021097 | 222412 | N/A |
| Clmp | 032024 | 139577 | N/A |
| Clmp | 032024 | 034522 | 034522 |
| Clmp | 032024 | 141759 | N/A |
| Clmp | 032024 | 134153 | N/A |
| Clstn2 | 032452 | 035027 | 035027 |
| Clstn2 | 032452 | 162295 | 124081 |
| Clvs2 | 019785 | 019920 | 019920 |
| Clvs2 | 019785 | 159533 | N/A |
| Clvs2 | 019785 | 161692 | 151805 |
| Clvs2 | 019785 | 160299 | 125100 |
| Nat8f5 | 079494 | 032074 | 032074 |
| Cmtm5 | 040759 | 037814 | 036138 |
| Cmtm5 | 040759 | 227441 | 153874 |
| Cmtm5 | 040759 | 226807 | N/A |
| Cnih3 | 026514 | 161880 | 124611 |
| Cnih3 | 026514 | 027795 | 027795 |
| Cnih3 | 026514 | 162685 | 124247 |
| Cnih3 | 026514 | 209607 | 148015 |
| Cnksr3 | 015202 | 015346 | 015346 |
| Cnksr3 | 015202 | 150282 | 115863 |
| Cnp | 006782 | 103120 | 099409 |
| Cnp | 006782 | 148034 | N/A |
| Cnp | 006782 | 150414 | N/A |
| Cnp | 006782 | 147403 | N/A |
| Cnpy1 | 044681 | 141601 | 122171 |
| Cnpy1 | 044681 | 118882 | 113944 |
| Cnpy1 | 044681 | 120068 | 112773 |
| Cnpy1 | 044681 | 117098 | 113956 |
| Cnpy1 | 044681 | 141196 | 116024 |
| Cnr1 | 044288 | 057188 | 055797 |
| Cnr1 | 044288 | 133462 | N/A |
| Cnr1 | 044288 | 084736 | 081787 |
| Cntfr | 028444 | 102961 | 100026 |
| Cntfr | 028444 | 102962 | 100027 |
| Cntfr | 028444 | 151181 | N/A |
| Cntfr | 028444 | 064443 | N/A |
| Cntfr | 028444 | 084701 | N/A |
| Cntfr | 028444 | 145379 | 115631 |
| Cntn3 | 030075 | 204990 | N/A |
| Cntn3 | 030075 | 203619 | 145176 |
| Cntn3 | 030075 | 032159 | 032159 |
| Cntn4 | 064293 | 132044 | N/A |
| Cntn4 | 064293 | 113261 | 108886 |
| Cntn4 | 064293 | 089208 | 086616 |
| Cntn4 | 064293 | 113260 | 108885 |
| Cntn4 | 064293 | 113258 | 108883 |
| Cntn4 | 064293 | 125904 | N/A |
| Cntn4 | 064293 | 079416 | 078385 |
| Cntn4 | 064293 | 130040 | N/A |
| Cntn4 | 064293 | 132395 | N/A |
| Cntn4 | 064293 | 204621 | N/A |
| Cntn4 | 064293 | 123596 | N/A |
| Cntn4 | 064293 | 142626 | N/A |
| Cntn4 | 064293 | 113264 | 108889 |
| Cntn5 | 039488 | 160216 | 124327 |
| Cntn5 | 039488 | 162484 | 124214 |
| Cntn5 | 039488 | 160358 | N/A |
| Cntn5 | 039488 | 074133 | 073769 |
| Cntn5 | 039488 | 179049 | 135903 |
| Cntnap4 | 031772 | 125976 | N/A |
| Cntnap4 | 031772 | 118171 | 112511 |
| Cntnap4 | 031772 | 125196 | N/A |
| Cntnap4 | 031772 | 127636 | N/A |
| Cntnap4 | 031772 | 140753 | N/A |
| Cntnap4 | 031772 | 034225 | 034225 |
| Cntnap5a | 070695 | 043725 | 035732 |
| Cobl | 020173 | 172919 | 133669 |
| Cobl | 020173 | 109650 | 105277 |
| Cobl | 020173 | 046755 | 045693 |
| Cobl | 020173 | 174874 | 133470 |
| Cobl | 020173 | 109651 | 105278 |
| Cobl | 020173 | 172956 | 134372 |
| Cobl | 020173 | 172827 | 133368 |
| Cobl | 020173 | 136549 | 114779 |
| Cobl | 020173 | 130572 | N/A |
| Cobl | 020173 | 146067 | 119008 |
| Col11a1 | 027966 | 092155 | 089793 |
| Col11a1 | 027966 | 196345 | N/A |
| Col11a1 | 027966 | 196654 | N/A |
| Col11a1 | 027966 | 211802 | 148798 |
| Col11a1 | 027966 | 138680 | N/A |
| Col11a1 | 027966 | 184978 | 138879 |
| Col11a1 | 027966 | 123619 | 121027 |
| Col11a2 | 024330 | 131134 | 122082 |
| Col11a2 | 024330 | 087497 | 084772 |
| Col11a2 | 024330 | 143354 | 115026 |
| Col11a2 | 024330 | 173749 | N/A |
| Col11a2 | 024330 | 137374 | N/A |
| Col11a2 | 024330 | 144927 | N/A |
| Col11a2 | 024330 | 114252 | 109890 |
| Col11a2 | 024330 | 114255 | 109893 |
| Col13a1 | 058806 | 145469 | 117248 |
| Col13a1 | 058806 | 105451 | N/A |
| Col13a1 | 058806 | 105453 | 101093 |
| Col13a1 | 058806 | 105452 | 101092 |
| Col13a1 | 058806 | 105454 | 101094 |
| Col13a1 | 058806 | 051826 | N/A |
| Col13a1 | 058806 | 153120 | N/A |
| Col15a1 | 028339 | 082303 | 080921 |
| Col15a1 | 028339 | 102917 | 099981 |
| Col15a1 | 028339 | 124105 | N/A |
| Col15a1 | 028339 | 148103 | N/A |
| Col15a1 | 028339 | 140094 | N/A |
| Col15a1 | 028339 | 140413 | 119292 |
| Col15a1 | 028339 | 107731 | 103359 |
| Col15a1 | 028339 | 146967 | 118637 |
| Col15a1 | 028339 | 107730 | 103358 |
| Col1a2 | 029661 | 141483 | 125275 |
| Col1a2 | 029661 | 031668 | 031668 |
| Col1a2 | 029661 | 138511 | N/A |
| Col1a2 | 029661 | 132029 | N/A |
| Col1a2 | 029661 | 148864 | N/A |
| Col1a2 | 029661 | 155687 | N/A |
| Col1a2 | 029661 | 124686 | N/A |
| Col1a2 | 029661 | 203346 | N/A |
| Col20a1 | 016356 | 149179 | 115291 |
| Col20a1 | 016356 | 108856 | 104484 |
| Col20a1 | 016356 | 228434 | 153871 |
| Col20a1 | 016356 | 152473 | 117514 |
| Col20a1 | 016356 | 155425 | 114654 |
| Col22a1 | 079022 | 159410 | 124182 |
| Col22a1 | 079022 | 162081 | N/A |
| Col22a1 | 079022 | 159993 | 125069 |
| Col22a1 | 079022 | 160513 | 124270 |

TABLE 3-continued

ENSEMBL IDs for rats

| Symbol | MUSG | MUST | MUSP |
|---|---|---|---|
| Col23a1 | 063564 | 102765 | 099826 |
| Col23a1 | 063564 | 151098 | 119825 |
| Col4a5 | 031274 | 112931 | 108553 |
| Col4a5 | 031274 | 112930 | 108552 |
| Col4a5 | 031274 | 130732 | 116610 |
| Col4a5 | 031274 | 128669 | N/A |
| Col5a1 | 026837 | 028280 | 028280 |
| Col5a1 | 026837 | 145423 | 123532 |
| Col5a3 | 004098 | 004201 | 004201 |
| Col5a3 | 004098 | 145974 | N/A |
| Col6a1 | 001119 | 001147 | 001147 |
| Col6a1 | 001119 | 137599 | N/A |
| Colgalt2 | 032649 | 127586 | 119210 |
| Colgalt2 | 032649 | 044311 | 037532 |
| Colgalt2 | 032649 | 127586 | 119210 |
| Colgalt2 | 032649 | 044311 | 037532 |
| Corin | 005220 | 167460 | 127389 |
| Corin | 005220 | 005352 | 005352 |
| Corin | 005220 | 175766 | 135889 |
| Corin | 005220 | 177290 | 135511 |
| Corin | 005220 | 176974 | 135722 |
| Corin | 005220 | 176320 | N/A |
| Corin | 005220 | 176439 | N/A |
| Coro1c | 004530 | 164980 | 129314 |
| Coro1c | 004530 | 004646 | 004646 |
| Coro1c | 004530 | 163995 | N/A |
| Coro1c | 004530 | 168634 | N/A |
| Coro1c | 004530 | 172016 | N/A |
| Coro1c | 004530 | 111283 | N/A |
| Coro1c | 004530 | 166647 | N/A |
| Coro1c | 004530 | 168493 | N/A |
| Coro1c | 004530 | 163264 | 129457 |
| Coro1c | 004530 | 168399 | 132504 |
| Coro1c | 004530 | 171630 | N/A |
| Coro2b | 041729 | 048043 | 041826 |
| Coro2b | 041729 | 131981 | 133481 |
| Coro2b | 041729 | 164246 | 128441 |
| Coro2b | 041729 | 151604 | N/A |
| Coro2b | 041729 | 174439 | 134079 |
| Coro2b | 041729 | 173171 | 134709 |
| Coro2b | 041729 | 123379 | N/A |
| Coro6 | 020836 | 102493 | 099551 |
| Coro6 | 020836 | 130255 | 120232 |
| Coro6 | 020836 | 021190 | 021190 |
| Coro6 | 020836 | 079770 | 078703 |
| Coro6 | 020836 | 108391 | 104028 |
| Coro6 | 020836 | 052515 | 056862 |
| Cotl1 | 031827 | 034285 | 034285 |
| Cotl1 | 031827 | 211873 | 148448 |
| Cotl1 | 031827 | 212676 | N/A |
| Cotl1 | 031827 | 168698 | 126329 |
| Cpe | 037852 | 048967 | 048555 |
| Cpe | 037852 | 210783 | N/A |
| Cpe | 037852 | 210680 | N/A |
| Cpe | 037852 | 211312 | N/A |
| Cpm | 020183 | 138020 | N/A |
| Cpm | 020183 | 123374 | N/A |
| Cpm | 020183 | 020399 | 020399 |
| Cpm | 020183 | 141991 | N/A |
| Cpne4 | 032564 | 098443 | 096042 |
| Cpne4 | 032564 | 157006 | 117155 |
| Cpne4 | 032564 | 057742 | 049663 |
| Cpne4 | 032564 | 077190 | 076432 |
| Cpne4 | 032564 | 213120 | 150096 |
| Cpne4 | 032564 | 213452 | 150551 |
| Cpne7 | 034796 | 134235 | N/A |
| Cpne7 | 034796 | 037900 | 042159 |
| Cpne7 | 034796 | 131659 | N/A |
| Cpne7 | 034796 | 123191 | N/A |
| Cpne7 | 034796 | 127431 | N/A |
| Cpne9 | 030270 | 041203 | 044416 |
| Cpne9 | 030270 | 132372 | N/A |
| Cpne9 | 030270 | 130191 | 138786 |
| Cpne9 | 030270 | 124574 | N/A |
| Cpne9 | 030270 | 204050 | N/A |
| Cpne9 | 030270 | 128148 | N/A |
| Cpne9 | 030270 | 155779 | N/A |
| Cpne9 | 030270 | 138388 | N/A |
| Cpne9 | 030270 | 134523 | N/A |
| Cpne9 | 030270 | 136728 | N/A |
| Creb3l1 | 027230 | 028663 | 028663 |
| Crim1 | 024074 | 112498 | 108117 |
| Crispld1 | 025776 | 159958 | 124095 |
| Crispld1 | 025776 | 160305 | 123800 |
| Crispld1 | 025776 | 095075 | 092686 |
| Cryab | 032060 | 217475 | 149803 |
| Cryab | 032060 | 214609 | 149454 |
| Cryab | 032060 | 034562 | 034562 |
| Cryab | 032060 | 214962 | 149759 |
| Cryab | 032060 | 216755 | 150669 |
| Cryab | 032060 | 216393 | N/A |
| Cryba2 | 006546 | 133833 | 140298 |
| Cryba2 | 006546 | 006721 | 006721 |
| Cryl1 | 021947 | 022517 | 022517 |
| Cryl1 | 021947 | 223986 | N/A |
| Cryl1 | 021947 | 224292 | N/A |
| Cryl1 | 021947 | 225765 | N/A |
| Crym | 030905 | 134067 | N/A |
| Crym | 030905 | 033198 | 033198 |
| Csmd1 | 060924 | 082104 | 080751 |
| Csmd1 | 060924 | 125551 | N/A |
| Csmd1 | 060924 | 131778 | N/A |
| Csmd1 | 060924 | 138348 | N/A |
| Csmd1 | 060924 | 137947 | N/A |
| Csmd1 | 060924 | 133933 | N/A |
| Csmd1 | 060924 | 122983 | N/A |
| Csmd2 | 028804 | 129619 | N/A |
| Csmd2 | 028804 | 144298 | N/A |
| Csmd2 | 028804 | 184063 | 138958 |
| Csmd2 | 028804 | 148247 | N/A |
| Csmd2 | 028804 | 139561 | N/A |
| Csmd2 | 028804 | 221199 | 152795 |
| Cspg4 | 032911 | 214057 | N/A |
| Cspg4 | 032911 | 035661 | 038909 |
| Cspg4 | 032911 | 215666 | N/A |
| Cspg4 | 032911 | 217052 | N/A |
| Cspg5 | 032482 | 035058 | 035058 |
| Cspg5 | 032482 | 196060 | 143164 |
| Cspg5 | 032482 | 196176 | N/A |
| Cspg5 | 032482 | 197850 | 143005 |
| Cspg5 | 032482 | 199736 | 142845 |
| Csrnp3 | 044647 | 122912 | 117533 |
| Csrnp3 | 044647 | 053910 | 055719 |
| Csrnp3 | 044647 | 139896 | N/A |
| Csrnp3 | 044647 | 112397 | 135151 |
| Csrnp3 | 044647 | 129133 | N/A |
| Csrnp3 | 044647 | 176109 | 135019 |
| Csrnp3 | 044647 | 145598 | 135605 |
| Csrnp3 | 044647 | 112394 | 108013 |
| Csrp1 | 026421 | 097561 | 095169 |
| Csrp1 | 026421 | 027677 | 027677 |
| Csta1 | 034362 | 096090 | 093795 |
| Csta1 | 034362 | 161638 | 125577 |
| Ctnna3 | 060843 | 105441 | 101081 |
| Ctnna3 | 060843 | 105440 | 101080 |
| Ctnna3 | 060843 | 133190 | N/A |
| Ctnna3 | 060843 | 135474 | N/A |
| Ctnna3 | 060843 | 075099 | 074606 |
| Cttnbp2 | 000416 | 152499 | N/A |
| Cttnbp2 | 000416 | 146775 | 119383 |
| Cttnbp2 | 000416 | 148602 | 118432 |
| Cttnbp2 | 000416 | 090601 | 088089 |
| Cttnbp2 | 000416 | 141581 | 123162 |
| Cttnbp2 | 000416 | 139557 | N/A |
| Cttnbp2 | 000416 | 129669 | 116878 |
| Cttnbp2 | 000416 | 142963 | 122590 |
| Cttnbp2 | 000416 | 140416 | N/A |
| Ctxn1 | 048644 | 053252 | 057115 |
| Ctxn3 | 069372 | 091892 | 089507 |
| Ctxn3 | 069372 | 209782 | 147740 |
| Ctxn3 | 069372 | 209786 | 147982 |
| Cxcl14 | 021508 | 224801 | 153440 |

TABLE 3-continued

| | ENSEMBL IDs for rats | | |
| --- | --- | --- | --- |
| Symbol | MUSG | MUST | MUSP |
| Cxcl14 | 021508 | 021970 | 021970 |
| Cxcl5 | 029371 | 202380 | N/A |
| Cxcl5 | 029371 | 031318 | 031318 |
| Cxcr4 | 045382 | 052172 | 053489 |
| Cxcr4 | 045382 | 142893 | 120153 |
| 4930578C19Rik | 037358 | 044188 | 046567 |
| 4930578C19Rik | 037358 | 147039 | N/A |
| Cxxc4 | 044365 | 197151 | N/A |
| Cxxc4 | 044365 | 181904 | 138000 |
| Cxxc4 | 044365 | 181597 | N/A |
| Cxxc4 | 044365 | 199134 | N/A |
| Cxxc4 | 044365 | 166288 | 128574 |
| Cyb5a | 024646 | 160180 | 124480 |
| Cyb5a | 024646 | 025549 | 025549 |
| Cyb5a | 024646 | 159846 | N/A |
| Cyb5a | 024646 | 163083 | 124412 |
| Cyb5a | 024646 | 159837 | N/A |
| Cyfip2 | 020340 | 093166 | 090854 |
| Cyfip2 | 020340 | 142017 | 119801 |
| Cyfip2 | 020340 | 129474 | 116715 |
| Cyfip2 | 020340 | 165599 | 127586 |
| Cyfip2 | 020340 | 093165 | 090853 |
| Cyp27a1 | 026170 | 027356 | 027356 |
| Cyp27a1 | 026170 | 190781 | N/A |
| Cyp27a1 | 026170 | 189083 | N/A |
| Cyp2j9 | 015224 | 055693 | 050464 |
| Cyp2j9 | 015224 | 126509 | N/A |
| Cyp7b1 | 039519 | 035625 | 037487 |
| D430019H16Rik | 094910 | 178224 | 137376 |
| D430041D05Rik | 068373 | 136156 | N/A |
| D430041D05Rik | 068373 | 141159 | 117041 |
| D430041D05Rik | 068373 | 156278 | N/A |
| D430041D05Rik | 068373 | 149165 | N/A |
| D430041D05Rik | 068373 | 155458 | N/A |
| D430041D05Rik | 068373 | 139015 | 124519 |
| D430041D05Rik | 068373 | 149466 | 124980 |
| D430041D05Rik | 068373 | 089726 | 106756 |
| D430042O09Rik | 032743 | 124223 | 118668 |
| D430042O09Rik | 032743 | 069660 | 065744 |
| D430042O09Rik | 032743 | 205723 | N/A |
| D430042O09Rik | 032743 | 148701 | 119527 |
| D430042O09Rik | 032743 | 122337 | N/A |
| D430042O09Rik | 032743 | 205462 | N/A |
| D430042O09Rik | 032743 | 132204 | 115955 |
| D430042O09Rik | 032743 | 155059 | N/A |
| D630003M21Rik | 037813 | 103121 | 099410 |
| D630003M21Rik | 037813 | 046944 | 040546 |
| D630003M21Rik | 037813 | 169335 | 130623 |
| D7Ertd443e | 030994 | 094002 | 091539 |
| D7Ertd443e | 030994 | 172947 | 134479 |
| D7Ertd443e | 030994 | 106129 | 101735 |
| D7Ertd443e | 030994 | 206005 | N/A |
| D7Ertd443e | 030994 | 174700 | 134411 |
| D7Ertd443e | 030994 | 173195 | 134585 |
| D7Ertd443e | 030994 | 173754 | 133963 |
| D7Ertd443e | 030994 | 174271 | N/A |
| Tmem131 | 026116 | 194563 | 142307 |
| Tmem131 | 026116 | 191381 | N/A |
| Tmem131 | 026116 | 187917 | N/A |
| Tmem131 | 026116 | 189470 | 140620 |
| Tmem131 | 026116 | 190442 | 140187 |
| Tmem131 | 026116 | 186486 | 142080 |
| Tmem131 | 026116 | 185964 | 141413 |
| Tmem131 | 026116 | 027290 | 027290 |
| Dagla | 035735 | 039327 | 046358 |
| Dagla | 035735 | 125567 | 138702 |
| Dagla | 035735 | 156361 | N/A |
| Dao | 042096 | 112292 | 107911 |
| Dao | 042096 | 086599 | 083792 |
| Dao | 042096 | 161610 | 125588 |
| Dao | 042096 | 199175 | 143337 |
| Dao | 042096 | 162214 | N/A |
| Dapk1 | 021559 | 226059 | 153607 |
| Dapk1 | 021559 | 077453 | 076666 |
| Dapk1 | 021559 | 224340 | N/A |
| Dapk1 | 021559 | 044083 | 040825 |

TABLE 3-continued

| | ENSEMBL IDs for rats | | |
| --- | --- | --- | --- |
| Symbol | MUSG | MUST | MUSP |
| Dapk1 | 021559 | 225632 | N/A |
| Dapk1 | 021559 | 224789 | 153205 |
| Dapk1 | 021559 | 225952 | N/A |
| Slc6a3 | 021609 | 022100 | 022100 |
| Dcc | 060534 | 114943 | 110593 |
| Dcc | 060534 | 073379 | 073094 |
| Dcc | 060534 | 126030 | N/A |
| Ddhd1 | 037697 | 111828 | 107459 |
| Ddhd1 | 037697 | 087320 | 084577 |
| Ddhd1 | 037697 | 051310 | 050088 |
| Ddhd1 | 037697 | 152110 | N/A |
| Ddhd1 | 037697 | 129599 | N/A |
| Ddhd1 | 037697 | 149286 | 118848 |
| Ddhd1 | 037697 | 156758 | 121837 |
| Ddhd1 | 037697 | 141487 | 133358 |
| Ddhd1 | 037697 | 126428 | N/A |
| Ddhd1 | 037697 | 226301 | 154065 |
| Ddhd1 | 037697 | 147551 | N/A |
| Ddhd1 | 037697 | 153547 | N/A |
| Ddhd1 | 037697 | 226559 | N/A |
| Ddn | 059213 | 075444 | 074895 |
| Ddr2 | 026674 | 194690 | 141443 |
| Ddr2 | 026674 | 192312 | 142191 |
| Ddr2 | 026674 | 195867 | N/A |
| Ddr2 | 026674 | 194619 | N/A |
| Ddr2 | 026674 | 027985 | 027985 |
| Ddr2 | 026674 | 170800 | 129624 |
| Ddx3y | 069045 | 091190 | 088729 |
| Ddx3y | 069045 | 188182 | N/A |
| Ddx3y | 069045 | 188484 | 140361 |
| Ddx3y | 069045 | 187596 | N/A |
| Depdc1b | 021697 | 051594 | 059291 |
| Depdc1b | 021697 | 168037 | N/A |
| Depdc1b | 021697 | 163307 | 131707 |
| Depdc1b | 021697 | 171178 | 132972 |
| Depdc1b | 021697 | 167413 | N/A |
| Depdc1b | 021697 | 172402 | N/A |
| Depdc7 | 027173 | 028595 | 028595 |
| Depdc7 | 027173 | 144133 | N/A |
| Des | 026208 | 027409 | 027409 |
| Des | 026208 | 144894 | N/A |
| Des | 026208 | 125948 | N/A |
| Gsdme | 029821 | 204417 | N/A |
| Gsdme | 029821 | 165099 | 130522 |
| Gsdme | 029821 | 101405 | 098952 |
| Gsdme | 029821 | 031845 | 031845 |
| Gsdme | 029821 | 167893 | 132062 |
| Gsdme | 029821 | 204700 | N/A |
| Gsdme | 029821 | 170142 | 126759 |
| Dgkb | 036095 | 222337 | 152460 |
| Dgkb | 036095 | 221176 | 152446 |
| Dgkb | 036095 | 220990 | 152378 |
| Dgkb | 036095 | 221540 | N/A |
| Dgkb | 036095 | 040500 | 037900 |
| Dgkb | 036095 | 221098 | N/A |
| Dgkb | 036095 | 221686 | N/A |
| Dgkb | 036095 | 220606 | N/A |
| Dgkh | 034731 | 226342 | 154036 |
| Dgkh | 034731 | 227537 | 154107 |
| Dgkh | 034731 | 228362 | 154554 |
| Dgkh | 034731 | 227767 | 154031 |
| Dgkh | 034731 | 227820 | N/A |
| Dgkh | 034731 | 074729 | 074290 |
| Dgki | 038665 | 101532 | 099071 |
| Dgki | 038665 | 150300 | 138457 |
| Dgki | 038665 | 138286 | 138628 |
| Dgki | 038665 | 090314 | 087788 |
| Dgki | 038665 | 042075 | 047858 |
| Dgki | 038665 | 143046 | N/A |
| Dgki | 038665 | 146656 | N/A |
| Dgki | 038665 | 136457 | N/A |
| Disp3 | 041544 | 047720 | 038490 |
| Disp3 | 041544 | 143851 | N/A |
| Disp3 | 041544 | 129734 | N/A |
| Dixdc1 | 032064 | 034566 | 034566 |
| Dixdc1 | 032064 | 141919 | N/A |

TABLE 3-continued

| ENSEMBL IDs for rats | | |
|---|---|---|
| Symbol | MUSG | MUST | MUSP |
| Dixdc1 | 032064 | 117646 | 112431 |
| Dixdc1 | 032064 | 119449 | N/A |
| Dixdc1 | 032064 | 121634 | 113089 |
| Dixdc1 | 032064 | 124424 | N/A |
| Dixdc1 | 032064 | 120622 | 113934 |
| Dixdc1 | 032064 | 151109 | N/A |
| Dixdc1 | 032064 | 149717 | N/A |
| Dixdc1 | 032064 | 154315 | N/A |
| Dixdc1 | 032064 | 117093 | 112654 |
| Dixdc1 | 032064 | 118707 | 113907 |
| Dlc1 | 031523 | 033923 | 033923 |
| Dlc1 | 031523 | 098826 | 096425 |
| Dlc1 | 031523 | 163663 | 132812 |
| Dlc1 | 031523 | 156312 | N/A |
| Dlc1 | 031523 | 145245 | N/A |
| Dlc1 | 031523 | 036104 | N/A |
| Dlc1 | 031523 | 178717 | N/A |
| Dlc1 | 031523 | 179652 | N/A |
| Dlc1 | 031523 | 179501 | 137498 |
| Dlgap2 | 047495 | 152652 | 123078 |
| Dlgap2 | 047495 | 133298 | 119613 |
| Dlgap2 | 047495 | 150247 | 123104 |
| Dlgap2 | 047495 | 141155 | N/A |
| Dlgap2 | 047495 | 136000 | N/A |
| Dlgap2 | 047495 | 141214 | N/A |
| Dlgap2 | 047495 | 137130 | N/A |
| Dlgap2 | 047495 | 129119 | N/A |
| Dlgap2 | 047495 | 043279 | 039647 |
| Dlgap4 | 061689 | 169464 | 126980 |
| Dlgap4 | 061689 | 109568 | 105196 |
| Dlgap4 | 061689 | 070782 | 068745 |
| Dlgap4 | 061689 | 137356 | 135698 |
| Dlgap4 | 061689 | 131157 | 134941 |
| Dlgap4 | 061689 | 109566 | 105194 |
| Dlgap4 | 061689 | 127944 | N/A |
| Dlgap4 | 061689 | 146412 | 135156 |
| Dlgap4 | 061689 | 177013 | 135409 |
| Dlgap4 | 061689 | 171030 | 129756 |
| Dlgap4 | 061689 | 000094 | 000094 |
| Dlgap4 | 061689 | 099145 | 096749 |
| Dlgap4 | 061689 | 123730 | N/A |
| Dlgap4 | 061689 | 109567 | 105195 |
| Dlx4os | 086552 | 156477 | N/A |
| Dlx6os1 | 098326 | 184182 | N/A |
| Dlx6os1 | 090063 | 159827 | N/A |
| Dlx6os1 | 090063 | 159568 | N/A |
| Dlx6os1 | 090063 | 210702 | N/A |
| Dmd | 045103 | 114000 | 109633 |
| Dmd | 045103 | 128983 | N/A |
| Dmd | 045103 | 113991 | 109624 |
| Dmd | 045103 | 132333 | N/A |
| Dmd | 045103 | 146331 | N/A |
| Dmd | 045103 | 149433 | N/A |
| Dmd | 045103 | 113992 | 109625 |
| Dmd | 045103 | 156107 | N/A |
| Dmd | 045103 | 147740 | N/A |
| Dmd | 045103 | 141778 | N/A |
| Dmd | 045103 | 141261 | N/A |
| Dmd | 045103 | 139998 | N/A |
| Dmd | 045103 | 123308 | N/A |
| Dmd | 045103 | 127295 | N/A |
| Dmp1 | 029307 | 066708 | 068053 |
| Dnah5 | 022262 | 067048 | 069751 |
| Dnah6 | 052861 | 114040 | 109674 |
| Dnah6 | 052861 | 204053 | 144791 |
| Dnah6 | 052861 | 114038 | N/A |
| Dnah6 | 052861 | 064948 | 068758 |
| Dner | 036766 | 049126 | 042927 |
| Dner | 036766 | 191306 | N/A |
| Dner | 036766 | 185606 | 140986 |
| Dner | 036766 | 191546 | 140662 |
| Dnmbp | 025195 | 212396 | 148582 |
| Dnmbp | 025195 | 212592 | 148421 |
| Dnmbp | 025195 | 212048 | 148546 |
| Dnmbp | 025195 | 212032 | 148708 |
| Dnmbp | 025195 | 212157 | N/A |

TABLE 3-continued

| ENSEMBL IDs for rats | | |
|---|---|---|
| Symbol | MUSG | MUST | MUSP |
| Dnmbp | 025195 | 026209 | 026209 |
| Doc2b | 020848 | 021209 | 021209 |
| Dock1 | 058325 | 211570 | N/A |
| Dock1 | 058325 | 211593 | 147945 |
| Dock1 | 058325 | 084488 | 081531 |
| Dock1 | 058325 | 210617 | N/A |
| Dock1 | 058325 | 210464 | N/A |
| Dock1 | 058325 | 210121 | 147797 |
| Dock5 | 044447 | 039135 | 036674 |
| Dock5 | 044447 | 226033 | N/A |
| Dock5 | 044447 | 224823 | N/A |
| Dock6 | 032198 | 217336 | 149156 |
| Dock6 | 032198 | 215729 | 150250 |
| Dock6 | 032198 | 034728 | 034728 |
| Dock6 | 032198 | 217310 | N/A |
| Dock6 | 032198 | 216626 | 150347 |
| Dock6 | 032198 | 217515 | N/A |
| Dock6 | 032198 | 213296 | N/A |
| Dock6 | 032198 | 213775 | N/A |
| Dock7 | 028556 | 030286 | 030286 |
| Dock7 | 028556 | 206128 | N/A |
| Dock7 | 028556 | 127417 | 117797 |
| Dock7 | 028556 | 124466 | 145749 |
| Dock7 | 028556 | 075836 | 075233 |
| Dock7 | 028556 | 205650 | 145604 |
| Dock7 | 028556 | 140225 | N/A |
| Dock7 | 028556 | 205484 | N/A |
| Dock7 | 028556 | 124040 | N/A |
| Dock7 | 028556 | 205652 | 145833 |
| Dock7 | 028556 | 139152 | N/A |
| Dock7 | 028556 | 140848 | N/A |
| Dock7 | 028556 | 150254 | 114204 |
| Dock7 | 028556 | 127946 | 119103 |
| Dock7 | 028556 | 205783 | N/A |
| Dock7 | 028556 | 153362 | N/A |
| Dock7 | 028556 | 131386 | 145985 |
| Dock7 | 028556 | 206604 | N/A |
| Dock8 | 052085 | 025831 | 025831 |
| Dok6 | 073514 | 097495 | 095103 |
| Dok6 | 073514 | 160328 | N/A |
| Dopey2 | 022946 | 045004 | 044437 |
| Dopey2 | 022946 | 226335 | N/A |
| Dopey2 | 022946 | 226418 | N/A |
| Dopey2 | 022946 | 228846 | 154446 |
| Dopey2 | 022946 | 227156 | 154771 |
| Dopey2 | 022946 | 226836 | 154636 |
| Dopey2 | 022946 | 226215 | 154229 |
| Dopey2 | 022946 | 226535 | N/A |
| Dopey2 | 022946 | 227939 | N/A |
| Dopey2 | 022946 | 228261 | N/A |
| Dopey2 | 022946 | 227278 | N/A |
| Dopey2 | 022946 | 228423 | N/A |
| Dpf3 | 021221 | 147469 | 122598 |
| Dpf3 | 021221 | 144237 | 122004 |
| Dpf3 | 021221 | 133282 | 121199 |
| Dpf3 | 021221 | 140327 | 120700 |
| Dpf3 | 021221 | 178756 | 136280 |
| Dpf3 | 021221 | 177959 | 137477 |
| Dpf3 | 021221 | 177801 | 136740 |
| Dpp10 | 036815 | 112606 | 108225 |
| Dpp10 | 036815 | 112603 | 108222 |
| Dpp10 | 036815 | 187202 | N/A |
| Dpp10 | 036815 | 140361 | N/A |
| Dpy19l1 | 043067 | 115277 | 110932 |
| Dpy19l1 | 043067 | 142064 | 119986 |
| Dpy19l1 | 043067 | 152480 | N/A |
| Dpy19l1 | 043067 | 149001 | N/A |
| Dpy19l1 | 043067 | 129048 | N/A |
| Dpy19l1 | 043067 | 170356 | 129575 |
| Dpy19l2 | 085576 | 133010 | 132092 |
| Dpyd | 033308 | 039177 | 039429 |
| Dpyd | 033308 | 126254 | N/A |
| Dpyd | 033308 | 150950 | N/A |
| Dpyd | 033308 | 149101 | 143022 |
| Dpyd | 033308 | 200178 | N/A |
| Dpyd | 033308 | 129148 | N/A |

TABLE 3-continued

| ENSEMBL IDs for rats | | | |
|---|---|---|---|
| Symbol | MUSG | MUST | MUSP |
| Dpysl3 | 024501 | 121805 | 112928 |
| Dpysl3 | 024501 | 135547 | N/A |
| Dpysl3 | 024501 | 118043 | 113711 |
| Dpysl3 | 024501 | 025379 | 025379 |
| Dpysl3 | 024501 | 124207 | 114981 |
| Dpysl3 | 024501 | 118071 | 113604 |
| Dpysl4 | 025478 | 026551 | 026551 |
| Dpysl4 | 025478 | 139364 | N/A |
| Dpysl4 | 025478 | 154273 | N/A |
| Dpysl4 | 025478 | 122844 | N/A |
| Dpysl4 | 025478 | 145499 | 117764 |
| Dpysl4 | 025478 | 121184 | 112896 |
| Drd1 | 021478 | 221470 | 152768 |
| Drd1 | 021478 | 222706 | N/A |
| Drd1 | 021478 | 021932 | 021932 |
| Drd2 | 032259 | 075764 | 075170 |
| Dscaml1 | 032087 | 217335 | N/A |
| Dscaml1 | 032087 | 217538 | 149771 |
| Dscaml1 | 032087 | 213919 | 150245 |
| Dscaml1 | 032087 | 216340 | N/A |
| Dscaml1 | 032087 | 034592 | 034592 |
| Dscaml1 | 032087 | 216078 | 148905 |
| Dscaml1 | 032087 | 216685 | 149247 |
| Dscaml1 | 032087 | 215027 | N/A |
| Dscaml1 | 032087 | 214151 | N/A |
| Dusp16 | 030203 | 129433 | 115925 |
| Dusp16 | 030203 | 100857 | 098419 |
| Dusp16 | 030203 | 204083 | 144834 |
| Dusp16 | 030203 | 203651 | N/A |
| Dusp16 | 030203 | 203452 | N/A |
| Dusp16 | 030203 | 148926 | 144917 |
| Dusp16 | 030203 | 149776 | 144784 |
| Dusp22 | 069255 | 091672 | 089260 |
| Dusp22 | 069255 | 110310 | 105939 |
| Dusp22 | 069255 | 220748 | N/A |
| Dusp22 | 069255 | 221725 | 152283 |
| Dusp22 | 069255 | 095914 | 093603 |
| Dusp26 | 039661 | 036631 | 046794 |
| Dusp26 | 039661 | 170204 | 126397 |
| Dusp26 | 039661 | 162551 | N/A |
| Dusp26 | 039661 | 161713 | 124949 |
| Dusp26 | 039661 | 160700 | N/A |
| Dusp5 | 034765 | 038287 | 047900 |
| Dzank1 | 037259 | 081982 | 080643 |
| Dzank1 | 037259 | 124823 | N/A |
| Dzank1 | 037259 | 150816 | N/A |
| Dzank1 | 037259 | 163701 | 133177 |
| Dzip1l | 037784 | 131095 | 116647 |
| Dzip1l | 037784 | 078367 | 077475 |
| Dzip1l | 037784 | 112885 | 108506 |
| Dzip1l | 037784 | 112886 | 108507 |
| Dzip1l | 037784 | 112884 | 108505 |
| Dzip1l | 037784 | 134969 | N/A |
| Dzip1l | 037784 | 190893 | N/A |
| Ebf1 | 057098 | 081265 | 080020 |
| Ebf1 | 057098 | 101326 | 099857 |
| Ebf1 | 057098 | 109268 | 104891 |
| Ebf1 | 057098 | 140822 | N/A |
| Ebf1 | 057098 | 149997 | N/A |
| Ebf1 | 057098 | 135993 | N/A |
| Ebf1 | 057098 | 138452 | N/A |
| Ebf2 | 022053 | 022637 | 022637 |
| Ebf2 | 022053 | 176161 | 135500 |
| Ebf2 | 022053 | 177231 | N/A |
| Ebf2 | 022053 | 176029 | 135782 |
| Ebf3 | 010476 | 033378 | 033378 |
| Ebf3 | 010476 | 106118 | 101724 |
| Ebf3 | 010476 | 210774 | 147829 |
| Ebf3 | 010476 | 209578 | 147512 |
| Ebf3 | 010476 | 209905 | N/A |
| Ebf3 | 010476 | 209864 | N/A |
| Ebf3 | 010476 | 168203 | 130334 |
| Ebf3 | 010476 | 169486 | 132563 |
| Ebf4 | 053552 | 110288 | 105917 |
| Ebf4 | 053552 | 110286 | 105915 |
| Ebf4 | 053552 | 134728 | N/A |

TABLE 3-continued

| ENSEMBL IDs for rats | | | |
|---|---|---|---|
| Symbol | MUSG | MUST | MUSP |
| Ebf4 | 053552 | 126740 | 133528 |
| Ebf4 | 053552 | 140169 | 134520 |
| Ebf4 | 053552 | 110287 | 105916 |
| Ece1 | 057530 | 102518 | 099576 |
| Ece1 | 057530 | 130407 | 125529 |
| Ece1 | 057530 | 151110 | 114671 |
| Ece1 | 057530 | 129607 | N/A |
| Echdc2 | 028601 | 052999 | 051268 |
| Echdc2 | 028601 | 130942 | 124746 |
| Echdc2 | 028601 | 125647 | 123913 |
| Echdc2 | 028601 | 116307 | 112009 |
| Echdc2 | 028601 | 135718 | 114371 |
| Echdc2 | 028601 | 138701 | N/A |
| Echdc2 | 028601 | 133049 | N/A |
| Echdc2 | 028601 | 123280 | N/A |
| Echdc2 | 028601 | 126900 | 123734 |
| Echdc2 | 028601 | 150487 | N/A |
| Echdc2 | 028601 | 127392 | N/A |
| Echdc2 | 028601 | 106691 | 102302 |
| Echdc2 | 028601 | 116309 | 112011 |
| Edem1 | 030104 | 204804 | 144901 |
| Edem1 | 030104 | 089162 | 086565 |
| Edem1 | 030104 | 203469 | N/A |
| Edem1 | 030104 | 204524 | N/A |
| Edem1 | 030104 | 203302 | N/A |
| Edil3 | 034488 | 118731 | 112829 |
| Edil3 | 034488 | 153974 | N/A |
| Edil3 | 034488 | 081769 | 080462 |
| Edil3 | 034488 | 134241 | N/A |
| Edil3 | 034488 | 133761 | N/A |
| Edil3 | 034488 | 137921 | N/A |
| Edil3 | 034488 | 140625 | N/A |
| Edil3 | 034488 | 043111 | 044652 |
| Ednrb | 022122 | 022718 | 022718 |
| Ednrb | 022122 | 227824 | 154806 |
| Ednrb | 022122 | 172237 | 126057 |
| Slc13a1 | 029700 | 031713 | 031713 |
| Slc13a1 | 029700 | 174594 | N/A |
| Slc13a1 | 029700 | 177412 | N/A |
| Slc13a1 | 029700 | 176692 | N/A |
| Efemp1 | 020467 | 020759 | 020759 |
| Efemp1 | 020467 | 139713 | 114757 |
| Efemp1 | 020467 | 124103 | N/A |
| Efhc2 | 025038 | 026014 | 026014 |
| Efhd1 | 026255 | 118687 | 112980 |
| Efhd1 | 026255 | 027472 | 027472 |
| Efhd1 | 026255 | 150831 | N/A |
| Efhd2 | 040659 | 036854 | 044502 |
| Efna5 | 048915 | 076840 | 076115 |
| Efna5 | 048915 | 078839 | 077883 |
| Efnb3 | 003934 | 004036 | 004036 |
| Egfr | 020122 | 020329 | 020329 |
| Egfr | 020122 | 102884 | 099948 |
| Egfr | 020122 | 125984 | 122632 |
| Egfr | 020122 | 138518 | N/A |
| Egfr | 020122 | 139722 | N/A |
| Egln3 | 035105 | 039516 | 041874 |
| Egr3 | 033730 | 035908 | 037042 |
| Egr3 | 033730 | 225200 | 153491 |
| Egr3 | 033730 | 223809 | N/A |
| Egr3 | 033730 | 223747 | N/A |
| Ehd3 | 024065 | 024860 | 024860 |
| Eif2s3y | 069049 | 091197 | 088736 |
| Eif2s3y | 069049 | 137006 | N/A |
| Eif2s3y | 069049 | 148961 | N/A |
| Eif2s3y | 069049 | 154556 | N/A |
| Eif2s3y | 069049 | 139083 | N/A |
| Eif2s3y | 069049 | 134820 | N/A |
| Elavl2 | 008489 | 107110 | 102727 |
| Elavl2 | 008489 | 008633 | 008633 |
| Elavl2 | 008489 | 107118 | 102735 |
| Elavl2 | 008489 | 107120 | 102737 |
| Elavl2 | 008489 | 102799 | 099863 |
| Elavl2 | 008489 | 128599 | N/A |
| Elavl2 | 008489 | 107116 | 102733 |
| Elavl2 | 008489 | 107109 | 102726 |

TABLE 3-continued

| ENSEMBL IDs for rats | | | |
|---|---|---|---|
| Symbol | MUSG | MUST | MUSP |
| Elavl2 | 008489 | 107111 | 102728 |
| Elavl2 | 008489 | 176469 | N/A |
| Elavl2 | 008489 | 177109 | 135780 |
| Elavl2 | 008489 | 147611 | 117770 |
| Elavl2 | 008489 | 176362 | 135038 |
| Elavl2 | 008489 | 144769 | N/A |
| Elavl2 | 008489 | 176151 | N/A |
| Elavl2 | 008489 | 107124 | 102741 |
| Elavl4 | 028546 | 106603 | 102214 |
| Elavl4 | 028546 | 102723 | 099784 |
| Elavl4 | 028546 | 106598 | 102208 |
| Elavl4 | 028546 | 106597 | 102207 |
| Elavl4 | 028546 | 102722 | 099783 |
| Elavl4 | 028546 | 106600 | 102210 |
| Elavl4 | 028546 | 106601 | 102212 |
| Elavl4 | 028546 | 142722 | 121828 |
| Elavl4 | 028546 | 153200 | N/A |
| Elavl4 | 028546 | 144554 | N/A |
| Elavl4 | 028546 | 153906 | 120942 |
| Elavl4 | 028546 | 138972 | 123014 |
| Elf2 | 037174 | 194641 | 141197 |
| Elf2 | 037174 | 183463 | 139360 |
| Elf2 | 037174 | 162009 | 061076 |
| Elf2 | 037174 | 091144 | 088678 |
| Elf2 | 037174 | 108051 | 103686 |
| Elf2 | 037174 | 108053 | 103688 |
| Elf2 | 037174 | 193909 | N/A |
| Elf2 | 037174 | 195432 | 142300 |
| Elf2 | 037174 | 183338 | 139358 |
| Elf2 | 037174 | 184677 | 139199 |
| Elf2 | 037174 | 194209 | N/A |
| Elf2 | 037174 | 156983 | 141525 |
| Elf2 | 037174 | 163748 | 126871 |
| Elfn1 | 048988 | 050519 | 053869 |
| Elfn1 | 048988 | 198608 | N/A |
| Elmo2 | 017670 | 103091 | 099380 |
| Elmo2 | 017670 | 148643 | 117124 |
| Elmo2 | 017670 | 074046 | 073691 |
| Elmo2 | 017670 | 094329 | 091887 |
| Elmo2 | 017670 | 103088 | 099377 |
| Elmo2 | 017670 | 071699 | 071619 |
| Elmo2 | 017670 | 127496 | N/A |
| Elmo2 | 017670 | 137188 | 123232 |
| Elmo2 | 017670 | 149844 | N/A |
| Elmo2 | 017670 | 126318 | 116124 |
| Elmo2 | 017670 | 133205 | 119682 |
| Elmo2 | 017670 | 128690 | 114303 |
| Elmod1 | 041986 | 215313 | N/A |
| Elmod1 | 041986 | 048409 | 046191 |
| Elmod1 | 041986 | 216880 | N/A |
| Elmod1 | 041986 | 213111 | N/A |
| Elmod1 | 041986 | 166580 | 129082 |
| Elovl2 | 021364 | 021793 | 021793 |
| Elovl2 | 021364 | 117096 | 114112 |
| Elovl7 | 021696 | 022207 | 022207 |
| Elovl7 | 021696 | 225550 | 152997 |
| Emilin2 | 024053 | 024849 | 024849 |
| Eml5 | 051166 | 065716 | 065643 |
| Eml5 | 051166 | 223282 | 152709 |
| Eml5 | 051166 | 222717 | N/A |
| Eml5 | 051166 | 220848 | N/A |
| Eml5 | 051166 | 221107 | N/A |
| Eml5 | 051166 | 222097 | 152624 |
| Eml5 | 051166 | 222593 | N/A |
| Eml5 | 051166 | 221511 | N/A |
| Eml5 | 051166 | 220676 | N/A |
| Eml5 | 051166 | 222128 | 152401 |
| Emp2 | 022505 | 078357 | 077466 |
| En2 | 039095 | 036177 | 036761 |
| Enah | 022995 | 193703 | 141462 |
| Enah | 022995 | 111024 | 106653 |
| Enah | 022995 | 195703 | N/A |
| Enah | 022995 | 191649 | N/A |
| Enah | 022995 | 193074 | 141936 |
| Enah | 022995 | 078719 | 077781 |
| Enah | 022995 | 195059 | 141344 |

| ENSEMBL IDs for rats | | | |
|---|---|---|---|
| Symbol | MUSG | MUST | MUSP |
| Enah | 022995 | 111030 | 106659 |
| Enah | 022995 | 195788 | N/A |
| Enah | 022995 | 192768 | N/A |
| Enah | 022995 | 192967 | 141330 |
| Enah | 022995 | 195840 | N/A |
| Enah | 022995 | 195461 | N/A |
| Enah | 022995 | 192497 | N/A |
| Enah | 022995 | 177811 | 136863 |
| Enah | 022995 | 111025 | 106654 |
| Enc1 | 041773 | 041623 | 038783 |
| Enox1 | 022012 | 022589 | 022589 |
| Enox1 | 022012 | 226576 | N/A |
| Enox1 | 022012 | 228148 | N/A |
| Enox1 | 022012 | 228102 | N/A |
| Enox1 | 022012 | 227831 | 154296 |
| Enox1 | 022012 | 227662 | 154512 |
| Enox1 | 022012 | 228845 | N/A |
| Enpp1 | 037370 | 105520 | 101159 |
| Enpp1 | 037370 | 039882 | 046090 |
| Enpp1 | 037370 | 135846 | 114273 |
| Enpp1 | 037370 | 150570 | N/A |
| Enpp1 | 037370 | 142974 | N/A |
| Enpp2 | 022425 | 041591 | 036180 |
| Enpp2 | 022425 | 173516 | 133877 |
| Enpp2 | 022425 | 167541 | 132640 |
| Enpp2 | 022425 | 171545 | 128941 |
| Enpp2 | 022425 | 228823 | N/A |
| Enpp2 | 022425 | 227483 | N/A |
| Enpp2 | 022425 | 228222 | 154470 |
| Enpp2 | 022425 | 227057 | N/A |
| Enpp2 | 022425 | 226339 | 154729 |
| Enpp4 | 023961 | 024757 | 024757 |
| Enpp4 | 023961 | 143137 | 114429 |
| Enpp6 | 038173 | 039840 | 044608 |
| Enpp6 | 038173 | 140149 | N/A |
| Enpp6 | 038173 | 123066 | 147811 |
| Enpp6 | 038173 | 119686 | 112633 |
| Enpp6 | 038173 | 149593 | 121470 |
| Enpp6 | 038173 | 210466 | N/A |
| Epb41l4b | 028434 | 030142 | 030142 |
| Epb41l4b | 028434 | 095076 | 092687 |
| Epb41l4b | 028434 | 044022 | 037625 |
| Epb41l4b | 028434 | 136337 | N/A |
| Epb41l4b | 028434 | 133859 | N/A |
| Epb41l4b | 028434 | 149109 | N/A |
| Epb41l4b | 028434 | 150665 | N/A |
| Epha3 | 052504 | 064405 | 066554 |
| Epha4 | 026235 | 188952 | 139640 |
| Epha4 | 026235 | 188797 | 140954 |
| Epha4 | 026235 | 187346 | 140631 |
| Epha4 | 026235 | 190149 | 140408 |
| Epha4 | 026235 | 189934 | N/A |
| Epha4 | 026235 | 186930 | 140370 |
| Epha4 | 026235 | 027451 | 027451 |
| Ephb1 | 032537 | 035129 | 035129 |
| Ephb1 | 032537 | 085169 | 082261 |
| Ephb1 | 032537 | 217014 | N/A |
| Ephb1 | 032537 | 217184 | N/A |
| Ephb1 | 032537 | 215514 | N/A |
| Ephb1 | 032537 | 149800 | 139470 |
| Eps15 | 028552 | 102729 | 099790 |
| Eps15 | 028552 | 176251 | 135034 |
| Eps15 | 028552 | 177089 | 134922 |
| Eps15 | 028552 | 175776 | 135270 |
| Eps15 | 028552 | 132165 | 118949 |
| Eps15 | 028552 | 150755 | N/A |
| Eps15 | 028552 | 141751 | N/A |
| Eps15 | 028552 | 030281 | 030281 |
| Eps15 | 028552 | 126015 | N/A |
| Eps15 | 028552 | 177192 | 135755 |
| Eps15 | 028552 | 177140 | N/A |
| Erbb3 | 018166 | 082059 | 080716 |
| Erbb4 | 062209 | 119142 | 112713 |
| Erbb4 | 062209 | 121473 | 114123 |
| Erbb4 | 062209 | 153432 | 115373 |
| Erbb4 | 062209 | 131148 | N/A |

TABLE 3-continued

| ENSEMBL IDs for rats | | | |
|---|---|---|---|
| Symbol | MUSG | MUST | MUSP |
| Erbb4 | 062209 | 126682 | N/A |
| Erich5 | 044726 | 060894 | 058182 |
| Ermn | 026830 | 090940 | 088458 |
| Esrrb | 021255 | 116102 | 112103 |
| Esrrb | 021255 | 110203 | 105832 |
| Esrrb | 021255 | 110204 | 105833 |
| Esrrb | 021255 | 021680 | 021680 |
| Esrrb | 021255 | 167891 | 131335 |
| Esrrb | 021255 | 136464 | N/A |
| Esrrg | 026610 | 127489 | 119286 |
| Esrrg | 026610 | 110939 | 106564 |
| Esrrg | 026610 | 152927 | N/A |
| Esrrg | 026610 | 027906 | 027906 |
| Esrrg | 026610 | 110938 | 106563 |
| Etl4 | 036617 | 114610 | 110257 |
| Etl4 | 036617 | 146881 | 119778 |
| Etl4 | 036617 | 131714 | 116637 |
| Etl4 | 036617 | 045555 | 041431 |
| Etl4 | 036617 | 114614 | 110261 |
| Etl4 | 036617 | 114604 | 110251 |
| Etl4 | 036617 | 146613 | N/A |
| Etl4 | 036617 | 066509 | 066170 |
| Etl4 | 036617 | 129278 | N/A |
| Etl4 | 036617 | 123383 | N/A |
| Etl4 | 036617 | 136870 | N/A |
| Etl4 | 036617 | 125556 | N/A |
| Etl4 | 036617 | 146488 | N/A |
| Etl4 | 036617 | 125772 | N/A |
| Etl4 | 036617 | 114607 | 110254 |
| Etl4 | 036617 | 114606 | 110253 |
| Etl4 | 036617 | 114608 | 110255 |
| Etl4 | 036617 | 139531 | N/A |
| Etl4 | 036617 | 156587 | N/A |
| Etl4 | 036617 | 114627 | 110274 |
| Etnppl | 019232 | 166187 | 131294 |
| Etnppl | 019232 | 072271 | 072121 |
| Etnppl | 019232 | 199940 | N/A |
| Etnppl | 019232 | 172432 | N/A |
| Etnppl | 019232 | 163620 | 129120 |
| Etnppl | 019232 | 170664 | 128425 |
| Etv1 | 004151 | 160244 | 125733 |
| Etv1 | 004151 | 095767 | 093442 |
| Etv1 | 004151 | 162563 | 125157 |
| Etv1 | 004151 | 161164 | 124650 |
| Etv1 | 004151 | 160996 | 124705 |
| Etv1 | 004151 | 160856 | 125692 |
| Etv1 | 004151 | 162730 | N/A |
| Etv1 | 004151 | 161513 | 124166 |
| Etv1 | 004151 | 161980 | 124736 |
| Etv1 | 004151 | 160701 | 124019 |
| Etv1 | 004151 | 159334 | 125676 |
| Etv1 | 004151 | 220492 | N/A |
| Etv1 | 004151 | 161591 | N/A |
| Etv4 | 017724 | 107176 | 102794 |
| Etv4 | 017724 | 017868 | 017868 |
| Etv4 | 017724 | 132040 | N/A |
| Etv4 | 017724 | 129160 | N/A |
| Etv4 | 017724 | 131862 | N/A |
| Etv4 | 017724 | 129995 | N/A |
| Etv4 | 017724 | 140970 | N/A |
| Etv4 | 017724 | 131117 | N/A |
| Etv4 | 017724 | 149099 | N/A |
| Etv4 | 017724 | 137179 | N/A |
| Etv4 | 017724 | 154512 | N/A |
| Etv4 | 017724 | 164750 | 129261 |
| Etv5 | 013089 | 079601 | 078551 |
| Etv5 | 013089 | 168774 | 131791 |
| Etv5 | 013089 | 170803 | 128338 |
| Etv5 | 013089 | 165506 | N/A |
| Etv5 | 013089 | 170393 | 132210 |
| Eva1a | 035104 | 150976 | 122674 |
| Eva1a | 035104 | 042974 | 037422 |
| Eva1a | 035104 | 150691 | N/A |
| Eva1a | 035104 | 149023 | 117345 |
| Exph5 | 034584 | 051014 | 062632 |
| Exph5 | 034584 | 139096 | N/A |

TABLE 3-continued

| ENSEMBL IDs for rats | | | |
|---|---|---|---|
| Symbol | MUSG | MUST | MUSP |
| Exph5 | 034584 | 132410 | N/A |
| Extl2 | 027963 | 029575 | 029575 |
| Extl2 | 027963 | 106501 | 102110 |
| Extl2 | 027963 | 128228 | N/A |
| Extl2 | 027963 | 145945 | N/A |
| Extl2 | 027963 | 149920 | N/A |
| Extl2 | 027963 | 106502 | 102111 |
| Eya1 | 025932 | 168081 | 126383 |
| Eya1 | 025932 | 080664 | 079493 |
| Eya1 | 025932 | 190337 | 141112 |
| Eya1 | 025932 | 189526 | 140619 |
| Eya1 | 025932 | 188857 | 140171 |
| Eya1 | 025932 | 185453 | 141072 |
| Eya1 | 025932 | 187790 | 139542 |
| Eya1 | 025932 | 185329 | N/A |
| Eya1 | 025932 | 027066 | 027066 |
| F3 | 028128 | 029771 | 029771 |
| F3 | 028128 | 196746 | N/A |
| F3 | 028128 | 197731 | N/A |
| F3 | 028128 | 199997 | 143678 |
| Fa2h | 033579 | 038475 | 043597 |
| Fa2h | 033579 | 162463 | N/A |
| Fa2h | 033579 | 159336 | N/A |
| Fa2h | 033579 | 162216 | N/A |
| Fam102a | 039157 | 136816 | N/A |
| Fam102a | 039157 | 133512 | 116809 |
| Fam102a | 039157 | 048375 | 044731 |
| Fam102a | 039157 | 133366 | 118624 |
| Fam102a | 039157 | 147723 | N/A |
| Fam107b | 026655 | 226435 | 154419 |
| Fam107b | 026655 | 115052 | 110704 |
| Fam107b | 026655 | 115055 | 110707 |
| Fam107b | 026655 | 115054 | 110706 |
| Fam107b | 026655 | 027965 | 027965 |
| Fam107b | 026655 | 115053 | 110705 |
| Fam107b | 026655 | 177125 | 135757 |
| Fam107b | 026655 | 177037 | 135325 |
| Fam107b | 026655 | 176254 | 135846 |
| Fam114a1 | 029185 | 031080 | 031080 |
| Fam114a1 | 029185 | 139366 | 119284 |
| Fam117a | 038893 | 037502 | 049162 |
| Fam117a | 038893 | 129553 | N/A |
| Fam117a | 038893 | 143482 | N/A |
| Fam117a | 038893 | 129290 | N/A |
| Fam117a | 038893 | 155999 | N/A |
| Fam117a | 038893 | 132357 | N/A |
| Fam124a | 035184 | 162987 | N/A |
| Fam124a | 035184 | 161899 | N/A |
| Fam124a | 035184 | 039064 | 047681 |
| Fam124a | 035184 | 160745 | N/A |
| Retreg1 | 022270 | 022881 | 022881 |
| Retreg1 | 022270 | 228600 | 154407 |
| Retreg1 | 022270 | 228327 | 154377 |
| Retreg1 | 022270 | 227275 | 154471 |
| Retreg1 | 022270 | 226750 | 154791 |
| Retreg1 | 022270 | 226438 | 154765 |
| Retreg1 | 022270 | 110438 | 106068 |
| Retreg1 | 022270 | 228306 | 154070 |
| Fam171b | 048388 | 051454 | 062702 |
| Fam171b | 048388 | 148184 | N/A |
| Fam196a | 073805 | 210055 | N/A |
| Fam196a | 073805 | 171394 | 129222 |
| Fam196a | 073805 | 210826 | N/A |
| Fam198b | 027955 | 118853 | 114093 |
| Fam198b | 027955 | 145992 | 120603 |
| Fam198b | 027955 | 135021 | 117199 |
| Fam198b | 027955 | 193204 | N/A |
| Fam198b | 027955 | 029567 | 029567 |
| Fam19a1 | 059187 | 122120 | 113152 |
| Fam19a1 | 059187 | 075080 | 074589 |
| Fam19a1 | 059187 | 129844 | N/A |
| Fam19a1 | 059187 | 125951 | N/A |
| Fam19a4 | 046500 | 089295 | 086710 |
| Fam19a4 | 046500 | 203930 | N/A |
| Fam20a | 020614 | 155559 | 116687 |
| Fam20a | 020614 | 020938 | 020938 |

TABLE 3-continued

ENSEMBL IDs for rats

| Symbol | MUSG | MUST | MUSP |
|---|---|---|---|
| Fam20a | 020614 | 146408 | N/A |
| Fam20a | 020614 | 144972 | N/A |
| Fam222b | 037750 | 073705 | 073384 |
| Fam222b | 037750 | 100782 | 126620 |
| Fam222b | 037750 | 155571 | 121832 |
| Fam46a | 032265 | 034802 | 034802 |
| Fam46a | 032265 | 187711 | 140869 |
| Fam49b | 022378 | 063838 | 066359 |
| Fam49b | 022378 | 164532 | 132486 |
| Fam49b | 022378 | 228226 | 154320 |
| Fam49b | 022378 | 228908 | 154547 |
| Fam49b | 022378 | 227024 | 153790 |
| Fam49b | 022378 | 226675 | 154205 |
| Fam49b | 022378 | 227118 | N/A |
| Fam49b | 022378 | 226129 | N/A |
| Fam69a | 029270 | 031198 | 031198 |
| Fam69a | 029270 | 145239 | 117801 |
| Fam69a | 029270 | 153172 | 114892 |
| Fam84a | 020607 | 020926 | 020926 |
| Fam84a | 020607 | 221405 | 152642 |
| Fam89a | 043068 | 055257 | 058156 |
| Fam92b | 042269 | 048786 | 038825 |
| Fam92b | 042269 | 153177 | N/A |
| Fam92b | 042269 | 135567 | 134033 |
| Fam92b | 042478 | 142478 | N/A |
| Fat1 | 070047 | 191428 | 140596 |
| Fat1 | 070047 | 189017 | 140765 |
| Fat1 | 070047 | 215588 | 149194 |
| Fat1 | 070047 | 186342 | 139921 |
| Fat1 | 070047 | 189367 | N/A |
| Fat1 | 070047 | 098796 | 096394 |
| Fat2 | 055333 | 068853 | 067556 |
| Fat2 | 055333 | 108864 | 104492 |
| Fbln2 | 064080 | 113498 | 109126 |
| Fbln2 | 064080 | 041544 | 048334 |
| Fbln2 | 064080 | 153364 | 120101 |
| Fbln2 | 064080 | 132021 | 116456 |
| Fbln2 | 064080 | 203406 | N/A |
| Fbln2 | 064080 | 134974 | 116302 |
| Fbln2 | 064080 | 147371 | N/A |
| Fbln2 | 064080 | 134286 | N/A |
| Fbln2 | 064080 | 137029 | N/A |
| Fbn1 | 027204 | 028633 | 028633 |
| Fbn1 | 027204 | 148272 | N/A |
| Fbn1 | 027204 | 103234 | 099524 |
| Fbn2 | 024598 | 025497 | 025497 |
| Fchsd2 | 030691 | 208439 | 146962 |
| Fchsd2 | 030691 | 032931 | 032931 |
| Fchsd2 | 030691 | 098250 | 095850 |
| Fchsd2 | 030691 | 137196 | N/A |
| Fchsd2 | 030691 | 145802 | N/A |
| Fchsd2 | 030691 | 142727 | N/A |
| Fchsd2 | 030691 | 130426 | N/A |
| Fchsd2 | 030691 | 208063 | N/A |
| Fchsd2 | 030691 | 151693 | N/A |
| Fchsd2 | 030691 | 208638 | N/A |
| Fchsd2 | 030691 | 208917 | N/A |
| Fezf2 | 021743 | 224714 | 153090 |
| Fezf2 | 021743 | 022262 | 022262 |
| Fezf2 | 021743 | 224023 | 153647 |
| Fgd3 | 037946 | 110087 | 105714 |
| Fgd3 | 037946 | 048716 | 048692 |
| Fgd3 | 037946 | 110086 | 105713 |
| Fgd4 | 022788 | 161861 | 125174 |
| Fgd4 | 022788 | 162671 | 125736 |
| Fgd4 | 022788 | 069284 | 069573 |
| Fgd4 | 022788 | 172181 | N/A |
| Fgd4 | 022788 | 162045 | N/A |
| Fgd4 | 022788 | 162124 | N/A |
| Fgd4 | 022788 | 159542 | 125649 |
| Fgd4 | 022788 | 159058 | N/A |
| Fgd4 | 022788 | 162414 | N/A |
| Fgd4 | 022788 | 162542 | N/A |
| Fgd4 | 022788 | 161624 | N/A |
| Fgd4 | 022788 | 161188 | 123763 |
| Fgd6 | 020021 | 020208 | 020208 |

TABLE 3-continued

ENSEMBL IDs for rats

| Symbol | MUSG | MUST | MUSP |
|---|---|---|---|
| Fgd6 | 020021 | 141143 | N/A |
| Fgd6 | 020021 | 125535 | N/A |
| Fgf13 | 031137 | 033473 | 033473 |
| Fgf13 | 031137 | 138503 | N/A |
| Fgf13 | 031137 | 123660 | N/A |
| Fgf13 | 031137 | 124402 | 114905 |
| Fgf13 | 031137 | 145767 | 119897 |
| Fgf13 | 031137 | 119833 | 113639 |
| Fgf13 | 031137 | 131319 | 115765 |
| Fgf13 | 031137 | 119306 | 113206 |
| Fgf13 | 031137 | 150413 | N/A |
| Fgfr1 | 031565 | 155564 | 117884 |
| Fgfr1 | 031565 | 084027 | 081041 |
| Fgfr1 | 031565 | 119398 | 113855 |
| Fgfr1 | 031565 | 117179 | 113909 |
| Fgfr1 | 031565 | 148322 | N/A |
| Fgfr1 | 031565 | 210778 | N/A |
| Fgfr1 | 031565 | 124228 | 116564 |
| Fgfr1 | 031565 | 210846 | 148032 |
| Fgfr1 | 031565 | 167764 | 131343 |
| Fgfr1 | 031565 | 138104 | 148135 |
| Fgfr1 | 031565 | 138455 | 147898 |
| Fgfr1 | 031565 | 126118 | N/A |
| Fgfr1 | 031565 | 210504 | N/A |
| Fgfr1 | 031565 | 120106 | N/A |
| Fgfr1 | 031565 | 211419 | N/A |
| Fgfr1 | 031565 | 145218 | N/A |
| Fgfr1 | 031565 | 133936 | N/A |
| Fgfr1 | 031565 | 179592 | 136640 |
| Fgfr1 | 031565 | 178276 | 137515 |
| Fgfr2 | 030849 | 120187 | 113248 |
| Fgfr2 | 030849 | 124096 | 130971 |
| Fgfr2 | 030849 | 153166 | 120100 |
| Fgfr2 | 030849 | 117872 | 113994 |
| Fgfr2 | 030849 | 130557 | N/A |
| Fgfr2 | 030849 | 122054 | 112430 |
| Fgfr2 | 030849 | 136264 | N/A |
| Fgfr2 | 030849 | 121064 | 113452 |
| Fgfr2 | 030849 | 117754 | 113187 |
| Fgfr2 | 030849 | 120715 | 113474 |
| Fgfr2 | 030849 | 119260 | 113010 |
| Fgfr2 | 030849 | 117089 | 112992 |
| Fgfr2 | 030849 | 117691 | 113180 |
| Fgfr2 | 030849 | 117858 | 112623 |
| Fgfr2 | 030849 | 120141 | 113415 |
| Fgfr2 | 030849 | 117357 | 112580 |
| Fgfr2 | 030849 | 122448 | 113993 |
| Fgfr2 | 030849 | 118296 | 112471 |
| Fgfr2 | 030849 | 121080 | 112585 |
| Fgfr2 | 030849 | 117073 | 112672 |
| Fgfr2 | 030849 | 129542 | N/A |
| Fgfr2 | 030849 | 147859 | N/A |
| Fgfr2 | 030849 | 133806 | N/A |
| Fgfr2 | 030849 | 148675 | N/A |
| Fgfr2 | 030849 | 127091 | 122856 |
| Fgfr2 | 030849 | 129103 | N/A |
| Fgfr2 | 030849 | 208844 | N/A |
| Fgfr3 | 054252 | 201437 | 144379 |
| Fgfr3 | 054252 | 067150 | 070998 |
| Fgfr3 | 054252 | 164207 | 133064 |
| Fgfr3 | 054252 | 087820 | 085122 |
| Fgfr3 | 054252 | 202182 | 143936 |
| Fgfr3 | 054252 | 134610 | N/A |
| Fgfr3 | 054252 | 155002 | 119941 |
| Fgfr3 | 054252 | 181298 | 143963 |
| Fgfr3 | 054252 | 132724 | N/A |
| Fgfr3 | 054252 | 201295 | 144104 |
| Fgfr3 | 054252 | 202791 | 143797 |
| Fgfr3 | 054252 | 152661 | N/A |
| Fgfr3 | 054252 | 142860 | N/A |
| Fgfr3 | 054252 | 202138 | 143945 |
| Fgfr3 | 054252 | 169212 | 130856 |
| Fgfr3 | 054252 | 114411 | 110053 |
| Fgfr3 | 054252 | 171509 | 131845 |
| Fggy | 028573 | 079223 | 078216 |
| Fggy | 028573 | 176162 | N/A |

TABLE 3-continued

| ENSEMBL IDs for rats | | | |
|---|---|---|---|
| Symbol | MUSG | MUST | MUSP |
| Fggy | 028573 | 141248 | N/A |
| Fggy | 028573 | 177394 | 134881 |
| Fggy | 028573 | 043335 | 043460 |
| Fggy | 028573 | 147783 | N/A |
| Fggy | 028573 | 150830 | 115546 |
| Fggy | 028573 | 134012 | 115859 |
| Fggy | 028573 | 131654 | 116264 |
| Fggy | 028573 | 107091 | 102706 |
| Fggy | 028573 | 176840 | N/A |
| Fggy | 028573 | 147766 | N/A |
| Fggy | 028573 | 143742 | 117386 |
| Fggy | 028573 | 125742 | N/A |
| Fggy | 028573 | 153119 | N/A |
| Fggy | 028573 | 130541 | 115688 |
| Fggy | 028573 | 156223 | 118147 |
| Fggy | 028573 | 142384 | 123407 |
| Fhl3 | 032643 | 106199 | 101805 |
| Fhl3 | 032643 | 145942 | 121702 |
| Fhl3 | 032643 | 038684 | 040150 |
| Fhl5 | 028259 | 029922 | 029922 |
| Fhl5 | 028259 | 108204 | 103839 |
| Fign | 075324 | 131615 | 122855 |
| Fign | 075324 | 102728 | 124338 |
| Fign | 075324 | 153538 | N/A |
| Fign | 075324 | 126042 | N/A |
| Filip1l | 043336 | 159816 | 124179 |
| Filip1l | 043336 | 099667 | 133232 |
| Filip1l | 043336 | 159414 | 124069 |
| Fli1 | 016087 | 016231 | 016231 |
| Fli1 | 016087 | 183767 | 138984 |
| Flrt2 | 047414 | 057324 | 062171 |
| Flrt2 | 047414 | 110117 | 105744 |
| Flt3 | 042817 | 049324 | 039041 |
| Flt3 | 042817 | 110549 | N/A |
| Fmnl1 | 055805 | 042286 | 046296 |
| Fmnl1 | 055805 | 218163 | 151439 |
| Fmnl1 | 055805 | 107027 | 102642 |
| Fmnl1 | 055805 | 126425 | N/A |
| Fmnl1 | 055805 | 154871 | N/A |
| Fmnl1 | 055805 | 021322 | N/A |
| Fmnl1 | 055805 | 129726 | 133299 |
| Fmo3 | 026691 | 028010 | 028010 |
| Fmo3 | 026691 | 142759 | N/A |
| Fndc3b | 039286 | 195008 | 141620 |
| Fndc3b | 039286 | 046157 | 041495 |
| Fndc3b | 039286 | 191684 | N/A |
| Fndc3b | 039286 | 193779 | 141888 |
| Folh1 | 001773 | 001824 | 001824 |
| Folh1 | 001773 | 107271 | 102892 |
| Folh1 | 001773 | 209082 | N/A |
| Fosb | 003545 | 003640 | 003640 |
| Fosb | 003545 | 207334 | 147210 |
| Fosb | 003545 | 208505 | 146525 |
| Fosb | 003545 | 207716 | 146949 |
| Fosb | 003545 | 208326 | 146569 |
| Fosb | 003545 | 208446 | 146789 |
| Fosb | 003545 | 208230 | N/A |
| Foxa1 | 035451 | 044380 | 041118 |
| Foxa1 | 035451 | 218398 | N/A |
| Foxa2 | 037025 | 109964 | 105590 |
| Foxa2 | 037025 | 047315 | 045918 |
| Foxa2 | 037025 | 172928 | 134081 |
| Foxa2 | 037025 | 146242 | N/A |
| Foxg1 | 020950 | 135006 | N/A |
| Foxg1 | 020950 | 154930 | N/A |
| Foxg1 | 020950 | 179669 | 136372 |
| Foxg1 | 021333 | 021333 | 021333 |
| Foxh1 | 033837 | 037824 | 036591 |
| Foxp4 | 023991 | 113265 | 108890 |
| Foxp4 | 023991 | 113263 | 108888 |
| Foxp4 | 023991 | 097311 | 094916 |
| Foxp4 | 023991 | 113262 | 108887 |
| Foxp4 | 023991 | 136314 | N/A |
| Foxp4 | 023991 | 154108 | N/A |
| Foxp4 | 023991 | 137039 | N/A |
| Foxp4 | 023991 | 153752 | N/A |

TABLE 3-continued

| ENSEMBL IDs for rats | | | |
|---|---|---|---|
| Symbol | MUSG | MUST | MUSP |
| Frem1 | 059049 | 107230 | 102849 |
| Frem1 | 059049 | 127886 | 122467 |
| Frem1 | 059049 | 131102 | N/A |
| Frem1 | 059049 | 130889 | N/A |
| Frem1 | 059049 | 141841 | N/A |
| Frem1 | 059049 | 133610 | N/A |
| Frem1 | 059049 | 071708 | 071627 |
| Frem1 | 059049 | 170248 | 125809 |
| Frmd3 | 049122 | 084474 | 081514 |
| Frmd3 | 049122 | 098006 | 095615 |
| Frmd3 | 049122 | 154134 | N/A |
| Frmd4a | 026657 | 138735 | N/A |
| Frmd4a | 026657 | 137809 | N/A |
| Frmd4a | 026657 | 177457 | 134788 |
| Frmd4a | 026657 | 132710 | N/A |
| Frmd4a | 026657 | 091497 | 089079 |
| Frmd4a | 026657 | 175669 | 135306 |
| Frmd4a | 026657 | 147156 | N/A |
| Frmd4a | 026657 | 176803 | 135432 |
| Frmd4a | 026657 | 175944 | 135686 |
| Frmd4a | 026657 | 115037 | 110689 |
| Frmd4a | 026657 | 141746 | N/A |
| Frmd4a | 026657 | 075767 | 075172 |
| Frmd4a | 026657 | 176962 | N/A |
| Frmd4a | 026657 | 115039 | N/A |
| Frmd4a | 026657 | 123919 | N/A |
| Frmd4a | 026657 | 153160 | N/A |
| Frmd4a | 026657 | 176828 | 134803 |
| Frmd4a | 026657 | 142452 | N/A |
| Frmd4a | 026657 | 176864 | 135057 |
| Frmd4b | 030064 | 113355 | 108982 |
| Frmd4b | 030064 | 203486 | N/A |
| Frmd4b | 030064 | 143698 | N/A |
| Frmd4b | 030064 | 113359 | 108986 |
| Frmd4b | 030064 | 032146 | 032146 |
| Frmd4b | 030064 | 146191 | N/A |
| Frmd4b | 030064 | 155326 | N/A |
| Frmd4b | 030064 | 138301 | N/A |
| Frmd4b | 030064 | 152385 | N/A |
| Frmd4b | 030064 | 113353 | N/A |
| Frmd4b | 030064 | 142589 | N/A |
| Frmd4b | 030064 | 126899 | N/A |
| Frmd4b | 030064 | 124050 | 145240 |
| Frmpd1 | 035615 | 107804 | 103434 |
| Frmpd1 | 035615 | 134280 | 118757 |
| Frmpd1 | 035615 | 044773 | 047232 |
| Frmpd2 | 108841 | 208853 | 146522 |
| Frmpd2 | 108841 | 208577 | 146693 |
| Frmpd2 | 108841 | 207581 | N/A |
| Frmpd2 | 108841 | 208380 | N/A |
| Frmpd4 | 049176 | 112149 | 107777 |
| Frmpd4 | 049176 | 112146 | 107774 |
| Frmpd4 | 049176 | 112147 | 107775 |
| Frmpd4 | 049176 | 112145 | 107773 |
| Frrs1 | 033386 | 040260 | 039487 |
| Frrs1 | 033386 | 199626 | 143546 |
| Frrs1 | 033386 | 195905 | 143255 |
| Frrs1 | 033386 | 199584 | N/A |
| Frrs1 | 033386 | 197323 | N/A |
| Frrs1 | 033386 | 199030 | 142793 |
| Frrs1l | 045589 | 053681 | 052507 |
| Frrs1l | 045589 | 128276 | 121657 |
| Fry | 056602 | 200960 | 144674 |
| Fry | 056602 | 202530 | 144277 |
| Fry | 056602 | 203000 | N/A |
| Fry | 056602 | 202600 | 144317 |
| Fry | 056602 | 201854 | N/A |
| Fry | 056602 | 087204 | 084454 |
| Fry | 056602 | 202841 | N/A |
| Fry | 056602 | 200964 | N/A |
| Fry | 056602 | 202630 | N/A |
| Fry | 056602 | 201634 | N/A |
| Fry | 056602 | 202566 | 144657 |
| Fry | 056602 | 200863 | 143845 |
| Fry | 056602 | 201196 | N/A |
| Fry | 056602 | 202070 | N/A |

TABLE 3-continued

| ENSEMBL IDs for rats | | | |
|---|---|---|---|
| Symbol | MUSG | MUST | MUSP |
| Fry | 056602 | 200750 | N/A |
| Fry | 056602 | 202571 | N/A |
| Fry | 056602 | 201628 | N/A |
| Fsip2 | 075249 | 143764 | 120314 |
| Fsip2 | 075249 | 136202 | 114196 |
| Fsip2 | 075249 | 132967 | 122350 |
| Fstl5 | 034098 | 038364 | 038506 |
| Fstl5 | 034098 | 159686 | N/A |
| Fstl5 | 034098 | 160261 | 125393 |
| Fstl5 | 034098 | 191664 | N/A |
| Fstl5 | 034098 | 162471 | 125688 |
| Fth1 | 024661 | 025563 | 025563 |
| Fxyd1 | 036570 | 206328 | 145712 |
| Fxyd1 | 036570 | 205807 | 145990 |
| Fxyd1 | 036570 | 205917 | N/A |
| Fxyd1 | 036570 | 206012 | 146295 |
| Fxyd1 | 036570 | 206305 | 145589 |
| Fxyd1 | 036570 | 206030 | 146129 |
| Fxyd1 | 036570 | 206317 | N/A |
| Fxyd1 | 036570 | 205778 | 145818 |
| Fxyd1 | 036570 | 108110 | 103745 |
| Fxyd1 | 036570 | 206860 | 146288 |
| Fxyd1 | 036570 | 206474 | 145920 |
| Fxyd1 | 036570 | 071697 | 071617 |
| Fxyd1 | 036570 | 205439 | 146064 |
| Fxyd1 | 036570 | 205542 | N/A |
| Fxyd1 | 036570 | 206522 | N/A |
| Fxyd1 | 036570 | 205392 | N/A |
| Fxyd1 | 036570 | 039909 | 048460 |
| Fxyd7 | 036578 | 206341 | 146171 |
| Fxyd7 | 036578 | 073892 | 073555 |
| Fzd9 | 049551 | 062572 | 053551 |
| Gab2 | 004508 | 004622 | 004622 |
| Gab2 | 004508 | 206791 | 146200 |
| Gabra2 | 000560 | 197284 | 142892 |
| Gabra2 | 000560 | 198625 | 143645 |
| Gabra2 | 000560 | 197124 | N/A |
| Gabra2 | 000560 | 000572 | 000572 |
| Gabra2 | 000560 | 199861 | N/A |
| Gabra2 | 000560 | 199012 | N/A |
| Gabra4 | 029211 | 031121 | 031121 |
| Gabra4 | 029211 | 199357 | 143675 |
| Gabra4 | 029211 | 197994 | 143063 |
| Gabra4 | 029211 | 198138 | 142466 |
| Gabra4 | 029211 | 199150 | N/A |
| Gabra6 | 020428 | 020703 | 020703 |
| Gabra6 | 020428 | 155218 | 126114 |
| Gabra6 | 020428 | 109286 | 104909 |
| Gabrb1 | 029212 | 199967 | 143682 |
| Gabrb1 | 029212 | 031122 | 031122 |
| Gabrd | 029054 | 150423 | N/A |
| Gabrd | 029054 | 030925 | 030925 |
| Gabrd | 029054 | 129892 | N/A |
| Gabrg2 | 020436 | 070725 | 064739 |
| Gabrg2 | 020436 | 070735 | 063812 |
| Gabrg2 | 020436 | 146198 | N/A |
| Gabrg2 | 020436 | 109290 | 104913 |
| Gabrg3 | 055026 | 068911 | 067632 |
| Gabrg3 | 055026 | 068394 | 065255 |
| Gabrg3 | 055026 | 171965 | N/A |
| Gad1 | 070880 | 094934 | 092539 |
| Gad1 | 070880 | 130604 | 117721 |
| Gad1 | 070880 | 148210 | 119733 |
| Gad1 | 070880 | 130998 | 119379 |
| Gad1 | 070880 | 155979 | N/A |
| Gad1 | 070880 | 140478 | N/A |
| Gad1 | 070880 | 130618 | 117521 |
| Gad1 | 070880 | 123330 | 116301 |
| Gad2 | 026787 | 028123 | 028123 |
| Gad2 | 026787 | 156728 | N/A |
| Gal3st1 | 049721 | 078757 | 077815 |
| Gal3st1 | 049721 | 063004 | 058348 |
| Gal3st1 | 049721 | 109981 | 105608 |
| Galnt14 | 024064 | 024858 | 024858 |
| Galnt14 | 024064 | 146565 | N/A |
| Galnt14 | 024064 | 112591 | 108210 |

TABLE 3-continued

| ENSEMBL IDs for rats | | | |
|---|---|---|---|
| Symbol | MUSG | MUST | MUSP |
| Galnt15 | 021903 | 022460 | 022460 |
| Galnt15 | 021903 | 164208 | 131978 |
| Galnt16 | 021130 | 219993 | 151829 |
| Galnt16 | 021130 | 218943 | 151619 |
| Galnt16 | 021130 | 021558 | 021558 |
| Galnt16 | 021130 | 218648 | N/A |
| Galnt16 | 021130 | 217926 | 151370 |
| Galnt16 | 021130 | 219267 | 151800 |
| Galnt18 | 038296 | 049430 | 043636 |
| Galnt18 | 038296 | 106663 | 102274 |
| Galnt3 | 026994 | 028378 | 028378 |
| Galnt3 | 026994 | 153563 | N/A |
| Galnt3 | 026994 | 150793 | N/A |
| Galnt3 | 026994 | 155453 | N/A |
| Galnt5 | 026828 | 112616 | 108235 |
| Galnt5 | 026828 | 144671 | N/A |
| Galnt5 | 026828 | 166729 | 131362 |
| Galnt6 | 037280 | 159715 | 123848 |
| Galnt6 | 037280 | 052069 | 056705 |
| Galnt6 | 037280 | 161514 | 124793 |
| Galntl6 | 096914 | 204128 | 145321 |
| Galntl6 | 096914 | 204067 | 145016 |
| Galntl6 | 096914 | 204937 | N/A |
| Galntl6 | 096914 | 077447 | N/A |
| Galntl6 | 096914 | 146513 | 118306 |
| Galntl6 | 096914 | 125865 | N/A |
| Galntl6 | 096914 | 203398 | 145298 |
| Galntl6 | 096914 | 188531 | 139677 |
| Galntl6 | 096914 | 098757 | 096353 |
| Galr1 | 024553 | 065224 | 066381 |
| Gapdh | 057666 | 192506 | N/A |
| Gapdh | 057666 | 147954 | N/A |
| Gapdh | 057666 | 117757 | 113942 |
| Gapdh | 057666 | 118875 | 113213 |
| Gapdh | 057666 | 183272 | 138508 |
| Gapdh | 057666 | 182464 | N/A |
| Gapdh | 057666 | 144205 | N/A |
| Gapdh | 057666 | 182115 | N/A |
| Gapdh | 057666 | 182052 | 138403 |
| Gapdh | 057666 | 182277 | 138295 |
| Gapdh | 057666 | 182670 | N/A |
| Gapdh | 057666 | 144588 | N/A |
| Gapdh | 057666 | 073605 | 073289 |
| Garem2 | 044576 | 058045 | 054208 |
| Garnl3 | 038860 | 102810 | 099874 |
| Garnl3 | 038860 | 049618 | 057582 |
| Garnl3 | 038860 | 137381 | 122576 |
| Garnl3 | 038860 | 153717 | N/A |
| Garnl3 | 038860 | 139778 | N/A |
| Garnl3 | 038860 | 193171 | 142077 |
| Garnl3 | 038860 | 150242 | N/A |
| Garnl3 | 038860 | 135296 | N/A |
| Garnl3 | 038860 | 148043 | N/A |
| Garnl3 | 038860 | 133135 | 119973 |
| Garnl3 | 038860 | 127509 | 141523 |
| Garnl3 | 038860 | 124000 | 123601 |
| Gas1 | 052957 | 065086 | 064555 |
| Gas1 | 052957 | 223933 | 153311 |
| Gatm | 027199 | 028624 | 028624 |
| Gatm | 027199 | 154598 | N/A |
| Gatm | 027199 | 140808 | N/A |
| Gatm | 111138 | 215775 | 150264 |
| Gatm | 111138 | 214872 | N/A |
| Gatm | 111138 | 214402 | N/A |
| Gatsl2 | 015944 | 016088 | 016088 |
| Gatsl2 | 015944 | 201013 | N/A |
| Gatsl2 | 015944 | 140240 | N/A |
| Gca | 026893 | 028257 | 028257 |
| Gca | 026893 | 148083 | N/A |
| Gda | 058624 | 087600 | 084882 |
| Gda | 058624 | 136258 | N/A |
| Gda | 058624 | 121725 | 112758 |
| Gdf10 | 021943 | 168727 | 128621 |
| Gfap | 020932 | 067444 | 064691 |
| Gfap | 020932 | 127909 | N/A |
| Gfap | 020932 | 077902 | 077061 |

TABLE 3-continued

ENSEMBL IDs for rats

| Symbol | MUSG | MUST | MUSP |
|---|---|---|---|
| Gfra2 | 022103 | 022699 | 022699 |
| Gfra2 | 022103 | 227697 | 154391 |
| Gfra2 | 022103 | 227633 | 153937 |
| Ghitm | 041028 | 165649 | 129712 |
| Ghitm | 041028 | 042564 | 046212 |
| Ghitm | 041028 | 224769 | 153458 |
| Ghitm | 041028 | 223921 | N/A |
| Ghr | 055737 | 069451 | 069457 |
| Ghr | 055737 | 161561 | 124064 |
| Ghr | 055737 | 110698 | 106326 |
| Ghr | 055737 | 110697 | 106325 |
| Ghr | 055737 | 161770 | 125044 |
| Ghr | 055737 | 160343 | N/A |
| Ghr | 055737 | 162993 | N/A |
| Ghr | 055737 | 159508 | N/A |
| Ghr | 055737 | 161180 | N/A |
| Ghr | 055737 | 159912 | N/A |
| Gipc2 | 039131 | 152283 | N/A |
| Gipc2 | 039131 | 046614 | 037328 |
| Gipc2 | 039131 | 128741 | N/A |
| Gipc2 | 039131 | 130196 | N/A |
| Gipc2 | 039131 | 152680 | N/A |
| Gipc2 | 039131 | 200501 | N/A |
| Gipc2 | 039131 | 133672 | N/A |
| Gipc2 | 039131 | 197813 | N/A |
| Gipc2 | 039131 | 133102 | N/A |
| Gipr | 030406 | 094790 | 092384 |
| Gipr | 030406 | 206857 | N/A |
| Gipr | 030406 | 206971 | 145860 |
| Gipr | 030406 | 206137 | N/A |
| Gja1 | 050953 | 068581 | 061536 |
| Gja1 | 050953 | 218760 | N/A |
| Gja1 | 050953 | 217789 | 151596 |
| Gja1 | 050953 | 220204 | N/A |
| Gja1 | 050953 | 220194 | 151603 |
| Gja1 | 050953 | 218834 | 151647 |
| Gja1 | 050953 | 218444 | 151974 |
| Gja1 | 050953 | 220069 | 151620 |
| Gjb1 | 047797 | 119080 | 113904 |
| Gjb1 | 047797 | 052130 | 062723 |
| Gjb1 | 047797 | 119190 | 113516 |
| Gjb6 | 040055 | 039380 | 035630 |
| Gjb6 | 040055 | 224544 | N/A |
| Gjb6 | 040055 | 160703 | 124927 |
| Gjb6 | 040055 | 162931 | N/A |
| Gjc2 | 043448 | 108793 | 104421 |
| Gjc2 | 043448 | 108790 | 104418 |
| Gjc3 | 056966 | 077119 | 076367 |
| Gjc3 | 056966 | 199083 | N/A |
| Gjd2 | 068615 | 090275 | 087742 |
| Slc1a3 | 005360 | 005493 | 005493 |
| Slc1a3 | 005360 | 125997 | N/A |
| Slc1a3 | 005360 | 128879 | N/A |
| Slc1a3 | 005360 | 153455 | N/A |
| Slc1a3 | 005360 | 157065 | 118902 |
| Slc1a3 | 005360 | 129325 | N/A |
| Slc1a3 | 005360 | 133309 | N/A |
| Slc1a3 | 005360 | 126747 | N/A |
| Slc1a3 | 005360 | 005493 | 005493 |
| Slc1a3 | 005360 | 125997 | N/A |
| Slc1a3 | 005360 | 128879 | N/A |
| Slc1a3 | 005360 | 153455 | N/A |
| Slc1a3 | 005360 | 157065 | 118902 |
| Slc1a3 | 005360 | 129325 | N/A |
| Slc1a3 | 005360 | 133309 | N/A |
| Slc1a3 | 005360 | 126747 | N/A |
| Gldc | 024827 | 025778 | 025778 |
| Gldn | 046167 | 056740 | 056080 |
| Gli1 | 025407 | 026474 | 026474 |
| Gli1 | 025407 | 219808 | N/A |
| Gli1 | 025407 | 218236 | 151718 |
| Gli1 | 025407 | 219671 | 151749 |
| Gli1 | 025407 | 218451 | N/A |
| Gli2 | 048402 | 062483 | 054837 |
| Gli2 | 048402 | 161301 | 125342 |
| Gli2 | 048402 | 162552 | 125059 |

TABLE 3-continued

ENSEMBL IDs for rats

| Symbol | MUSG | MUST | MUSP |
|---|---|---|---|
| Gli2 | 048402 | 161056 | 124768 |
| Gli2 | 048402 | 160991 | 125634 |
| Gli2 | 048402 | 159839 | 125661 |
| Gli2 | 048402 | 161451 | 124132 |
| Gli2 | 048402 | 162607 | 123808 |
| Gli2 | 048402 | 159678 | N/A |
| Gli3 | 021318 | 130065 | 115989 |
| Gli3 | 021318 | 141194 | 152092 |
| Gli3 | 021318 | 130535 | N/A |
| Gli3 | 021318 | 110510 | 106137 |
| Glipr2 | 028480 | 030202 | 030202 |
| Glipr2 | 028480 | 107855 | 103487 |
| Glis1 | 034762 | 046005 | 035650 |
| Glis1 | 034762 | 106738 | 102349 |
| Glis1 | 034762 | 130573 | N/A |
| Glis1 | 034762 | 135835 | 118600 |
| Glis1 | 034762 | 138211 | N/A |
| Glis1 | 034762 | 125573 | N/A |
| Glp2r | 049928 | 021289 | 021289 |
| Glp2r | 049928 | 051765 | 061560 |
| Glul | 026473 | 086199 | 083375 |
| Glul | 026473 | 139476 | 114377 |
| Glul | 026473 | 140685 | 123157 |
| Glul | 026473 | 153134 | N/A |
| Glul | 026473 | 154576 | N/A |
| Gm11549 | 085007 | 124606 | 153318 |
| Gm136 | 071015 | 095129 | 092748 |
| Gm20425 | 090639 | 166836 | 127808 |
| Gm266 | 010529 | 010673 | 010673 |
| Gm5083 | 089815 | 163056 | N/A |
| Gm5083 | 089815 | 159595 | N/A |
| Gm5089 | 064052 | 081580 | 080290 |
| Gm5468 | 056089 | 227851 | N/A |
| Gm5468 | 056089 | 069992 | N/A |
| Sox1ot | 047935 | 186174 | N/A |
| Sox1ot | 047935 | 080795 | N/A |
| Gm8179 | N/A | N/A | N/A |
| Gna12 | 000149 | 000153 | 000153 |
| Gna12 | 000149 | 198447 | 143414 |
| Gnal | 024524 | 025402 | 025402 |
| Gnal | 024524 | 076605 | 075908 |
| Gnb3 | 023439 | 024206 | 024206 |
| Gnb3 | 023439 | 129251 | N/A |
| Gnb3 | 023439 | 140233 | N/A |
| Gnb3 | 023439 | 135996 | N/A |
| Gng11 | 032766 | 031670 | 031670 |
| Gng13 | 025739 | 172002 | 131648 |
| Gng13 | 025739 | 115108 | 110760 |
| Gng2 | 043004 | 161247 | 124725 |
| Gng2 | 043004 | 162425 | 124153 |
| Gng2 | 043004 | 159028 | 125141 |
| Gng2 | 043004 | 159073 | 125000 |
| Gng2 | 043004 | 160013 | 125697 |
| Gng2 | 043004 | 055100 | 055256 |
| Gpc6 | 058571 | 123239 | N/A |
| Gpc6 | 058571 | 088483 | 085835 |
| Gpc6 | 058571 | 125435 | 120362 |
| Gpc6 | 058571 | 078849 | 077893 |
| Gpcpd1 | 027346 | 127712 | N/A |
| Gpcpd1 | 027346 | 148833 | 116156 |
| Gpcpd1 | 027346 | 110136 | 105763 |
| Gpcpd1 | 027346 | 060955 | 062221 |
| Gpcpd1 | 027346 | 149854 | 116949 |
| Gpcpd1 | 027346 | 145694 | 116457 |
| Gpcpd1 | 027346 | 028822 | 028822 |
| Gpcpd1 | 027346 | 124632 | 117217 |
| Gpcpd1 | 027346 | 124107 | 122751 |
| Gpcpd1 | 027346 | 110135 | 105762 |
| Gpcpd1 | 027346 | 140867 | N/A |
| Gpcpd1 | 027346 | 131617 | N/A |
| Gpcpd1 | 027346 | 110142 | 105769 |
| Gphn | 047454 | 052472 | 054064 |
| Gphn | 047454 | 110388 | 106018 |
| Gphn | 047454 | 219629 | N/A |
| Gpr135 | 043398 | 050649 | 058762 |
| Gpr135 | 042804 | 105650 | 101275 |

TABLE 3-continued

ENSEMBL IDs for rats

| Symbol | MUSG | MUST | MUSP |
|---|---|---|---|
| Gpr135 | 042804 | 055754 | 052742 |
| Gpr135 | 042804 | 144035 | N/A |
| Gpr135 | 042804 | 105651 | 101276 |
| Gpr22 | 044067 | 057783 | 056125 |
| Gpr22 | 044067 | 176710 | 134839 |
| Gpr22 | 044067 | 174480 | 134674 |
| Gpr37 | 039904 | 200812 | 144683 |
| Gpr37 | 039904 | 054867 | 052185 |
| Gpr37l1 | 026424 | 027682 | 027682 |
| Gpr63 | 040372 | 151006 | N/A |
| Gpr63 | 040372 | 038920 | 039312 |
| Gprasp2 | 072966 | 134986 | N/A |
| Gprasp2 | 072966 | 113136 | 108761 |
| Gprasp2 | 072966 | 150797 | N/A |
| Gprasp2 | 072966 | 132798 | N/A |
| Gprasp2 | 072966 | 141953 | N/A |
| Gprasp2 | 072966 | 142034 | N/A |
| Gprasp2 | 072966 | 137392 | N/A |
| Gprasp2 | 072966 | 130034 | N/A |
| Gprasp2 | 072966 | 148658 | N/A |
| Gprasp2 | 072966 | 138251 | N/A |
| Gprasp2 | 072966 | 173804 | 134666 |
| Gprc5c | 051043 | 133245 | 121572 |
| Gprc5c | 051043 | 122967 | 114335 |
| Gprc5c | 051043 | 053361 | 061760 |
| Gprc5c | 051043 | 021071 | 021071 |
| Gprc5c | 051043 | 136785 | 116786 |
| Gprc5c | 051043 | 142262 | 121524 |
| Gprc5c | 051043 | 152314 | 118667 |
| Gprc5c | 051043 | 177952 | 136702 |
| Gpx2 | 042808 | 221421 | N/A |
| Gpx2 | 042808 | 220569 | N/A |
| Gpx2 | 042808 | 082431 | 081012 |
| Gramd3 | 001700 | 070166 | 068453 |
| Grb14 | 026888 | 134020 | N/A |
| Grb14 | 026888 | 149193 | 118115 |
| Grb14 | 026888 | 150643 | 121571 |
| Grb14 | 026888 | 028252 | 028252 |
| Grb14 | 026888 | 137085 | N/A |
| Grb14 | 026888 | 156765 | 121001 |
| Grb14 | 026888 | 145603 | N/A |
| Grb14 | 026888 | 146807 | N/A |
| Greb1l | 042942 | 173356 | N/A |
| Greb1l | 042942 | 048977 | 049003 |
| Greb1l | 042942 | 172532 | 134090 |
| Greb1l | 042942 | 224958 | N/A |
| Greb1l | 042942 | 174553 | N/A |
| Greb1l | 042942 | 172680 | 134314 |
| Greb1l | 042942 | 173261 | N/A |
| Grhl1 | 020656 | 085553 | 082689 |
| Grhl1 | 020656 | 221426 | N/A |
| Grhl1 | 020656 | 223442 | N/A |
| Grhl1 | 020656 | 020985 | 020985 |
| Gria1 | 020524 | 125292 | 133439 |
| Gria1 | 020524 | 036315 | 044494 |
| Gria1 | 020524 | 094179 | 091731 |
| Gria1 | 020524 | 151045 | 117746 |
| Gria1 | 020524 | 173531 | N/A |
| Gria3 | 001986 | 128197 | N/A |
| Gria3 | 001986 | 115103 | 110755 |
| Gria3 | 001986 | 076349 | 075687 |
| Gria3 | 001986 | 156721 | N/A |
| Gria3 | 001986 | 139965 | 116381 |
| Gria3 | 001986 | 148212 | N/A |
| Gria3 | 001986 | 124169 | 117766 |
| Gria3 | 001986 | 126843 | N/A |
| Gria3 | 001986 | 165288 | 131523 |
| Grid1 | 041078 | 043349 | 044009 |
| Grid1 | 041078 | 227253 | N/A |
| Grid1 | 041078 | 173307 | N/A |
| Grid2 | 071424 | 159319 | N/A |
| Grid2 | 071424 | 159561 | N/A |
| Grid2 | 071424 | 095852 | 093536 |
| Grid2 | 071424 | 160408 | N/A |
| Grid2 | 071424 | 161105 | N/A |
| Grid2 | 071424 | 162968 | N/A |

TABLE 3-continued

ENSEMBL IDs for rats

| Symbol | MUSG | MUST | MUSP |
|---|---|---|---|
| Grid2 | 071424 | 210324 | 147707 |
| Grid2ip | 010825 | 110733 | 106361 |
| Grid2ip | 010825 | 010969 | 010969 |
| Grid2ip | 010825 | 120825 | 113443 |
| Grid2ip | 010825 | 196148 | N/A |
| Grid2ip | 010825 | 138948 | N/A |
| Grik1 | 022935 | 228188 | 154130 |
| Grik1 | 022935 | 023652 | 023652 |
| Grik1 | 022935 | 072256 | 072107 |
| Grik1 | 022935 | 227986 | 153786 |
| Grik1 | 022935 | 228034 | 154596 |
| Grik1 | 022935 | 211444 | 147948 |
| Grik1 | 022935 | 210700 | N/A |
| Grik1 | 022935 | 211635 | N/A |
| Grik1 | 022935 | 226447 | N/A |
| Grik1 | 022935 | 210910 | N/A |
| Grik1 | 022935 | 114137 | 109773 |
| Grik2 | 056073 | 218823 | 151921 |
| Grik2 | 056073 | 217673 | N/A |
| Grik2 | 056073 | 218598 | 151389 |
| Grik2 | 056073 | 219509 | 151982 |
| Grik2 | 056073 | 218441 | 151671 |
| Grik2 | 056073 | 220330 | N/A |
| Grik2 | 056073 | 219051 | N/A |
| Grik2 | 056073 | 218669 | 152029 |
| Grik2 | 056073 | 220263 | 151372 |
| Grik2 | 056073 | 079751 | 078687 |
| Grik2 | 056073 | 105484 | 101124 |
| Grik3 | 001985 | 030676 | 030676 |
| Grin2a | 059003 | 199708 | 142900 |
| Grin2a | 059003 | 115835 | 111501 |
| Grin2a | 059003 | 199267 | N/A |
| Grin2a | 059003 | 156482 | N/A |
| Grin2a | 059003 | 197242 | N/A |
| Grin2a | 059003 | 032331 | 032331 |
| Grin2b | 030209 | 053880 | 062284 |
| Grin2b | 030209 | 152012 | 142696 |
| Grin2b | 030209 | 188999 | 140452 |
| Grin2b | 030209 | 143943 | 140710 |
| Grin2b | 030209 | 125905 | 139706 |
| Grin2b | 030209 | 198283 | N/A |
| Grin2b | 030209 | 111905 | 107536 |
| Grin2c | 020734 | 003351 | 003351 |
| Grin2c | 020734 | 106554 | 102164 |
| Grin2d | 002771 | 002848 | 002848 |
| Grin2d | 002771 | 211713 | 147663 |
| Grin2d | 002771 | 211250 | 147506 |
| Grip1 | 034813 | 077871 | 077033 |
| Grip1 | 034813 | 041962 | 042436 |
| Grip1 | 034813 | 147356 | 115478 |
| Grip1 | 034813 | 105262 | 100897 |
| Grip1 | 034813 | 147454 | 118073 |
| Grip1 | 034813 | 147598 | N/A |
| Grip1 | 034813 | 138410 | 123234 |
| Grip1 | 034813 | 144825 | 121670 |
| Grip1 | 034813 | 148954 | 118397 |
| Grip1 | 034813 | 144959 | 122323 |
| Grip1 | 034813 | 139352 | N/A |
| Grip1 | 034813 | 127787 | N/A |
| Grip1 | 034813 | 130387 | 123288 |
| Grip1 | 034813 | 105261 | 100896 |
| Grip1 | 034813 | 154238 | 122349 |
| Grip1 | 034813 | 081260 | 080016 |
| Grk4 | 052783 | 074651 | 074223 |
| Grk4 | 052783 | 001112 | 001112 |
| Grk4 | 052783 | 148588 | 122826 |
| Grk4 | 052783 | 153323 | N/A |
| Grk4 | 052783 | 134217 | N/A |
| Grm1 | 019828 | 105561 | 101190 |
| Grm1 | 019828 | 044306 | 037255 |
| Grm1 | 019828 | 135120 | N/A |
| Grm1 | 019828 | 155772 | N/A |
| Grm1 | 019828 | 156826 | N/A |
| Grm1 | 019828 | 105560 | 101189 |
| Grm5 | 049583 | 208791 | N/A |
| Grm5 | 049583 | 208878 | N/A |

TABLE 3-continued

| ENSEMBL IDs for rats | | | |
|---|---|---|---|
| Symbol | MUSG | MUST | MUSP |
| Grm5 | 049583 | 125009 | 118393 |
| Grm5 | 049583 | 208776 | N/A |
| Grm5 | 049583 | 155358 | 114927 |
| Grm5 | 049583 | 138732 | N/A |
| Grm5 | 049583 | 107263 | 102884 |
| Grm7 | 056755 | 174018 | 134635 |
| Grm7 | 056755 | 071076 | 064404 |
| Grm7 | 056755 | 172951 | 133957 |
| Grm7 | 056755 | 173001 | 134233 |
| Grm7 | 056755 | 174310 | 133897 |
| Grm8 | 024211 | 115323 | 110978 |
| Grm8 | 024211 | 090512 | 087998 |
| Grm8 | 024211 | 131897 | 120394 |
| Grm8 | 024211 | 146727 | N/A |
| Grm8 | 024211 | 132755 | 118098 |
| Grm8 | 024211 | 202861 | N/A |
| Grm8 | 024211 | 115324 | 110979 |
| Gsap | 039934 | 197522 | N/A |
| Gsap | 039934 | 198014 | 143739 |
| Gsap | 039934 | 036031 | 043679 |
| Gsap | 039934 | 197404 | N/A |
| Gsap | 039934 | 198071 | 142407 |
| Gsap | 039934 | 195969 | 142560 |
| Gsap | 039934 | 198937 | 142986 |
| Gsap | 039934 | 196035 | N/A |
| Gsap | 039934 | 198930 | 142596 |
| Gsap | 039934 | 199553 | N/A |
| Gsn | 026879 | 201185 | 144561 |
| Gsn | 026879 | 202990 | 144296 |
| Gsn | 026879 | 202899 | 144470 |
| Gsn | 026879 | 142324 | 118120 |
| Gsn | 026879 | 139867 | 144217 |
| Gsn | 026879 | 028239 | 028239 |
| Gsn | 026879 | 124323 | N/A |
| Gstm1 | 058135 | 004140 | 004140 |
| Gstm1 | 058135 | 198532 | N/A |
| Gstm1 | 058135 | 153314 | 123481 |
| Gstm1 | 058135 | 126593 | 118874 |
| Gsx1 | 053129 | 065382 | 069728 |
| Gtf2a1l | 024154 | 024970 | 024970 |
| Gtf2a1l | 024154 | 161481 | 124286 |
| Gucy1a3 | 033910 | 193924 | 142138 |
| Gucy1a3 | 033910 | 048976 | 048918 |
| Gucy1a3 | 033910 | 192289 | 141478 |
| Gucy1a3 | 033910 | 191942 | N/A |
| Gucy1a3 | 033910 | 194788 | N/A |
| N/A | N/A | N/A | N/A |
| Hapln2 | 004894 | 160737 | N/A |
| Hapln2 | 004894 | 005014 | 005014 |
| Hapln2 | 004894 | 162352 | N/A |
| Hapln2 | 004894 | 160150 | 125271 |
| Has2 | 022367 | 050544 | 062212 |
| Hcn1 | 021730 | 207599 | N/A |
| Hcn1 | 021730 | 006991 | 006991 |
| Hcn2 | 020331 | 099513 | 097113 |
| Hcn2 | 020331 | 020581 | 020581 |
| Hdac8 | 067567 | 087916 | 085226 |
| Hdac8 | 067567 | 154872 | 138805 |
| Hdac8 | 067567 | 148481 | N/A |
| Hdac8 | 067567 | 137785 | N/A |
| Hdac8 | 067567 | 154024 | N/A |
| Hebp1 | 042770 | 045855 | 042232 |
| Hebp1 | 042770 | 204000 | N/A |
| Hebp1 | 042770 | 204730 | N/A |
| Hebp1 | 042770 | 205232 | N/A |
| Heg1 | 075254 | 152832 | N/A |
| Heg1 | 075254 | 152782 | 123686 |
| Heg1 | 075254 | 132797 | N/A |
| Heg1 | 075254 | 128105 | N/A |
| Heg1 | 075254 | 146518 | N/A |
| Heg1 | 075254 | 126532 | 119790 |
| Heg1 | 075254 | 154863 | N/A |
| Hepacam | 046240 | 051839 | 054105 |
| Hepacam | 046240 | 215951 | 150856 |
| Hes3 | 028946 | 094438 | 092006 |
| Hes3 | 028946 | 218045 | 151815 |

TABLE 3-continued

| ENSEMBL IDs for rats | | | |
|---|---|---|---|
| Symbol | MUSG | MUST | MUSP |
| Hhatl | 032523 | 035110 | 035110 |
| Hhatl | 032523 | 163981 | 131971 |
| Hhatl | 032523 | 214768 | 149486 |
| Hhatl | 032523 | 215910 | 149350 |
| Hhatl | 032523 | 215477 | 150866 |
| Hhatl | 032523 | 217652 | 150721 |
| Hif3a | 004328 | 108492 | 104132 |
| Hif3a | 004328 | 037762 | 048248 |
| Hif3a | 004328 | 139224 | 146258 |
| Hif3a | 004328 | 153833 | 117728 |
| Hip1 | 039959 | 060311 | 059033 |
| Hip1 | 039959 | 202643 | 144086 |
| Hip1 | 039959 | 201479 | N/A |
| Hip1 | 039959 | 200808 | 144429 |
| Hip1 | 039959 | 200898 | N/A |
| Hip1 | 039959 | 212301 | 148842 |
| Hip1 | 039959 | 202236 | N/A |
| Hip1 | 039959 | 201998 | 144392 |
| Hip1 | 039959 | 202095 | N/A |
| Hip1 | 039959 | 202044 | N/A |
| Hip1r | 000915 | 000939 | 000939 |
| Hip1r | 000915 | 167879 | 127361 |
| Hip1r | 000915 | 166258 | 130766 |
| Hip1r | 000915 | 171407 | N/A |
| Hip1r | 000915 | 198664 | 143309 |
| Hip1r | 000915 | 167325 | N/A |
| Hip1r | 000915 | 166684 | N/A |
| Hk2 | 000628 | 000642 | 000642 |
| Hk2 | 000628 | 168725 | N/A |
| Hk2 | 000628 | 170833 | 125986 |
| Hk2 | 000628 | 169270 | 128572 |
| Hmgcll1 | 007908 | 008052 | 008052 |
| Hmgcll1 | 007908 | 183425 | 139094 |
| Hmgcll1 | 007908 | 183979 | 138914 |
| Hmgcll1 | 007908 | 121592 | N/A |
| Hmgcll1 | 007908 | 183505 | N/A |
| Hmgcll1 | 007908 | 126321 | N/A |
| Hmgcll1 | 007908 | 117981 | 114045 |
| Hmgn1 | 040681 | 050884 | 061012 |
| Hmgn1 | 040681 | 145713 | N/A |
| Hmgn1 | 040681 | 133885 | 122427 |
| Hmgn1 | 040681 | 142179 | N/A |
| Homer3 | 003573 | 087467 | 084735 |
| Homer3 | 003573 | 140212 | 117033 |
| Homer3 | 003573 | 155711 | N/A |
| Homer3 | 003573 | 003669 | 003669 |
| Homer3 | 003573 | 143528 | N/A |
| Homer3 | 003573 | 135692 | N/A |
| Homer3 | 003573 | 135368 | 137560 |
| Homer3 | 003573 | 110124 | 105751 |
| Hpcal4 | 046093 | 059667 | 051487 |
| Hpcal4 | 046093 | 106246 | 101853 |
| Hpcal4 | 046093 | 126995 | 122104 |
| Hpcal4 | 046093 | 136619 | N/A |
| Hpcal4 | 046093 | 152194 | 120066 |
| Hpse2 | 074852 | 099428 | 097026 |
| Hrh2 | 034987 | 038101 | 038170 |
| Hrh2 | 034987 | 209846 | 148117 |
| Hrh2 | 034987 | 211742 | 147413 |
| Hs3st1 | 051022 | 117944 | 113919 |
| Hs3st1 | 051022 | 053116 | 051055 |
| Hs3st1 | 051022 | 137142 | 114997 |
| Hs3st1 | 051022 | 152057 | 118060 |
| Hs3st2 | 046321 | 206880 | 146027 |
| Hs3st2 | 046321 | 084628 | 081678 |
| Hs3st4 | 078591 | 106437 | 102045 |
| Hs6st2 | 062184 | 088172 | 085497 |
| Hs6st2 | 062184 | 114871 | 110521 |
| Hs6st2 | 062184 | 142738 | N/A |
| Hs6st2 | 062184 | 140145 | N/A |
| Hs6st2 | 062184 | 142983 | N/A |
| Hsd17b11 | 029311 | 031251 | 031251 |
| Hsd17b11 | 029311 | 119025 | 113455 |
| Hspa1b | 090877 | 172753 | 133815 |
| Htr1b | 049511 | 183482 | 139389 |
| Htr1b | 049511 | 051005 | 050898 |

TABLE 3-continued

ENSEMBL IDs for rats

| Symbol | MUSG | MUST | MUSP |
| --- | --- | --- | --- |
| Htr2a | 034997 | 036653 | 047774 |
| Htr2c | 041380 | 149260 | N/A |
| Htr2c | 041380 | 131999 | N/A |
| Htr2c | 041380 | 036303 | 043936 |
| Htr2c | 041380 | 096299 | 094021 |
| Htr2c | 041380 | 156697 | 138772 |
| Htr2c | 041380 | 134368 | N/A |
| Htr2c | 041380 | 112831 | 108450 |
| Hta1 | 006205 | 150717 | N/A |
| Hta1 | 006205 | 006367 | 006367 |
| Hta1 | 006205 | 153290 | N/A |
| Hta1 | 006205 | 140741 | N/A |
| Hta1 | 006205 | 150905 | N/A |
| Hunk | 053414 | 065856 | 068007 |
| Icam5 | 032174 | 019616 | 019616 |
| Icosl | 000732 | 105393 | 101032 |
| Icosl | 000732 | 217675 | N/A |
| Icosl | 000732 | 219038 | 151346 |
| Icosl | 000732 | 219633 | N/A |
| Id4 | 021379 | 021810 | 021810 |
| Ift43 | 007867 | 221194 | N/A |
| Ift43 | 007867 | 054565 | 061891 |
| Ift43 | 007867 | 222821 | 152079 |
| Ift43 | 007867 | 222905 | 152281 |
| Ift43 | 007867 | 223269 | N/A |
| Ift43 | 007867 | 221161 | N/A |
| Ift43 | 007867 | 220711 | N/A |
| Igdcc3 | 032394 | 034961 | 034961 |
| Igdcc3 | 032394 | 217371 | 149084 |
| Igdcc3 | 032394 | 217135 | N/A |
| Igdcc4 | 032816 | 213533 | 150272 |
| Igdcc4 | 032816 | 035499 | 045387 |
| Igdcc4 | 032816 | 216542 | N/A |
| Igdcc4 | 032816 | 213423 | N/A |
| Igdcc4 | 032816 | 214978 | N/A |
| Igdcc4 | 032816 | 077696 | 076878 |
| Igdcc4 | 032816 | 166273 | 132576 |
| Igfbp3 | 020427 | 020702 | 020702 |
| Igfbp3 | 020427 | 135887 | 131670 |
| Igfbp5 | 026185 | 027377 | 027377 |
| Igfbp5 | 026185 | 137339 | N/A |
| Igsfl1 | 022790 | 210186 | N/A |
| Igsfl1 | 022790 | 114706 | 110354 |
| Igsfl1 | 022790 | 209958 | N/A |
| Igsfl1 | 022790 | 023478 | 023478 |
| Igsfl1 | 022790 | 210471 | N/A |
| Igsf3 | 042035 | 198995 | N/A |
| Igsf3 | 042035 | 043983 | 048900 |
| Igsf3 | 042035 | 195164 | 141823 |
| Il15 | 031712 | 209363 | 147848 |
| Il15 | 031712 | 209573 | 148256 |
| Il15 | 031712 | 034148 | 034148 |
| Il15 | 031712 | 211565 | 147319 |
| Il15 | 031712 | 209687 | N/A |
| Il15 | 031712 | 211722 | N/A |
| Il15 | 031712 | 210094 | 147312 |
| Il15 | 031712 | 211282 | N/A |
| Il15 | 031712 | 210885 | N/A |
| Il15 | 031712 | 210472 | N/A |
| Il16 | 001741 | 001792 | 001792 |
| Il16 | 001741 | 145610 | 146496 |
| Il16 | 001741 | 151047 | N/A |
| Il16 | 001741 | 153560 | 118516 |
| Il16 | 001741 | 131916 | 122022 |
| Il16 | 001741 | 156553 | 122813 |
| Il18 | 039217 | 213916 | 150305 |
| Il18 | 039217 | 214117 | 151002 |
| Il18 | 039217 | 180021 | 137193 |
| Il18 | 039217 | 059081 | 054591 |
| Il20rb | 044244 | 098458 | 096057 |
| Il20rb | 044244 | 136606 | N/A |
| Il20rb | 044244 | 136856 | N/A |
| Il20rb | 044244 | 125259 | N/A |
| Il20rb | 044244 | 152756 | N/A |
| Il20rb | 044244 | 122880 | N/A |
| Il22 | 074695 | 096691 | 094449 |
| Il33 | 024810 | 120388 | 113829 |
| Il33 | 024810 | 144528 | 122319 |
| Il33 | 024810 | 177518 | 135854 |
| Il33 | 024810 | 025724 | 025724 |
| Il33 | 024810 | 136850 | 135324 |
| Iltifb | 090461 | 163808 | 128415 |
| Iltifb | 090461 | 179123 | N/A |
| 5730559C18Rik | 041605 | 120339 | 113785 |
| 5730559C18Rik | 041605 | 150163 | 118074 |
| 5730559C18Rik | 041605 | 144464 | 115554 |
| 5730559C18Rik | 041605 | 194374 | N/A |
| 5730559C18Rik | 041605 | 153910 | 120263 |
| 5730559C18Rik | 041605 | 195177 | 141506 |
| Inhba | 041324 | 164993 | 132085 |
| Inhba | 041324 | 042603 | 047894 |
| Inpp1 | 026102 | 027271 | 027271 |
| Inpp1 | 026102 | 177279 | 135225 |
| Inpp1 | 026102 | 159607 | N/A |
| Inpp1 | 026102 | 162576 | 124890 |
| Inpp1 | 026102 | 162351 | N/A |
| Inpp1 | 026102 | 159725 | 123977 |
| Inpp4b | 037940 | 172167 | N/A |
| Inpp4b | 037940 | 213285 | 150520 |
| Inpp4b | 037940 | 217122 | 150541 |
| Inpp4b | 037940 | 169387 | 130104 |
| Inpp4b | 037940 | 215332 | 148972 |
| Inpp4b | 037940 | 042529 | 044466 |
| Inpp4b | 037940 | 169116 | 131947 |
| Inpp4b | 037940 | 109852 | 105478 |
| Inpp4b | 037940 | 172031 | 131324 |
| Inpp4b | 037940 | 164870 | N/A |
| Inpp4b | 037940 | 216036 | N/A |
| Inpp4b | 037940 | 170160 | 132156 |
| Inpp4b | 037940 | 216387 | N/A |
| Inpp4b | 037940 | 109851 | 105477 |
| Inpp4b | 037940 | 165821 | N/A |
| Inpp5a | 025477 | 106098 | 101704 |
| Inpp5a | 025477 | 026550 | 026550 |
| Inpp5a | 025477 | 097975 | 095589 |
| Inpp5a | 025477 | 138183 | N/A |
| Inpp5a | 025477 | 131781 | N/A |
| Inpp5a | 025477 | 210320 | N/A |
| Inpp5a | 025477 | 152475 | N/A |
| Insc | 048782 | 161800 | 125061 |
| Insc | 048782 | 136645 | 119459 |
| Insc | 048782 | 139670 | N/A |
| Insc | 048782 | 117543 | 112682 |
| Insc | 048782 | 151464 | 117296 |
| Insc | 048782 | 136347 | N/A |
| Insc | 048782 | 150991 | N/A |
| Insc | 048782 | 206274 | 145636 |
| Insc | 048782 | 169913 | 129505 |
| Ipcef1 | 064065 | 086896 | 084110 |
| Ipcef1 | 064065 | 145156 | 114267 |
| Ipcef1 | 064065 | 151960 | 118510 |
| Ipcef1 | 064065 | 149708 | N/A |
| Ipcef1 | 064065 | 144622 | N/A |
| Ipcef1 | 064065 | 105617 | 101242 |
| Ipcef1 | 064065 | 154998 | N/A |
| Ipcef1 | 064065 | 078070 | 077215 |
| Ipcef1 | 064065 | 170680 | 128131 |
| Iqch | 037801 | 042322 | 047953 |
| Iqch | 037801 | 163982 | 126546 |
| Iqch | 037801 | 163624 | 128482 |
| Iqch | 037801 | 080527 | 079370 |
| Iqch | 037801 | 171243 | 131828 |
| Iqch | 037801 | 170960 | N/A |
| Iqgap1 | 030536 | 167377 | 128278 |
| Iqgap1 | 030536 | 205606 | 145991 |
| Iqgap1 | 030536 | 205383 | N/A |
| Iqgap1 | 030536 | 206149 | N/A |
| Iqgap1 | 030536 | 205824 | N/A |
| Iqgap1 | 030536 | 205813 | 145556 |
| Iqgap1 | 030536 | 205304 | 146126 |
| Iqgap1 | 030536 | 205540 | N/A |
| Iqsec1 | 034312 | 101153 | 098712 |

TABLE 3-continued

| ENSEMBL IDs for rats | | | |
| --- | --- | --- | --- |
| Symbol | MUSG | MUST | MUSP |
| Iqsec1 | 034312 | 204983 | N/A |
| Iqsec1 | 034312 | 212100 | 148669 |
| Iqsec1 | 034312 | 154198 | N/A |
| Iqsec1 | 034312 | 141434 | N/A |
| Iqsec1 | 034312 | 205068 | N/A |
| Iqsec1 | 034312 | 156834 | 118802 |
| Iqsec1 | 034312 | 133492 | N/A |
| Iqsec1 | 034312 | 146977 | N/A |
| Iqsec1 | 034312 | 101151 | 098710 |
| Irak2 | 060477 | 059286 | 055073 |
| Irak2 | 060477 | 089023 | 086417 |
| Irak2 | 060477 | 204091 | N/A |
| Irak2 | 060477 | 089022 | 086416 |
| Irak2 | 060477 | 204744 | 144848 |
| Irak2 | 060477 | 155554 | N/A |
| Irak2 | 060477 | 113024 | N/A |
| Irak2 | 060477 | 203381 | N/A |
| Irak2 | 060477 | 143948 | N/A |
| Irx1 | 060969 | 077337 | 076562 |
| Irx1 | 060969 | 223379 | 152247 |
| Irx1 | 060969 | 223460 | 152128 |
| Irx2 | 001504 | 074372 | 073976 |
| Irx2 | 001504 | 169028 | N/A |
| Irx2 | 001504 | 167067 | 127963 |
| Irx2 | 001504 | 163393 | N/A |
| Irx2 | 001504 | 172353 | 126691 |
| Irx5 | 031737 | 210246 | 147339 |
| Irx5 | 031737 | 034184 | 034184 |
| Itga2 | 015533 | 056117 | 053891 |
| Itga2 | 015533 | 224204 | 153056 |
| Itga9 | 039115 | 044165 | 044227 |
| Itga9 | 039115 | 125021 | N/A |
| Itga9 | 039115 | 124360 | 122417 |
| Itga9 | 039115 | 149150 | 122408 |
| Itga9 | 039115 | 124422 | N/A |
| Itga9 | 039115 | 155437 | N/A |
| Itgav | 027087 | 028499 | 028499 |
| Itgav | 027087 | 125360 | N/A |
| Itgav | 027087 | 151463 | N/A |
| Itgav | 027087 | 148256 | N/A |
| Itgav | 027087 | 111740 | 107369 |
| Itgav | 027087 | 141725 | 122730 |
| Itgav | 027087 | 155521 | N/A |
| Itgav | 027087 | 125402 | 118016 |
| Itgav | 027087 | 131192 | 121295 |
| Itgb4 | 020758 | 021107 | 021107 |
| Itgb4 | 020758 | 068981 | 070811 |
| Itgb4 | 020758 | 106460 | 102068 |
| Itgb4 | 020758 | 106458 | 102066 |
| Itgb4 | 020758 | 151691 | N/A |
| Itgb4 | 020758 | 150129 | N/A |
| Itgb4 | 020758 | 127523 | N/A |
| Itgb4 | 020758 | 130286 | N/A |
| Itgb4 | 020758 | 169928 | 127604 |
| Itgb4 | 020758 | 106461 | 102069 |
| Itgb8 | 025321 | 026360 | 026360 |
| Itgb8 | 025321 | 137804 | N/A |
| Itgb8 | 025321 | 151023 | N/A |
| Itih3 | 006522 | 006697 | 006697 |
| Itih3 | 006522 | 227181 | N/A |
| Itih3 | 006522 | 227995 | 154659 |
| Itih3 | 006522 | 226547 | 154256 |
| Itih3 | 006522 | 226179 | N/A |
| Itih3 | 006522 | 228114 | 154720 |
| Itpka | 027296 | 028758 | 028758 |
| Itpkb | 038855 | 070181 | 069851 |
| Itpkb | 038855 | 195043 | N/A |
| Itpr1 | 030102 | 032192 | 032192 |
| Itpr1 | 030102 | 203615 | 144880 |
| Itpr1 | 030102 | 203995 | N/A |
| Itpr1 | 030102 | 203936 | 145526 |
| Itpr1 | 030102 | 212125 | 148284 |
| Itpr1 | 030102 | 205053 | N/A |
| Itpr1 | 030102 | 203262 | 145177 |
| Itpr1 | 030102 | 203638 | 145522 |
| Itpr1 | 030102 | 203687 | 145339 |

TABLE 3-continued

| ENSEMBL IDs for rats | | | |
| --- | --- | --- | --- |
| Symbol | MUSG | MUST | MUSP |
| Itpr1 | 030102 | 205048 | N/A |
| Itpr1 | 030102 | 203530 | N/A |
| Itpr1 | 030102 | 203288 | N/A |
| Itpr1 | 030102 | 205005 | N/A |
| Itpripl2 | 095115 | 178344 | 136409 |
| Jam2 | 053062 | 114195 | 109833 |
| Jam2 | 053062 | 098407 | 096007 |
| Jam2 | 053062 | 138054 | N/A |
| Jam3 | 031990 | 034472 | 034472 |
| Jam3 | 031990 | 215446 | N/A |
| Jam3 | 031990 | 213170 | N/A |
| Jam3 | 031990 | 167074 | N/A |
| Jam3 | 031990 | 213682 | N/A |
| Jazf1 | 063568 | 128282 | N/A |
| Jazf1 | 063568 | 136250 | N/A |
| Jazf1 | 063568 | 074541 | 074129 |
| Jkamp | 005078 | 117449 | 113744 |
| Jkamp | 005078 | 057257 | 061370 |
| Jkamp | 005078 | 125764 | 117251 |
| Jkamp | 005078 | 132371 | N/A |
| Jkamp | 005078 | 134041 | N/A |
| Jkamp | 005078 | 152381 | N/A |
| Jkamp | 005078 | 145752 | N/A |
| Jph1 | 042686 | 186024 | 140705 |
| Jph1 | 042686 | 038382 | 039072 |
| Kank1 | 032702 | 049400 | 042177 |
| Kank1 | 032702 | 146647 | 116660 |
| Kank1 | 032702 | 137260 | N/A |
| Kank1 | 032702 | 155788 | N/A |
| Kank4 | 035407 | 102790 | 099851 |
| Kank4 | 035407 | 137270 | N/A |
| Kcna1 | 047976 | 055168 | 055225 |
| Kcna1 | 047976 | 203094 | 144947 |
| Kcna1 | 047976 | 205171 | N/A |
| Kcna2 | 040724 | 197470 | 143798 |
| Kcna2 | 040724 | 038695 | 041702 |
| Kcna2 | 040724 | 196403 | 142873 |
| Kcnab2 | 028931 | 159840 | 124156 |
| Kcnab2 | 028931 | 160884 | 125058 |
| Kcnab2 | 028931 | 030768 | 030768 |
| Kcnab2 | 028931 | 159186 | 124588 |
| Kcnab2 | 028931 | 105648 | 101273 |
| Kcnab2 | 028931 | 159844 | N/A |
| Kcnab2 | 028931 | 161496 | N/A |
| Kcnab2 | 028931 | 161236 | 125270 |
| Kcnab2 | 028931 | 159435 | N/A |
| Kcnab2 | 028931 | 162200 | N/A |
| Kcnab2 | 028931 | 162165 | N/A |
| Kcnab2 | 028931 | 161844 | N/A |
| Kcnab2 | 028931 | 162518 | N/A |
| Kcnab2 | 028931 | 162017 | 123939 |
| Kcnab3 | 018470 | 018614 | 018614 |
| Kcnab3 | 018470 | 142328 | N/A |
| Kcnab3 | 018470 | 134561 | N/A |
| Kcnc1 | 058975 | 025202 | 025202 |
| Kcnc1 | 058975 | 160433 | 124938 |
| Kcnc1 | 058975 | 160234 | N/A |
| Kcnc2 | 035681 | 219301 | 151579 |
| Kcnc2 | 035681 | 092175 | 089814 |
| Kcnc2 | 035681 | 218445 | 151560 |
| Kcnc2 | 035681 | 219607 | 151870 |
| Kcnc2 | 035681 | 218827 | 151995 |
| Kcnc3 | 062785 | 209177 | 146535 |
| Kcnc3 | 062785 | 207493 | 146425 |
| Kcnc3 | 062785 | 208651 | 146988 |
| Kcnc3 | 062785 | 107907 | 103540 |
| Kcnc3 | 062785 | 107906 | 103539 |
| Kcnc3 | 062785 | 208412 | N/A |
| Kcnc3 | 062785 | 207497 | 146479 |
| Kcnf1 | 051726 | 170580 | 131480 |
| Kcnh1 | 058248 | 078470 | 077563 |
| Kcnh1 | 058218 | 110844 | 106468 |
| Kcnh1 | 058218 | 151152 | 141247 |
| Kcnh5 | 031102 | 042299 | 046864 |
| Kcnh7 | 059712 | 075052 | 074563 |
| Kcnh7 | 059712 | 112454 | 108073 |

TABLE 3-continued

| ENSEMBL IDs for rats | | | |
| --- | --- | --- | --- |
| Symbol | MUSG | MUST | MUSP |
| Kcnh7 | 059712 | 112452 | 108071 |
| Kcnh7 | 059712 | 131799 | N/A |
| Kcnh8 | 035580 | 039366 | 049206 |
| Kcnh8 | 035580 | 184279 | N/A |
| Kcnip1 | 053519 | 109340 | 104964 |
| Kcnip1 | 053519 | 065970 | 069063 |
| Kcnip1 | 053519 | 101368 | 098919 |
| Kcnip1 | 053519 | 135034 | N/A |
| Kcnip1 | 053519 | 154760 | N/A |
| Kcnip4 | 029088 | 166924 | 131276 |
| Kcnip4 | 029088 | 172363 | N/A |
| Kcnip4 | 029088 | 176978 | 134758 |
| Kcnip4 | 029088 | 087395 | 084656 |
| Kcnip4 | 029088 | 101215 | N/A |
| Kcnip4 | 029088 | 176191 | 135071 |
| Kcnip4 | 029088 | 175660 | 135799 |
| Kcnip4 | 029088 | 101214 | N/A |
| Kcnj10 | 044708 | 056136 | 054356 |
| Kcnj12 | 042529 | 089184 | 086588 |
| Kcnj12 | 042529 | 041944 | 041696 |
| Kcnj12 | 042529 | 108717 | 104357 |
| Kcnj16 | 051497 | 106636 | 102247 |
| Kcnj16 | 051497 | 106635 | 102246 |
| Kcnj16 | 051497 | 125692 | 119921 |
| Kcnj16 | 051497 | 150902 | 121758 |
| Kcnj16 | 051497 | 180023 | 136382 |
| Kcnj16 | 051497 | 178798 | 137414 |
| Kcnj3 | 026824 | 067101 | 063329 |
| Kcnj3 | 026824 | 112632 | 108251 |
| Kcnj3 | 026824 | 112633 | 108252 |
| Kcnj4 | 044216 | 057801 | 094075 |
| Kcnk10 | 033854 | 221240 | 152473 |
| Kcnk10 | 033854 | 110113 | 105740 |
| Kcnk10 | 033854 | 221305 | 152656 |
| Kcnk10 | 033854 | 221906 | N/A |
| Kcnk13 | 045404 | 160413 | 123916 |
| Kcnk13 | 045404 | 162221 | N/A |
| Kcnk13 | 045404 | 049788 | 051846 |
| Kcnk13 | 045404 | 177549 | 136882 |
| Kcnk3 | 049265 | 066295 | 098987 |
| Kcnk3 | 049265 | 197428 | N/A |
| Kcnma1 | 063142 | 145596 | 153247 |
| Kcnma1 | 063142 | 188285 | 140275 |
| Kcnma1 | 063142 | 225431 | 153670 |
| Kcnma1 | 063142 | 188210 | 141069 |
| Kcnma1 | 063142 | 224787 | 152999 |
| Kcnma1 | 063142 | 224025 | 153078 |
| Kcnma1 | 063142 | 190044 | 140033 |
| Kcnma1 | 063142 | 225315 | 153584 |
| Kcnma1 | 063142 | 225794 | 153254 |
| Kcnma1 | 063142 | 225556 | 152959 |
| Kcnma1 | 063142 | 190985 | 140154 |
| Kcnma1 | 063142 | 223727 | 153158 |
| Kcnma1 | 063142 | 223655 | 153362 |
| Kcnma1 | 063142 | 224077 | 153214 |
| Kcnma1 | 063142 | 188991 | 140751 |
| Kcnma1 | 063142 | 224468 | 153312 |
| Kcnma1 | 063142 | 224812 | 153527 |
| Kcnma1 | 063142 | 224285 | 153316 |
| Kcnma1 | 063142 | 225471 | 153083 |
| Kcnma1 | 063142 | 224232 | 153291 |
| Kcnma1 | 063142 | 223749 | 153216 |
| Kcnma1 | 063142 | 212542 | N/A |
| Kcnma1 | 063142 | 226051 | 153356 |
| Kcnma1 | 063142 | 224933 | N/A |
| Kcnma1 | 063142 | 212576 | 148692 |
| Kcnma1 | 063142 | 223847 | N/A |
| Kcnma1 | 063142 | 225305 | N/A |
| Kcnma1 | 063142 | 224465 | N/A |
| Kcnma1 | 063142 | 190339 | 141143 |
| Kcnma1 | 063142 | 065788 | 065293 |
| Kcnma1 | 063142 | 100831 | 098393 |
| Kcnma1 | 063142 | 074983 | 074511 |
| Kcnma1 | 063142 | 112423 | 108042 |
| Kcnma1 | 063142 | 172099 | 132204 |
| Kcnma1 | 063142 | 177634 | 136447 |

TABLE 3-continued

| ENSEMBL IDs for rats | | | |
| --- | --- | --- | --- |
| Symbol | MUSG | MUST | MUSP |
| Kcnma1 | 063142 | 163322 | 128553 |
| Kcnma1 | 063142 | 179836 | 137141 |
| Kcnma1 | 063142 | 179097 | 136568 |
| Kcnn3 | 000794 | 000811 | 000811 |
| Kcnn3 | 000794 | 124584 | N/A |
| Kcnq5 | 028033 | 029667 | 029667 |
| Kcnq5 | 028033 | 115300 | 110955 |
| Kcnq5 | 028033 | 173058 | 134166 |
| Kcnq5 | 028033 | 174183 | 134389 |
| Kcnq5 | 028033 | 173404 | 134076 |
| Kcnq5 | 028033 | 115299 | N/A |
| Kcnq5 | 028033 | 134505 | N/A |
| Kcnt2 | 052726 | 120709 | 112887 |
| Kcnt2 | 052726 | 120796 | 113333 |
| Kcnt2 | 052726 | 119786 | 113535 |
| Kcnt2 | 052726 | 192840 | N/A |
| Kcnt2 | 052726 | 145077 | N/A |
| Kcnt2 | 052726 | 193606 | 141947 |
| Kcnv1 | 022342 | 022967 | 022967 |
| Kcnv1 | 022342 | 228536 | N/A |
| Kctd12b | 041633 | 039424 | 037539 |
| Kctd12b | 041633 | 112572 | 108191 |
| Kctd13 | 030685 | 032924 | 032924 |
| Kctd13 | 030685 | 141369 | N/A |
| Kctd13 | 030685 | 139233 | N/A |
| Kctd3 | 026608 | 193143 | 141861 |
| Kctd3 | 026608 | 085678 | 082821 |
| Kctd3 | 026608 | 192200 | N/A |
| Kctd3 | 026608 | 195745 | N/A |
| Kctd3 | 026608 | 195658 | 141863 |
| Kctd3 | 026608 | 195488 | N/A |
| Kctd3 | 026608 | 192458 | N/A |
| Kctd3 | 026608 | 193590 | N/A |
| Kctd3 | 026608 | 195787 | N/A |
| Kctd3 | 026608 | 193273 | N/A |
| Kdm5d | 056673 | 189069 | 139636 |
| Kdm5d | 056673 | 055032 | 061095 |
| Kdm5d | 056673 | 188910 | N/A |
| Kdm5d | 056673 | 186696 | 140663 |
| Kdm5d | 056673 | 186726 | 140462 |
| Kdm5d | 056673 | 189626 | N/A |
| Kdm5d | 056673 | 185542 | N/A |
| Kdm5d | 056673 | 187296 | N/A |
| Kdm5d | 056673 | 189955 | N/A |
| Khdrbs3 | 022332 | 022954 | 022954 |
| 9530077C05Rik | 036411 | 058868 | 062120 |
| 9530077C05Rik | 036411 | 213598 | N/A |
| 9530077C05Rik | 036411 | 214436 | 149413 |
| 9530077C05Rik | 036411 | 213133 | N/A |
| 1810041L15Rik | 062760 | 080751 | 079575 |
| 1810041L15Rik | 062760 | 189248 | 141117 |
| 1810041L15Rik | 062760 | 189994 | 140712 |
| 1810041L15Rik | 062760 | 186527 | 140964 |
| Kif13a | 021375 | 056978 | 055304 |
| Kif13a | 021375 | 223881 | 153657 |
| Kif13a | 021375 | 225836 | 153536 |
| Kif13a | 021375 | 224756 | 153385 |
| Kif13a | 021375 | 225591 | 153614 |
| Kif13a | 021375 | 223856 | 152982 |
| Kif13a | 021375 | 225904 | N/A |
| Kif13a | 021375 | 224457 | N/A |
| Kif13a | 021375 | 224923 | N/A |
| Kif13b | 060012 | 224126 | 153252 |
| Kif13b | 060012 | 224507 | N/A |
| Kif13b | 060012 | 224503 | 153168 |
| Kif13b | 060012 | 224677 | N/A |
| Kif13b | 060012 | 100473 | 098041 |
| Kif19a | 010021 | 126555 | N/A |
| Kif19a | 010021 | 137326 | N/A |
| Kif19a | 010021 | 138804 | 115663 |
| Kif19a | 010021 | 084368 | 081398 |
| Kif19a | 010021 | 131782 | N/A |
| Kif19a | 010021 | 138340 | 122743 |
| Kif19a | 010021 | 134165 | N/A |
| Kif21b | 041642 | 075164 | 074661 |
| Kif21b | 041642 | 130864 | 114297 |

TABLE 3-continued

ENSEMBL IDs for rats

| Symbol | MUSG | MUST | MUSP |
|--------|------|------|------|
| Kif21b | 041642 | 122892 | N/A |
| Kif21b | 041642 | 171381 | 131815 |
| Kif21b | 041642 | 127624 | N/A |
| Kif21b | 041642 | 165333 | N/A |
| Kif26b | 026494 | 193931 | N/A |
| Kif26b | 026494 | 161017 | 124462 |
| Kif26b | 026494 | 160789 | 124608 |
| Kif6 | 023999 | 162854 | 124674 |
| Kif6 | 023999 | 159354 | N/A |
| Kif6 | 023999 | 162029 | 125227 |
| Kif6 | 023999 | 024798 | N/A |
| Kif6 | 023999 | 159396 | N/A |
| Kif6 | 023999 | 160049 | N/A |
| Kif6 | 023999 | 162419 | N/A |
| Kirrel | 041734 | 159976 | 125525 |
| Kirrel | 041734 | 041732 | 043756 |
| Kirrel | 041734 | 107618 | 103243 |
| Kit | 005672 | 144270 | 116465 |
| Kit | 005672 | 005815 | 005815 |
| Kit | 005672 | 143221 | N/A |
| Kit | 005672 | 151357 | N/A |
| Kit | 005672 | 136002 | N/A |
| Kit | 005672 | 148993 | N/A |
| Kit | 005672 | 202167 | N/A |
| Kit | 005672 | 201240 | N/A |
| Kitl | 019966 | 105283 | 100920 |
| Kitl | 019966 | 219050 | N/A |
| Kitl | 019966 | 130190 | 123360 |
| Kitl | 019966 | 218200 | 151554 |
| Kitl | 019966 | 020129 | 020129 |
| Kitl | 019966 | 219881 | N/A |
| Klhl13 | 036782 | 115313 | 110968 |
| Klhl13 | 036782 | 115319 | 110974 |
| Klhl13 | 036782 | 115316 | 110971 |
| Klhl13 | 036782 | 115317 | 110972 |
| Klhl13 | 036782 | 144360 | N/A |
| Klhl13 | 036782 | 153345 | N/A |
| Klhl13 | 036782 | 035973 | 041190 |
| Klhl5 | 054920 | 204097 | 144976 |
| Klhl5 | 054920 | 101191 | 098752 |
| Klhl5 | 054920 | 204348 | 144732 |
| Klhl5 | 054920 | 204829 | N/A |
| Klhl5 | 054920 | 204479 | N/A |
| Klhl5 | 054920 | 203561 | N/A |
| Klhl5 | 054920 | 203538 | 145269 |
| Klk6 | 050063 | 107968 | 103602 |
| Klk6 | 050063 | 107966 | 103600 |
| Klk6 | 050063 | 177514 | 135591 |
| Klk6 | 050063 | 107967 | 103601 |
| Kndc1 | 066129 | 154782 | N/A |
| Kndc1 | 066129 | 121839 | 113856 |
| Kndc1 | 066129 | 156941 | N/A |
| Kndc1 | 066129 | 210154 | N/A |
| Kndc1 | 066129 | 053445 | 050586 |
| Krt24 | 020913 | 017255 | 017255 |
| Ksr2 | 061578 | 073347 | N/A |
| Ksr2 | 061578 | 180430 | 137670 |
| L3hypdh | 019718 | 138029 | N/A |
| L3hypdh | 019718 | 124405 | N/A |
| L3hypdh | 019718 | 019862 | 019862 |
| L3mbtl2 | 022394 | 023029 | 023029 |
| L3mbtl2 | 022394 | 174229 | 133967 |
| L3mbtl2 | 022394 | 172620 | N/A |
| L3mbtl2 | 022394 | 172568 | N/A |
| L3mbtl2 | 022394 | 172748 | 134333 |
| L3mbtl2 | 022394 | 174274 | N/A |
| L3mbtl2 | 022394 | 173105 | N/A |
| L3mbtl2 | 022394 | 173607 | N/A |
| L3mbtl2 | 022394 | 174497 | 133549 |
| L3mbtl2 | 022394 | 174401 | N/A |
| L3mbtl2 | 022394 | 173761 | N/A |
| Lama1 | 032796 | 035471 | 043957 |
| Lama2 | 019899 | 186279 | N/A |
| Lama2 | 019899 | 092639 | 090304 |
| Lama2 | 019899 | 219763 | 151741 |
| Lama2 | 019899 | 189575 | 140716 |

TABLE 3-continued

ENSEMBL IDs for rats

| Symbol | MUSG | MUST | MUSP |
|--------|------|------|------|
| Lama2 | 019899 | 185839 | N/A |
| Lama2 | 019899 | 186965 | N/A |
| Lama2 | 019899 | 188963 | N/A |
| Lama2 | 019899 | 187535 | N/A |
| Lama4 | 019846 | 159506 | N/A |
| Lama4 | 019846 | 019992 | 019992 |
| Lama4 | 019846 | 162211 | N/A |
| Lama4 | 019846 | 161303 | N/A |
| Lama4 | 019846 | 159580 | N/A |
| Lama4 | 019846 | 161992 | N/A |
| Lama4 | 019846 | 163036 | N/A |
| Lamb1 | 002900 | 169088 | 132778 |
| Lamb1 | 002900 | 002979 | 002979 |
| Lamb1 | 002900 | 164228 | N/A |
| Lamb1 | 002900 | 170495 | 132001 |
| Lamb1 | 002900 | 169065 | N/A |
| Lamb1 | 002900 | 164009 | N/A |
| Lamb1 | 002900 | 172134 | N/A |
| Lamp5 | 027270 | 144403 | 120703 |
| Lamp5 | 027270 | 057503 | 061180 |
| Lamp5 | 027270 | 154674 | N/A |
| Lamp5 | 027270 | 143777 | N/A |
| Lamp5 | 027270 | 123436 | N/A |
| Laptm4b | 022257 | 022867 | 022867 |
| Laptm4b | 022257 | 226437 | 154241 |
| Laptm4b | 022257 | 226627 | 153935 |
| Laptm4b | 022257 | 228547 | 154118 |
| Lars2 | 035202 | 038863 | 036710 |
| Lars2 | 035202 | 215674 | N/A |
| Lars2 | 035202 | 214074 | N/A |
| Lars2 | 035202 | 217116 | 150083 |
| Lars2 | 035202 | 216843 | 150895 |
| Lars2 | 035202 | 215464 | 149082 |
| Lars2 | 035202 | 214557 | N/A |
| Lars2 | 035202 | 213711 | N/A |
| Lars2 | 035202 | 215087 | N/A |
| Lbh | 024063 | 024857 | 024857 |
| Lbh | 024063 | 148556 | 123062 |
| Lcat | 035237 | 038896 | 038232 |
| Lcorl | 015882 | 045586 | 042677 |
| Lcorl | 015882 | 190036 | 140503 |
| Lcorl | 015882 | 121573 | 112416 |
| Lcorl | 015882 | 199744 | N/A |
| Lcorl | 015882 | 200142 | N/A |
| Lcorl | 015882 | 087164 | 084408 |
| Lcorl | 015882 | 016026 | 016026 |
| Lcorl | 015882 | 189859 | 139996 |
| Lcorl | 015882 | 187615 | 139466 |
| Lcorl | 015882 | 067997 | N/A |
| Lcorl | 015882 | 156295 | N/A |
| Lcorl | 015882 | 186633 | 141174 |
| Ldah | 037669 | 037383 | 042285 |
| Ldah | 037669 | 218883 | 151802 |
| Ldah | 037669 | 218305 | 151881 |
| Ldah | 037669 | 219043 | 151289 |
| Ldah | 037669 | 218086 | 151612 |
| Ldah | 037669 | 169104 | 129424 |
| Ldah | 037669 | 220345 | 151631 |
| Ldah | 037669 | 217763 | N/A |
| Ldah | 037669 | 217999 | 151852 |
| Ldah | 037669 | 219357 | 151362 |
| Ldah | 037669 | 219058 | 151541 |
| Ldah | 037669 | 220274 | 151309 |
| Ldah | 037669 | 217872 | 151257 |
| Ldah | 037669 | 219532 | 151941 |
| Ldb2 | 039706 | 199534 | 142442 |
| Ldb2 | 039706 | 070748 | 067737 |
| Ldb2 | 039706 | 199256 | 143775 |
| Ldb2 | 039706 | 199261 | 143289 |
| Ldb2 | 039706 | 199471 | N/A |
| Ldb2 | 039706 | 198356 | N/A |
| Ldb2 | 039706 | 198894 | N/A |
| Leng9 | 043432 | 058358 | 061079 |
| Lfng | 029570 | 031555 | 031555 |
| Lfng | 029570 | 200626 | N/A |
| Lfng | 029570 | 199848 | N/A |

TABLE 3-continued | TABLE 3-continued

| Symbol | MUSG | MUST | MUSP |
|---|---|---|---|
| Lgi4 | 036560 | 039775 | 041579 |
| Lgi4 | 036560 | 169785 | 145660 |
| Lgi4 | 036560 | 164725 | 146008 |
| Lgi4 | 036560 | 172001 | 125865 |
| Lgr5 | 020140 | 020350 | 020350 |
| Lgr5 | 020140 | 172806 | 133860 |
| Lgr5 | 020140 | 173740 | 133707 |
| Lgr5 | 020140 | 173619 | N/A |
| Lgr5 | 020140 | 144732 | N/A |
| Lgr5 | 020140 | 105272 | N/A |
| Lgr5 | 020140 | 149008 | N/A |
| Lgr5 | 020140 | 129309 | N/A |
| Lgr6 | 042793 | 044828 | 035444 |
| Lgr6 | 042793 | 137968 | 122334 |
| Lgr6 | 042793 | 139369 | N/A |
| Lhfp | 048332 | 059562 | 056364 |
| Lhfp | 048332 | 137954 | N/A |
| Lhfp | 048332 | 147139 | 119019 |
| Lhfp | 048332 | 196913 | N/A |
| Lhfpl2 | 045312 | 054274 | 062239 |
| Lhfpl2 | 045312 | 144838 | N/A |
| Lhfpl2 | 045312 | 156071 | 117113 |
| Lhfpl2 | 045312 | 221096 | 152453 |
| Lhfpl2 | 045312 | 223423 | 152241 |
| Lhfpl2 | 045312 | 120051 | 113786 |
| Lhfpl2 | 045312 | 118195 | 112655 |
| Lhfpl2 | 045312 | 131595 | N/A |
| Lhfpl2 | 045312 | 121618 | 113468 |
| Lhx1 | 018698 | 018842 | 018842 |
| Lhx1 | 018698 | 184646 | 138899 |
| Lhx1 | 018698 | 176503 | N/A |
| Lhx1 | 018698 | 092827 | 090503 |
| Lhx1os | 087211 | 134800 | N/A |
| Lhx1os | 087211 | 126072 | N/A |
| Lhx1os | 087211 | 128121 | N/A |
| Lhx5 | 029595 | 031591 | 031591 |
| Lims2 | 024395 | 025254 | 025254 |
| Lims2 | 024395 | 225404 | 153218 |
| Lims2 | 024395 | 225470 | N/A |
| Lims2 | 024395 | 224383 | 152960 |
| Lims2 | 024395 | 226112 | N/A |
| Lims2 | 024395 | 225400 | N/A |
| Lims2 | 024395 | 223753 | 153122 |
| Lims2 | 024395 | 225125 | N/A |
| Lims2 | 024395 | 224328 | 153433 |
| Lin28b | 063804 | 079390 | 078361 |
| Lin28b | 063804 | 215708 | N/A |
| Lin28b | 063804 | 214555 | N/A |
| Lin7a | 019906 | 020057 | 020057 |
| Lin7a | 019906 | 105280 | 100916 |
| Lin7a | 019906 | 218031 | 151715 |
| Gm28653 | 099906 | 227082 | N/A |
| Gm28653 | 099906 | 185494 | N/A |
| Lingo1 | 049556 | 210032 | 148179 |
| Lingo1 | 049556 | 114256 | 109894 |
| Lingo1 | 049556 | 114247 | 109885 |
| Lingo1 | 049556 | 209596 | N/A |
| Lingo1 | 049556 | 210332 | N/A |
| Lingo1 | 049556 | 209332 | N/A |
| Lingo1 | 049556 | 210995 | N/A |
| Lingo1 | 049556 | 053568 | 059050 |
| Lingo2 | 045083 | 065173 | 069772 |
| Lingo2 | 045083 | 098151 | 095754 |
| Lingo2 | 045083 | 108122 | 103757 |
| Lingo2 | 045083 | 124999 | N/A |
| Lingo2 | 045083 | 145615 | N/A |
| Lingo2 | 045083 | 127372 | N/A |
| Lingo2 | 045083 | 144170 | N/A |
| Lingo2 | 045083 | 125128 | N/A |
| Lingo2 | 045083 | 108124 | 103759 |
| Lingo2 | 045083 | 164772 | 130423 |
| Litaf | 022500 | 023143 | 023143 |
| Litaf | 022500 | 117360 | 112667 |
| Litaf | 022500 | 162323 | 123948 |
| Litaf | 022500 | 140170 | N/A |
| Lmcd1 | 057604 | 032376 | 032376 |
| Lmo2 | 032698 | 111143 | 106773 |
| Lmo2 | 032698 | 111140 | 106770 |
| Lmo2 | 032698 | 133210 | N/A |
| Lmo2 | 032698 | 111139 | 106769 |
| Lmo2 | 032698 | 123437 | 117703 |
| Lmo2 | 032698 | 138815 | 121927 |
| Lmo2 | 032698 | 156813 | 122369 |
| Lmo2 | 032698 | 170926 | 128317 |
| Lonrf2 | 048814 | 147695 | 117600 |
| Lonrf2 | 048814 | 191724 | N/A |
| Lonrf2 | 048814 | 039612 | 047372 |
| Lpcat2 | 033192 | 046290 | 049252 |
| Lpcat2 | 033192 | 210099 | 147941 |
| Lpcat2 | 033192 | 209265 | 148089 |
| Lpcat2 | 033192 | 130471 | N/A |
| Lpcat2 | 033192 | 151106 | N/A |
| Lpp | 033306 | 115314 | 110969 |
| Lpp | 033306 | 078988 | 078005 |
| Lpp | 033306 | 038053 | 036304 |
| Lrch1 | 068015 | 088970 | 086363 |
| Lrch1 | 068015 | 228134 | N/A |
| Lrch1 | 068015 | 228252 | 154004 |
| Lrch1 | 068015 | 226799 | N/A |
| Lrch1 | 068015 | 227433 | N/A |
| Lrig1 | 030029 | 204645 | 144963 |
| Lrig1 | 030029 | 101126 | 098686 |
| Lrig1 | 030029 | 203876 | N/A |
| Lrig1 | 030029 | 141014 | N/A |
| Lrig1 | 030029 | 150811 | N/A |
| Lrig1 | 030029 | 124165 | N/A |
| Lrig1 | 030029 | 032105 | 032105 |
| Lrp1 | 040249 | 049149 | 044004 |
| Lrp1 | 040249 | 125480 | N/A |
| Lrp1 | 040249 | 121829 | 113584 |
| Lrp1 | 040249 | 133620 | 115305 |
| Lrp1 | 040249 | 129877 | N/A |
| Lrp1 | 040249 | 129727 | 120567 |
| Lrp1 | 040249 | 145947 | N/A |
| Lrp1 | 040249 | 140269 | N/A |
| Lrp1 | 040249 | 135188 | N/A |
| Lrp1 | 040249 | 118455 | 113497 |
| Lrp1b | 049252 | 129974 | N/A |
| Lrp1b | 049252 | 052550 | 054275 |
| Lrp1b | 049252 | 142546 | 117212 |
| Lrp1b | 049252 | 203015 | 145066 |
| Lrp1b | 049252 | 134032 | N/A |
| Lrp1b | 049252 | 203080 | 145278 |
| Lrp1b | 049252 | 138700 | N/A |
| Lrp1b | 049252 | 204204 | 145045 |
| Lrp1b | 049252 | 133104 | N/A |
| Lrp1b | 049252 | 142688 | 144957 |
| Lrp1b | 049252 | 185258 | 139874 |
| Lrp1b | 049252 | 167270 | 129192 |
| Lrrc2 | 032495 | 035076 | 035076 |
| Lrrc2 | 032495 | 196834 | 142360 |
| Lrrc2 | 032495 | 196598 | 143319 |
| Lrrc20 | 037151 | 049242 | 048042 |
| Lrrc38 | 028584 | 052458 | 053597 |
| Lrrc38 | 097351 | 181564 | 137856 |
| Lrrc3b | 045201 | 055211 | 059463 |
| Lrrc3b | 045201 | 223700 | 153616 |
| Lrrc3b | 045201 | 163937 | 128624 |
| Lrrc4c | 050587 | 135431 | 130984 |
| Lrrc4c | 050587 | 162807 | 125218 |
| Lrrc4c | 050587 | 059049 | 131795 |
| Lrrc4c | 050587 | 170144 | 128490 |
| Lrrc7 | 028176 | 200196 | 143365 |
| Lrrc7 | 028176 | 200137 | 142498 |
| Lrrc7 | 028176 | 199890 | 142440 |
| Lrrc7 | 028176 | 197866 | N/A |
| Lrrc7 | 028176 | 198284 | N/A |
| Lrrc7 | 028176 | 106044 | 101659 |
| Lrrk2 | 036273 | 060642 | 052584 |
| Lrrk2 | 036273 | 140734 | N/A |
| Lrrk2 | 036273 | 156900 | N/A |
| Lrrk2 | 036273 | 133743 | N/A |

TABLE 3-continued

ENSEMBL IDs for rats

| Symbol | MUSG | MUST | MUSP |
|---|---|---|---|
| Lrrk2 | 036273 | 137657 | N/A |
| Lrrk2 | 036273 | 172797 | N/A |
| Lrrtm4 | 052581 | 147663 | 117263 |
| Lrrtm4 | 052581 | 128718 | 114425 |
| Lrrtm4 | 052581 | 126005 | 117445 |
| Lrrtm4 | 052581 | 133918 | 115016 |
| Lrrtm4 | 052581 | 126399 | 121124 |
| Lrrtm4 | 052581 | 136421 | 121621 |
| Lrrtm4 | 052581 | 145407 | 114465 |
| Lrrtm4 | 052581 | 074662 | 074232 |
| Lrtm1 | 045776 | 055662 | 061828 |
| Lrtm1 | 045776 | 224760 | 153372 |
| Lrtm1 | 045776 | 224708 | 153518 |
| Ltbp2 | 002020 | 002073 | 002073 |
| Ltbp2 | 002020 | 163189 | 127693 |
| Ltbp2 | 002020 | 166383 | 127255 |
| Ltbp2 | 002020 | 163214 | 132067 |
| Ltbp2 | 002020 | 165141 | 132690 |
| Ltbp2 | 002020 | 168699 | N/A |
| Ltbp2 | 002020 | 110254 | 105883 |
| Lurap1 | 028701 | 030469 | 030469 |
| Lurap1 | 028701 | 135982 | N/A |
| Lurap1l | 048706 | 055922 | 062628 |
| Ly6e | 022587 | 188866 | 140145 |
| Ly6e | 022587 | 187606 | 139471 |
| Ly6e | 022587 | 189186 | 139477 |
| Ly6e | 022587 | 187284 | 140553 |
| Ly6e | 022587 | 190810 | 139482 |
| Ly6e | 022587 | 185861 | 141145 |
| Ly6e | 022587 | 185863 | 140060 |
| Ly6e | 022587 | 191127 | 139966 |
| Ly6e | 022587 | 191436 | 139549 |
| Ly6e | 022587 | 186927 | N/A |
| Ly6e | 022587 | 188503 | N/A |
| Ly6e | 022587 | 191145 | 140829 |
| Ly6e | 022587 | 191439 | N/A |
| Ly6e | 022587 | 188042 | 141059 |
| Ly6e | 022587 | 051698 | 056703 |
| Ly6e | 022587 | 169343 | 132081 |
| Lypd1 | 026344 | 159417 | 125149 |
| Lypd1 | 026344 | 162899 | 125158 |
| Lypd1 | 027582 | 027582 | 027582 |
| Lypd1 | 026344 | 159529 | 123824 |
| Lypd1 | 026344 | 161361 | 124265 |
| Lypd6 | 050447 | 053208 | 061578 |
| Lypd6 | 050447 | 128451 | 116803 |
| Lypd6 | 050447 | 126337 | 119755 |
| Lypd6 | 050447 | 112712 | 108332 |
| Lypd6 | 050447 | 169232 | 131002 |
| Lypd6b | 026765 | 028103 | 028103 |
| Lypd6b | 026765 | 153422 | N/A |
| Lypd6b | 026765 | 129867 | N/A |
| Lyzl4 | 032530 | 077706 | 076887 |
| Lyzl4 | 032530 | 120918 | 113034 |
| Lyzl4 | 032530 | 213757 | 151031 |
| Lyzl4 | 032530 | 125075 | 115284 |
| Lyzl4 | 032530 | 214592 | 150807 |
| Mag | 036634 | 187137 | 139564 |
| Mag | 036634 | 191081 | 139881 |
| Mag | 036634 | 188569 | 140526 |
| Mag | 036634 | 186422 | N/A |
| Mag | 036634 | 190638 | 140578 |
| Mag | 036634 | 190950 | 139861 |
| Mag | 036634 | 191486 | N/A |
| Mag | 036634 | 040548 | 041464 |
| Magi3 | 052539 | 064371 | 067932 |
| Magi3 | 052539 | 121198 | 112934 |
| Magi3 | 052539 | 122303 | 113713 |
| Magi3 | 052539 | 199201 | N/A |
| Mak | 021363 | 225084 | 152946 |
| Mak | 021363 | 225789 | N/A |
| Mak | 021363 | 070193 | 064750 |
| Mak | 021363 | 224740 | 153314 |
| Mak | 021363 | 225906 | 153176 |
| Mak | 021363 | 224423 | 152961 |
| Mak | 021363 | 165087 | 129615 |
| Mak | 021363 | 021792 | 021792 |
| Mal | 027375 | 028854 | 028854 |
| Mal | 027375 | 028853 | 028853 |
| Mal2 | 024479 | 025356 | 025356 |
| Man1a | 003746 | 003843 | 003843 |
| Man1a | 003746 | 105470 | 101110 |
| Man1a | 003746 | 218317 | 151328 |
| Man1a | 003746 | 220088 | 151568 |
| Man1a | 003746 | 219234 | N/A |
| Man1a | 003746 | 146483 | N/A |
| Man1a | 003746 | 105469 | N/A |
| Man1a | 003746 | 133330 | N/A |
| Man1c1 | 037306 | 054096 | 050979 |
| Man1c1 | 037306 | 176606 | N/A |
| Man1c1 | 037306 | 038628 | 037949 |
| Man2a1 | 024085 | 086723 | 083928 |
| Man2a1 | 024085 | 169239 | N/A |
| Man2a1 | 024085 | 169668 | 130529 |
| Map2k6 | 020623 | 020949 | 020949 |
| Map2k6 | 020623 | 146084 | N/A |
| Map2k6 | 020623 | 100260 | 097831 |
| Map2k6 | 020623 | 133920 | N/A |
| Map2k6 | 020623 | 146540 | N/A |
| Map6d1 | 041205 | 040880 | 043332 |
| Map7 | 019996 | 020173 | 020173 |
| Map7 | 019996 | 116259 | 111963 |
| Map7 | 019996 | 214231 | 149367 |
| Map7 | 019996 | 214823 | N/A |
| Map7 | 019996 | 216909 | N/A |
| Map7 | 019996 | 217251 | N/A |
| Map7 | 019996 | 215924 | 150818 |
| Map7 | 019996 | 216065 | N/A |
| Map7 | 019996 | 213386 | N/A |
| Map7 | 019996 | 213312 | 151101 |
| Map7 | 019996 | 215812 | N/A |
| Map7 | 019996 | 216474 | N/A |
| Map7 | 019996 | 216308 | N/A |
| Mapk12 | 022610 | 088827 | 086207 |
| Mapk4 | 024558 | 159162 | 123922 |
| Mapk4 | 024558 | 091851 | 089462 |
| Mapk4 | 024558 | 162863 | 124408 |
| Mapk4 | 024558 | 160601 | N/A |
| March11 | 022269 | 126304 | 153852 |
| March11 | 022269 | 140840 | 118729 |
| March11 | 022269 | 152841 | 120622 |
| March11 | 022269 | 155819 | N/A |
| Marcks | 069662 | 092584 | 090245 |
| Marcksl1 | 047945 | 062356 | 055637 |
| Marveld2 | 021636 | 225754 | 153294 |
| Marveld2 | 021636 | 163163 | 129990 |
| Marveld2 | 021636 | 168772 | 126438 |
| Marveld2 | 021636 | 022137 | 022137 |
| Masp1 | 022887 | 089883 | 087327 |
| Matn1 | 040533 | 102576 | 099636 |
| Matn4 | 016995 | 109359 | 104983 |
| Matn4 | 016995 | 109358 | 104982 |
| Matn4 | 016995 | 103103 | 099392 |
| Matn4 | 016995 | 103104 | 099393 |
| Matn4 | 016995 | 154940 | N/A |
| Mboat1 | 038732 | 153269 | N/A |
| Mboat1 | 038732 | 152798 | N/A |
| Mboat1 | 038732 | 047311 | 045441 |
| Mboat1 | 038732 | 220870 | N/A |
| Mboat1 | 038732 | 222095 | N/A |
| Mboat2 | 020646 | 222198 | 152150 |
| Mboat2 | 020646 | 221952 | 152348 |
| Mboat2 | 020646 | 220497 | N/A |
| Mboat2 | 020646 | 078902 | 077937 |
| Mboat2 | 020646 | 110942 | 106567 |
| Mboat2 | 020646 | 222994 | 152712 |
| Mcam | 032135 | 149241 | 121090 |
| Mcam | 032135 | 034650 | 034650 |
| Mcam | 032135 | 098852 | 096451 |
| Mcam | 032135 | 216002 | 149002 |
| Mcam | 032135 | 147836 | 117924 |
| Mcam | 032135 | 132490 | N/A |

TABLE 3-continued

| ENSEMBL IDs for rats | | | |
|---|---|---|---|
| Symbol | MUSG | MUST | MUSP |
| Mcc | 071856 | 089874 | 087318 |
| Mcc | 071856 | 164666 | 128032 |
| Mcc | 071856 | 202090 | N/A |
| Mcc | 071856 | 202845 | N/A |
| Mcc | 071856 | 201270 | N/A |
| Mctp1 | 021596 | 125209 | 118958 |
| Mctp1 | 021596 | 126960 | 120673 |
| Mctp1 | 021596 | 109589 | 105218 |
| Mctp1 | 021596 | 137052 | N/A |
| Mctp1 | 021596 | 155275 | N/A |
| Mctp1 | 021596 | 122843 | N/A |
| Mctp1 | 021596 | 149028 | N/A |
| Mctp1 | 021596 | 109583 | 105212 |
| Mdfi | 032717 | 113280 | 108905 |
| Mdfi | 032717 | 066368 | 069915 |
| Mdfi | 032717 | 035375 | 037888 |
| Mdfi | 032717 | 125745 | N/A |
| Mdfi | 032717 | 131971 | 120454 |
| Mdfi | 032717 | 140234 | N/A |
| Mdfi | 032717 | 152455 | 117665 |
| Mdfi | 032717 | 132125 | 114581 |
| Mdfi | 032717 | 129360 | 114930 |
| Mdga2 | 034912 | 037181 | 046761 |
| Mdga2 | 034912 | 222987 | 152049 |
| Mdga2 | 034912 | 222623 | 152548 |
| Mdga2 | 034912 | 178814 | 137608 |
| Mdga2 | 034912 | 101379 | 098930 |
| Mdga2 | 034912 | 178724 | N/A |
| Mdga2 | 034912 | 223289 | N/A |
| Mdga2 | 034912 | 179729 | N/A |
| Mdga2 | 034912 | 177690 | N/A |
| Mdga2 | 034912 | 179577 | N/A |
| Mdga2 | 034912 | 179025 | N/A |
| Mdga2 | 034912 | 223141 | 152613 |
| Mdga2 | 034912 | 222167 | 152112 |
| Mdga2 | 034912 | 113942 | 109575 |
| Med12l | 056476 | 040846 | 041859 |
| Med12l | 056476 | 199659 | 142903 |
| Med12l | 056476 | 197374 | 143419 |
| Med12l | 056476 | 029393 | 029393 |
| Med12l | 056476 | 040325 | 042269 |
| Med12l | 056476 | 164225 | 127038 |
| Mef2c | 005583 | 198199 | 143742 |
| Mef2c | 005583 | 199450 | 143315 |
| Mef2c | 005583 | 198916 | 143235 |
| Mef2c | 005583 | 200123 | 142833 |
| Mef2c | 005583 | 005722 | 005722 |
| Mef2c | 005583 | 163888 | 132547 |
| Mef2c | 005583 | 196493 | 142897 |
| Mef2c | 005583 | 200394 | 143598 |
| Mef2c | 005583 | 199019 | 143401 |
| Mef2c | 005583 | 199105 | 143212 |
| Mef2c | 005583 | 196832 | N/A |
| Mef2c | 005583 | 199432 | 142714 |
| Mef2c | 005583 | 198069 | 143286 |
| Mef2c | 005583 | 197681 | 143420 |
| Mef2c | 005583 | 197722 | 142456 |
| Mef2c | 005583 | 197938 | 143187 |
| Mef2c | 005583 | 199262 | N/A |
| Mef2c | 005583 | 198064 | 142399 |
| Mef2c | 005583 | 196730 | 143338 |
| Mef2c | 005583 | 196207 | 143221 |
| Mef2c | 005583 | 197146 | 143227 |
| Mef2c | 005583 | 197022 | N/A |
| Mef2c | 005583 | 185052 | 138826 |
| Mef2c | 005583 | 195984 | 143611 |
| Mef2c | 005583 | 199167 | 142884 |
| Mef2c | 005583 | 195904 | 143339 |
| Mef2c | 005583 | 198217 | 142487 |
| Mef2c | 005583 | 199210 | 142595 |
| Mef2c | 005583 | 200138 | 142715 |
| Mef2c | 005583 | 198360 | 143058 |
| Mef2c | 005583 | 197145 | 142619 |
| Megf10 | 024593 | 075770 | 075174 |
| Megf10 | 024593 | 139892 | 116814 |
| Mei4 | 043289 | 057067 | 061341 |

TABLE 3-continued

| ENSEMBL IDs for rats | | | |
|---|---|---|---|
| Symbol | MUSG | MUST | MUSP |
| Mei4 | 043289 | 189832 | 140647 |
| Mei4 | 043289 | 189391 | 139589 |
| Meis1 | 020160 | 144988 | 134969 |
| Meis1 | 020160 | 102878 | 099942 |
| Meis1 | 020160 | 068264 | 069277 |
| Meis1 | 020160 | 118661 | N/A |
| Meis1 | 020160 | 177417 | 135726 |
| Meis1 | 020160 | 177357 | 139074 |
| Meis1 | 020160 | 125722 | N/A |
| Meis1 | 020160 | 137300 | N/A |
| Meis1 | 020160 | 185131 | 139219 |
| Meis2 | 027210 | 028639 | 028639 |
| Meis2 | 027210 | 102538 | 099597 |
| Meis2 | 027210 | 110907 | 106532 |
| Meis2 | 027210 | 110908 | 106533 |
| Meis2 | 027210 | 110906 | 106531 |
| Meis2 | 027210 | 074285 | 073898 |
| Meis2 | 027210 | 120995 | N/A |
| Meis2 | 027210 | 189640 | N/A |
| Meis2 | 027210 | 151279 | N/A |
| Meis2 | 027210 | 177493 | N/A |
| Meis2 | 027210 | 149217 | N/A |
| Meis2 | 027210 | 118654 | N/A |
| Meis2 | 027210 | 150477 | N/A |
| Meis2 | 027210 | 154671 | N/A |
| Meis2 | 027210 | 140461 | N/A |
| Meis2 | 027210 | 135543 | N/A |
| Meis2 | 027210 | 134314 | N/A |
| Meis2 | 027210 | 133990 | N/A |
| Meis2 | 027210 | 138526 | N/A |
| Mertk | 014361 | 014505 | 014505 |
| Mertk | 014361 | 140221 | N/A |
| Metrn | 002274 | 165838 | 127275 |
| Metrn | 002344 | 002344 | 002344 |
| Mfap3l | 031647 | 161421 | 124136 |
| Mfap3l | 031647 | 160719 | 125139 |
| Mfap3l | 031647 | 161702 | 124330 |
| Mfap3l | 031647 | 034066 | 034066 |
| Mff | 026150 | 078332 | 077446 |
| Mff | 026150 | 161572 | N/A |
| Mff | 026150 | 073025 | 072784 |
| Mff | 026150 | 161648 | 124164 |
| Mff | 026150 | 162056 | N/A |
| Mff | 026150 | 160786 | 125230 |
| Mff | 026150 | 162003 | 124334 |
| Mff | 026150 | 160972 | 124200 |
| Mff | 026150 | 160750 | 125223 |
| Mff | 026150 | 159279 | 123713 |
| Mff | 026150 | 160044 | 125005 |
| Mff | 026150 | 160744 | 125629 |
| Mff | 026150 | 160632 | N/A |
| Mff | 026150 | 188333 | N/A |
| Mff | 026150 | 162794 | N/A |
| Mff | 026150 | 162573 | N/A |
| Mfge8 | 030605 | 206338 | N/A |
| Mfge8 | 030605 | 107409 | 103032 |
| Mfge8 | 030605 | 032825 | 032825 |
| Mfge8 | 030605 | 205563 | 145720 |
| Mfge8 | 030605 | 205649 | N/A |
| Mfge8 | 030605 | 205494 | N/A |
| Mfge8 | 030605 | 205929 | N/A |
| Mfge8 | 030605 | 205688 | N/A |
| Mfge8 | 030605 | 205526 | N/A |
| Mfge8 | 030605 | 206844 | N/A |
| Mfhas1 | 070056 | 037666 | 044135 |
| Mfhas1 | 070056 | 209953 | 147927 |
| Mfhas1 | 070056 | 154989 | N/A |
| Mfsd2a | 028655 | 152308 | N/A |
| Mfsd2a | 028655 | 030408 | 030408 |
| Mfsd2a | 028655 | 138964 | N/A |
| Mfsd2a | 028655 | 127047 | 116782 |
| Mgat4c | 019888 | 146230 | N/A |
| Mgat4c | 019888 | 219195 | 151859 |
| Mgat4c | 019888 | 134930 | N/A |
| Mgat4c | 019888 | 127504 | 117148 |
| Mgat4c | 019888 | 156751 | 116216 |

TABLE 3-continued

| Symbol | MUSG | MUST | MUSP |
|---|---|---|---|
| Mgat4c | 019888 | 138522 | 118056 |
| Mgat4c | 019888 | 130580 | N/A |
| Mgat4c | 019888 | 138016 | 116902 |
| Mgat4c | 019888 | 219683 | N/A |
| Mgat4c | 019888 | 218554 | N/A |
| Mgat4c | 019888 | 143640 | N/A |
| Mgat4c | 019888 | 020039 | 020039 |
| Mgat4c | 019888 | 218984 | N/A |
| Mgat4c | 019888 | 120748 | 114010 |
| Mgat4c | 019888 | 163753 | 131551 |
| Mgat4c | 019888 | 179929 | 135959 |
| Mgat5b | 043857 | 103027 | 099316 |
| Mgat5b | 043857 | 139905 | N/A |
| Mgat5b | 043857 | 136584 | 122276 |
| Mgat5b | 043857 | 126757 | N/A |
| Mgll | 033174 | 113585 | 109215 |
| Mgll | 033174 | 151699 | N/A |
| Mgll | 033174 | 113582 | 109212 |
| Mgll | 033174 | 203608 | 144883 |
| Mgll | 033174 | 113581 | 109211 |
| Mgll | 033174 | 150180 | 145068 |
| Mgll | 033174 | 089449 | 086872 |
| Mgll | 033174 | 203824 | 145364 |
| Mgll | 033174 | 205045 | N/A |
| Mgll | 033174 | 163271 | 127374 |
| Mgst1 | 008540 | 008684 | 008684 |
| Mgst1 | 008540 | 120939 | 112646 |
| Mgst1 | 008540 | 204628 | 144912 |
| Mgst1 | 008540 | 140932 | 145306 |
| Mgst1 | 008540 | 120302 | 113257 |
| Mgst1 | 008540 | 120230 | 113859 |
| Mgst1 | 008540 | 118091 | 112923 |
| Mgst1 | 008540 | 125810 | 114222 |
| Miat | 097767 | 182953 | N/A |
| Miat | 097767 | 181535 | N/A |
| Miat | 097767 | 182258 | N/A |
| Miat | 097767 | 182509 | N/A |
| Miat | 097767 | 183036 | N/A |
| Miat | 097767 | 182699 | N/A |
| Mical2 | 038244 | 050149 | 051163 |
| Mical2 | 038244 | 106647 | N/A |
| Mical2 | 038244 | 106648 | N/A |
| Mical2 | 038244 | 037991 | 047639 |
| Mical2 | 038244 | 150428 | N/A |
| Mical2 | 038244 | 144509 | 123341 |
| Micalcl | 030771 | 051308 | 062443 |
| Micalcl | 030771 | 033033 | 033033 |
| Micalcl | 030771 | 106645 | 102256 |
| Micalcl | 030771 | 213108 | 150200 |
| Micalcl | 030771 | 140202 | N/A |
| Mid1 | 035299 | 112104 | 107732 |
| Mid1 | 035299 | 036753 | 038765 |
| Mid1 | 035299 | 078947 | 077974 |
| Mid1 | 035299 | 149258 | N/A |
| Mid1 | 035299 | 133857 | N/A |
| Mid1 | 035299 | 146073 | N/A |
| Mid1 | 035299 | 152163 | N/A |
| Mid1 | 035299 | 129642 | N/A |
| Mid1 | 035299 | 151722 | N/A |
| Mid1 | 035299 | 112107 | 107735 |
| Mid1 | 035299 | 079443 | 078412 |
| Mid1 | 035299 | 143815 | N/A |
| Mid1 | 035299 | 171433 | 126746 |
| Mid1 | 035299 | 163810 | 128176 |
| Mid1 | 035299 | 112105 | 107733 |
| Mid2 | 000266 | 112990 | 108614 |
| Mid2 | 000266 | 112988 | 108612 |
| Mid2 | 000266 | 140144 | N/A |
| Mid2 | 000266 | 128809 | 123221 |
| Mid2 | 000266 | 112993 | 108617 |
| Midn | 035621 | 099492 | 097091 |
| Midn | 035621 | 042057 | 046967 |
| Midn | 035621 | 151202 | 115717 |
| Midn | 035621 | 124179 | N/A |
| Midn | 035621 | 153477 | 119787 |
| Midn | 035621 | 146516 | 119962 |

TABLE 3-continued

| Symbol | MUSG | MUST | MUSP |
|---|---|---|---|
| Midn | 035621 | 144526 | 120988 |
| Mkx | 061013 | 176586 | N/A |
| Mkx | 061013 | 079788 | 078718 |
| Mkx | 061013 | 188926 | N/A |
| Mkx | 061013 | 176608 | N/A |
| Mkx | 061013 | 176757 | N/A |
| Mlc1 | 035805 | 042594 | 047667 |
| Mlc1 | 035805 | 109368 | 104993 |
| Mlycd | 074064 | 098367 | 095970 |
| Mlycd | 074064 | 145121 | N/A |
| Mmd2 | 039533 | 037048 | 039357 |
| Mmd2 | 039533 | 195947 | N/A |
| Mmd2 | 039533 | 196972 | N/A |
| Mmp14 | 000957 | 089688 | 087119 |
| Mmp14 | 000957 | 197874 | 142665 |
| Mmp14 | 000957 | 225641 | 153679 |
| Mmp14 | 000957 | 197947 | N/A |
| Mmp14 | 000957 | 198679 | N/A |
| Mmp14 | 000957 | 196155 | 143012 |
| Mmp14 | 000957 | 226710 | N/A |
| Mmp2 | 031740 | 034187 | 034187 |
| Mmp2 | 031740 | 211691 | N/A |
| Mmp2 | 031740 | 211308 | N/A |
| Mmp2 | 031740 | 211567 | 147838 |
| Mmp24 | 027612 | 029141 | 029141 |
| Mmp24 | 027612 | 135945 | N/A |
| Mns1 | 032221 | 183809 | 139105 |
| Mns1 | 032221 | 184604 | 139232 |
| Mns1 | 032221 | 034746 | 034746 |
| Mobp | 032517 | 068698 | 071084 |
| Mobp | 032517 | 215512 | 149831 |
| Mobp | 032517 | 111627 | 107254 |
| Mobp | 032517 | 093773 | 091287 |
| Mobp | 032517 | 174193 | 134410 |
| Mobp | 032517 | 214943 | 149285 |
| Mobp | 032517 | 214008 | N/A |
| Mog | 076439 | 102665 | 099726 |
| Mog | 076439 | 167275 | 129489 |
| Mpp6 | 038388 | 166318 | 125880 |
| Mpp6 | 038388 | 036236 | 039314 |
| Mpp6 | 038388 | 204545 | 144737 |
| Mpp6 | 038388 | 203415 | N/A |
| Mpp6 | 038388 | 036225 | 038772 |
| Mpp6 | 038388 | 171601 | 129004 |
| Mpp6 | 038388 | 167628 | 129355 |
| Mpp6 | 038388 | 167063 | N/A |
| Mpp6 | 038388 | 167319 | N/A |
| Mpp7 | 057440 | 115869 | 111535 |
| Mpped1 | 041708 | 109470 | 105096 |
| Mpped1 | 041708 | 123387 | 123230 |
| Mpped1 | 041708 | 046168 | 041981 |
| Mpped1 | 041708 | 109469 | 105095 |
| Mpped1 | 041708 | 150489 | 128786 |
| Mpped1 | 041708 | 125739 | 131463 |
| Mpped1 | 041708 | 148868 | 131679 |
| Mpped1 | 041708 | 163723 | 126242 |
| Mpped1 | 041708 | 172115 | 132518 |
| Mpped1 | 041708 | 171560 | 125835 |
| Mpped1 | 041708 | 172398 | 131333 |
| Mrm2 | 029557 | 031536 | 031536 |
| Msi1 | 054256 | 150779 | 120516 |
| Msi1 | 054256 | 151444 | N/A |
| Msi1 | 054256 | 067168 | 070415 |
| Msi1 | 054256 | 131079 | 144032 |
| Msi1 | 054256 | 145005 | N/A |
| Msi1 | 054256 | 139918 | N/A |
| Msi1 | 054256 | 145840 | N/A |
| Msi1 | 054256 | 136586 | 143900 |
| Msi1 | 054256 | 130849 | N/A |
| Msra | 054733 | 067927 | 065754 |
| Msra | 054733 | 210428 | 147689 |
| Msra | 054733 | 210363 | 148189 |
| Msra | 054733 | 209392 | N/A |
| Msra | 054733 | 209513 | N/A |
| Msx2 | 021469 | 021922 | 021922 |
| Msx2 | 021469 | 188606 | N/A |

TABLE 3-continued

ENSEMBL IDs for rats

| Symbol | MUSG | MUST | MUSP |
|---|---|---|---|
| mt-Co1 | 064351 | 082402 | 080993 |
| mt-Nd4 | 064363 | 082414 | 081000 |
| Mt3 | 031760 | 034211 | 034211 |
| Mt3 | 031760 | 211930 | 148345 |
| Mt3 | 031760 | 211915 | 148383 |
| Mtch2 | 027282 | 136872 | 121851 |
| Mtch2 | 027282 | 150232 | 118566 |
| Mtch2 | 027282 | 111467 | 107092 |
| Mtch2 | 027282 | 111468 | 107093 |
| Mtch2 | 027282 | 057216 | N/A |
| Mtch2 | 027282 | 148936 | N/A |
| Mtch2 | 027282 | 146392 | N/A |
| Mtch2 | 027282 | 143773 | N/A |
| Mtch2 | 027282 | 142350 | N/A |
| Mtch2 | 027282 | 144696 | N/A |
| Mtch2 | 027282 | 135026 | N/A |
| Mtch2 | 111714 | 214148 | 149233 |
| Mtch2 | 111714 | 213376 | 149651 |
| Mtch2 | 111714 | 217470 | N/A |
| Mtch2 | 111714 | 214378 | 150912 |
| Mtch2 | 111714 | 215609 | N/A |
| Mtch2 | 111714 | 216454 | 151033 |
| Mtch2 | 111714 | 216814 | N/A |
| Mtch2 | 111714 | 215750 | N/A |
| Mtch2 | 111714 | 214987 | N/A |
| Mtch2 | 111714 | 216471 | N/A |
| Mtch2 | 111714 | 217168 | N/A |
| Mtfp1 | 004748 | 004868 | 004868 |
| Mtfpl | 004748 | 123607 | N/A |
| Mtss1 | 022353 | 080371 | 079239 |
| Mtss1 | 022353 | 226393 | N/A |
| Mtss1 | 022353 | 226976 | N/A |
| Mtss1 | 022353 | 227045 | 154093 |
| Mtss1 | 022353 | 227196 | 154064 |
| Mtss1 | 022353 | 228067 | 153850 |
| Mtss1 | 022353 | 227290 | N/A |
| Mtss1 | 022353 | 227238 | N/A |
| Mtss1 | 022353 | 228365 | N/A |
| Mtss1 | 022353 | 228655 | N/A |
| Mtss1 | 022353 | 226923 | N/A |
| Mtss1 | 022353 | 227797 | N/A |
| Mxd4 | 037235 | 201189 | N/A |
| Mxd4 | 037235 | 042701 | 039071 |
| Mxd4 | 037235 | 119171 | 113300 |
| Mxd4 | 037235 | 201763 | N/A |
| Mxra8 | 029070 | 141883 | 114929 |
| Mxra8 | 029070 | 030947 | 030947 |
| Mxra8 | 029070 | 133592 | N/A |
| Mxra8 | 029070 | 143886 | N/A |
| Mxra8 | 029070 | 141766 | N/A |
| Mxra8 | 029070 | 126487 | N/A |
| Mxra8 | 029070 | 132142 | N/A |
| Mybpc1 | 020061 | 121629 | 112615 |
| Mybpc1 | 020061 | 124144 | N/A |
| Mybpc1 | 020061 | 119185 | 112699 |
| Mybpc1 | 020061 | 153964 | 122472 |
| Mybpc1 | 020061 | 148205 | N/A |
| Mybpc1 | 020061 | 156573 | 119024 |
| Mycl | 028654 | 144998 | 117232 |
| Mycl | 028654 | 106252 | 101859 |
| Mycl | 028654 | 030407 | 030407 |
| Mycl | 028654 | 135925 | N/A |
| Mycl | 028654 | 147259 | N/A |
| Myh14 | 030739 | 107899 | 103531 |
| Myh14 | 030739 | 048102 | 046059 |
| Myh14 | 030739 | 208200 | 146686 |
| Myh14 | 030739 | 208044 | N/A |
| Myh14 | 030739 | 207775 | 147115 |
| Myh14 | 030739 | 209024 | N/A |
| Myh14 | 030739 | 208085 | N/A |
| Myh14 | 030739 | 208131 | 146584 |
| Myh14 | 030739 | 107900 | 103532 |
| Myh6 | 040752 | 081857 | 080538 |
| Myh6 | 040752 | 226297 | 154634 |
| Myh6 | 040752 | 228731 | 153961 |
| Myh6 | 040752 | 227905 | N/A |

TABLE 3-continued

ENSEMBL IDs for rats

| Symbol | MUSG | MUST | MUSP |
|---|---|---|---|
| Myh6 | 040752 | 131892 | N/A |
| Myh6 | 040752 | 124930 | 115615 |
| Myh6 | 040752 | 111456 | 107083 |
| Mylip | 038175 | 038275 | 047403 |
| Mylip | 038175 | 222178 | 152597 |
| Myo10 | 022272 | 110457 | 106087 |
| Myo10 | 022272 | 137601 | 118280 |
| Myo10 | 022272 | 127486 | N/A |
| Myo10 | 022272 | 130517 | N/A |
| Myo10 | 022272 | 126076 | N/A |
| Myo10 | 022272 | 135981 | 123057 |
| Myo10 | 022272 | 022882 | 022882 |
| Myo10 | 022272 | 135173 | 118744 |
| Myo10 | 022272 | 131834 | 119200 |
| Myo10 | 022272 | 124966 | 120817 |
| Myo10 | 022272 | 151360 | 119367 |
| Myo10 | 022272 | 125667 | 120566 |
| Myo10 | 022272 | 145587 | N/A |
| Myo1d | 035441 | 041065 | 037819 |
| Myo1d | 035441 | 070997 | 066948 |
| Myo1d | 035441 | 125944 | N/A |
| Myo7a | 030761 | 107128 | 102745 |
| Myo7a | 030761 | 156992 | 146114 |
| Myo7a | 030761 | 084979 | 082046 |
| Myo7a | 030761 | 107122 | 102739 |
| Myo7a | 030761 | 205746 | 146165 |
| Myo7a | 030761 | 107127 | 102744 |
| Myo7a | 030761 | 124787 | N/A |
| Myo7a | 030761 | 152975 | N/A |
| Myo7a | 030761 | 153657 | N/A |
| Myo7a | 030761 | 155637 | N/A |
| Myo7a | 030761 | 149079 | N/A |
| Myo7a | 030761 | 138627 | 114944 |
| Myo7a | 030761 | 131632 | N/A |
| Myot | 024471 | 025349 | 025349 |
| Myot | 024471 | 115498 | 111160 |
| Myrf | 036098 | 088013 | 085329 |
| Myrf | 036098 | 190922 | N/A |
| Myrf | 036098 | 186056 | 140871 |
| Myrf | 036098 | 186854 | 140838 |
| Myrf | 036098 | 189897 | 139601 |
| Myrf | 036098 | 189439 | N/A |
| Ncald | 051359 | 090150 | 087611 |
| Ncald | 051359 | 120746 | 112898 |
| Ncald | 051359 | 119730 | 113858 |
| Ncald | 051359 | 116445 | 112146 |
| Ncald | 051359 | 153775 | 114576 |
| Ncald | 051359 | 148652 | 121460 |
| Ncald | 051359 | 132423 | N/A |
| Ncald | 051359 | 150453 | 119726 |
| Ncald | 051359 | 226924 | N/A |
| Ncald | 051359 | 137944 | N/A |
| Ncald | 051359 | 123317 | N/A |
| Ncald | 051359 | 168992 | 130126 |
| Ncam2 | 022762 | 037785 | 049390 |
| Ncam2 | 022762 | 067602 | 063468 |
| Ncan | 002341 | 002412 | 002412 |
| Nceh1 | 027698 | 046515 | 045864 |
| Nceh1 | 027698 | 138947 | 115209 |
| Nceh1 | 027698 | 129412 | N/A |
| Nceh1 | 027698 | 091284 | 088829 |
| Nceh1 | 027698 | 140872 | N/A |
| Nckap5 | 049690 | 161954 | 125624 |
| Nckap5 | 049690 | 162877 | 124748 |
| Nckap5 | 049690 | 160736 | N/A |
| Nckap5 | 049690 | 057846 | 062229 |
| Nckap5 | 049690 | 094610 | 092193 |
| Nckap5 | 049690 | 159934 | N/A |
| Nckap5 | 049690 | 162646 | 123936 |
| Nckap5 | 049690 | 160693 | 123975 |
| Nckap5 | 049690 | 162664 | N/A |
| Nckap5 | 049690 | 162647 | N/A |
| Nckap5 | 049690 | 112583 | 108202 |
| Nckap5 | 049690 | 094609 | 092192 |
| Ndrg1 | 005125 | 005256 | 005256 |
| Ndrg1 | 005125 | 165966 | N/A |

TABLE 3-continued

| ENSEMBL IDs for rats | | | |
|---|---|---|---|
| Symbol | MUSG | MUST | MUSP |
| Ndrg1 | 005125 | 166420 | 127099 |
| Ndrg1 | 005125 | 171569 | N/A |
| Ndrg1 | 005125 | 164675 | 130150 |
| Ndrg1 | 005125 | 168542 | 127940 |
| Ndrg1 | 005125 | 167817 | 127075 |
| Ndrg1 | 005125 | 168979 | 126985 |
| Ndrg1 | 005125 | 172447 | 130281 |
| Ndrg1 | 005125 | 171266 | 129093 |
| Ndrg1 | 005125 | 170903 | 127302 |
| Ndrg1 | 005125 | 163496 | 130584 |
| Ndrg1 | 005125 | 164070 | 126091 |
| Ndrg2 | 004558 | 004673 | 004673 |
| Ndrg2 | 004558 | 111632 | 107259 |
| Ndrg2 | 004558 | 226698 | N/A |
| Ndrg2 | 004558 | 227237 | 153938 |
| Ndrg2 | 004558 | 226122 | N/A |
| Ndrg2 | 004558 | 227402 | 154279 |
| Ndrg2 | 004558 | 228164 | 153830 |
| Ndrg2 | 004558 | 226366 | N/A |
| Ndrg2 | 004558 | 226528 | 154716 |
| Ndrg2 | 004558 | 226184 | 154135 |
| Ndrg2 | 004558 | 228620 | N/A |
| Ndrg2 | 004558 | 226364 | N/A |
| Ndrg2 | 004558 | 228173 | N/A |
| Ndst3 | 027977 | 137404 | 118796 |
| Ndst3 | 027977 | 132112 | 120623 |
| Ndst3 | 027977 | 154668 | 118207 |
| Ndst3 | 027977 | 124803 | 122617 |
| Ndst3 | 027977 | 172537 | 133657 |
| Ndst3 | 027977 | 199046 | N/A |
| Ndst3 | 027977 | 199825 | N/A |
| Ndst3 | 027977 | 132896 | N/A |
| Ndst3 | 027977 | 029602 | 029602 |
| Ndst4 | 027971 | 173932 | 133341 |
| Ndst4 | 027971 | 147016 | N/A |
| Ndst4 | 027971 | 144344 | 120687 |
| Ndst4 | 027971 | 174648 | 133575 |
| Ndst4 | 027971 | 172632 | N/A |
| Ndst4 | 027971 | 198101 | 142414 |
| Nectin3 | 022656 | 023335 | 023335 |
| Nectin3 | 022656 | 023334 | 023334 |
| Nectin3 | 022656 | 096052 | 093757 |
| Nectin3 | 022656 | 133935 | N/A |
| Nectin3 | 022656 | 149901 | 117479 |
| Nectin3 | 022656 | 121245 | 113146 |
| Nectin3 | 022656 | 132089 | N/A |
| Nectin3 | 022656 | 119941 | 113301 |
| Nectin3 | 022656 | 121803 | 112567 |
| Nectin3 | 022656 | 124602 | 115927 |
| Nedd4l | 024589 | 225057 | 153537 |
| Nedd4l | 024589 | 225261 | 153107 |
| Nedd4l | 024589 | 224385 | 153594 |
| Nedd4l | 024589 | 223959 | N/A |
| Nedd4l | 024589 | 224347 | 153052 |
| Nedd4l | 024589 | 224516 | N/A |
| Nedd4l | 024589 | 224890 | N/A |
| Nedd4l | 024589 | 080418 | 079280 |
| Nedd4l | 024589 | 226058 | 153526 |
| Nedd4l | 024589 | 224663 | N/A |
| Nedd4l | 024589 | 163516 | 132838 |
| Nefh | 020396 | 093369 | 091061 |
| Negr1 | 040037 | 074015 | 073664 |
| Negr1 | 040037 | 041425 | 041132 |
| Negr1 | 040037 | 106065 | 101680 |
| Negr1 | 040037 | 197246 | N/A |
| Negr1 | 040037 | 175773 | 135531 |
| Nek2 | 026622 | 027931 | 027931 |
| Nek2 | 026622 | 126446 | N/A |
| Nek2 | 026622 | 150839 | N/A |
| Nek2 | 026622 | 136733 | N/A |
| Nek2 | 110797 | 213394 | 149034 |
| Nek2 | 110797 | 216945 | N/A |
| Nek2 | 110797 | 217216 | N/A |
| Nek2 | 110797 | 215890 | N/A |
| Nek4 | 021918 | 226551 | 154678 |
| Nek4 | 021918 | 228328 | 154090 |

TABLE 3-continued

| ENSEMBL IDs for rats | | | |
|---|---|---|---|
| Symbol | MUSG | MUST | MUSP |
| Nek4 | 021918 | 228392 | N/A |
| Nek4 | 021918 | 050171 | 057915 |
| Nek4 | 021918 | 226833 | 154606 |
| Nek4 | 021918 | 227602 | N/A |
| Nek4 | 021918 | 227199 | N/A |
| Nek4 | 021918 | 226146 | 153710 |
| Nell1 | 055409 | 151721 | 114706 |
| Nell1 | 055409 | 081872 | 080550 |
| Nell1 | 055409 | 145096 | N/A |
| Nell1 | 055409 | 107603 | 103229 |
| Nell1 | 055409 | 154410 | N/A |
| Neo1 | 032340 | 068664 | 063656 |
| Neo1 | 032340 | 214547 | 150600 |
| Neo1 | 032340 | 215165 | N/A |
| Neo1 | 032340 | 217545 | N/A |
| Neo1 | 032340 | 215026 | N/A |
| Neo1 | 032340 | 216964 | 149424 |
| Nes | 004891 | 159830 | N/A |
| Nes | 004891 | 090973 | 088493 |
| Nes | 004891 | 160694 | 125571 |
| Neto1 | 050321 | 058829 | 057340 |
| Neu4 | 034000 | 050890 | 051151 |
| Neu4 | 034000 | 190212 | 140127 |
| Rbfox3 | 025576 | 117731 | 113636 |
| Rbfox3 | 025576 | 103023 | 099312 |
| Rbfox3 | 025576 | 017576 | 017576 |
| Rbfox3 | 025576 | 069343 | 069598 |
| Rbfox3 | 025576 | 106278 | 101885 |
| Rbfox3 | 025576 | 120061 | 113987 |
| Rbfox3 | 025576 | 154746 | 118332 |
| Rbfox3 | 025576 | 136551 | 119255 |
| Rbfox3 | 025576 | 128863 | N/A |
| Rbfox3 | 025576 | 134774 | N/A |
| Rbfox3 | 025576 | 117731 | 113636 |
| Rbfox3 | 025576 | 103023 | 099312 |
| Rbfox3 | 025576 | 017576 | 017576 |
| Rbfox3 | 025576 | 069343 | 069598 |
| Rbfox3 | 025576 | 106278 | 101885 |
| Rbfox3 | 025576 | 120061 | 113987 |
| Rbfox3 | 025576 | 154746 | 118332 |
| Rbfox3 | 025576 | 136551 | 119255 |
| Rbfox3 | 025576 | 128863 | N/A |
| Rbfox3 | 025576 | 134774 | N/A |
| Neurl1a | 006435 | 111808 | 107439 |
| Neurl1a | 006435 | 111807 | 107438 |
| Neurod1 | 034701 | 041099 | 040364 |
| Neurod6 | 037984 | 044767 | 047016 |
| Nfatc2 | 027544 | 074618 | 074198 |
| Nfatc2 | 027544 | 109184 | 104812 |
| Nfatc2 | 027544 | 151292 | N/A |
| Nfatc2 | 027544 | 099067 | N/A |
| Nfatc2 | 027544 | 029057 | 029057 |
| Nfatc2 | 027544 | 137451 | 118329 |
| Nfatc2 | 027544 | 140137 | N/A |
| Nfatc2 | 027544 | 138546 | N/A |
| Nfatc2 | 027544 | 171689 | 130875 |
| Nhsl1 | 039835 | 207038 | 147021 |
| Nhsl1 | 039835 | 159299 | N/A |
| Nhsl1 | 039835 | 161510 | N/A |
| Nhsl1 | 039835 | 160602 | N/A |
| Nhsl1 | 039835 | 037341 | 040799 |
| Nhsl1 | 039835 | 160547 | N/A |
| Nhsl1 | 039835 | 160600 | N/A |
| Nhsl1 | 039835 | 162891 | 124072 |
| Nhsl1 | 039835 | 100054 | 097631 |
| Nid1 | 005397 | 005532 | 005532 |
| Nid1 | 005397 | 222142 | N/A |
| Nid1 | 005397 | 222436 | N/A |
| Ninj2 | 041377 | 112711 | 108331 |
| Ninj2 | 041377 | 035244 | 046306 |
| Nipal4 | 020411 | 020679 | 020679 |
| Nkain2 | 069670 | 191234 | 140463 |
| Nkain2 | 069670 | 218645 | 151255 |
| Nkain2 | 069670 | 219125 | 151959 |
| Nkain2 | 069670 | 219306 | N/A |
| Nkain2 | 069670 | 092602 | 090264 |

TABLE 3-continued

| ENSEMBL IDs for rats | | | |
|---|---|---|---|
| Symbol | MUSG | MUST | MUSP |
| Nkain2 | 069670 | 092603 | 090265 |
| Nkx2-2 | 027434 | 109970 | 105596 |
| Nkx2-2 | 027434 | 067075 | 069666 |
| Nkx2-2 | 027434 | 109969 | N/A |
| Nkx2-2 | 027434 | 172627 | N/A |
| Nlgn3 | 031302 | 118111 | 113863 |
| Nlgn3 | 031302 | 130555 | 122213 |
| Nlgn3 | 031302 | 151528 | 123283 |
| Nlgn3 | 031302 | 065858 | 066304 |
| Nlgn3 | 031302 | 147443 | N/A |
| Nlgn3 | 031302 | 144860 | N/A |
| Nln | 021710 | 109315 | 104938 |
| Nln | 021710 | 225324 | 153299 |
| Nln | 021710 | 224058 | N/A |
| Nln | 021710 | 225704 | N/A |
| Nln | 021710 | 224945 | 153227 |
| Nln | 021710 | 224475 | N/A |
| Nln | 021710 | 225478 | N/A |
| Nln | 021710 | 224086 | N/A |
| Nnt | 025453 | 069902 | 070564 |
| Nnt | 025453 | 099149 | 096753 |
| Nnt | 025453 | 109204 | 104827 |
| Nnt | 025453 | 133627 | N/A |
| Nnt | 025453 | 144599 | N/A |
| Nnt | 025453 | 223268 | 152868 |
| Notch1 | 026923 | 028288 | 028288 |
| Notch1 | 026923 | 132941 | N/A |
| Notch1 | 026923 | 148948 | N/A |
| Notch1 | 026923 | 138034 | N/A |
| Notch1 | 026923 | 126872 | N/A |
| Notch1 | 026923 | 140082 | N/A |
| Notch1 | 026923 | 147481 | N/A |
| Notch1 | 026923 | 123873 | N/A |
| Notch1 | 026923 | 129506 | N/A |
| Notch1 | 026923 | 132820 | 115258 |
| Notch1 | 026923 | 131393 | N/A |
| Npr3 | 022206 | 066529 | 066737 |
| Npr3 | 022206 | 226139 | N/A |
| Npr3 | 022206 | 228603 | 154180 |
| Npr3 | 022206 | 228489 | 153895 |
| Npr3 | 022206 | 226878 | N/A |
| Npy1r | 036437 | 212588 | 148417 |
| Npy1r | 036437 | 039303 | 045530 |
| Nrcam | 020598 | 218940 | N/A |
| Nrcam | 020598 | 110748 | 106376 |
| Nrcam | 020598 | 219592 | N/A |
| Nrcam | 020598 | 220130 | N/A |
| Nrcam | 020598 | 020939 | 020939 |
| Nrcam | 020598 | 220126 | 151296 |
| Nrcam | 020598 | 217907 | 151419 |
| Nrcam | 020598 | 218540 | 151732 |
| Nrcam | 020598 | 219928 | N/A |
| Nrcam | 020598 | 218805 | N/A |
| Nrcam | 020598 | 220123 | 151844 |
| Nrcam | 020598 | 218431 | 151873 |
| Nrcam | 020598 | 219939 | 152002 |
| Nrcam | 020598 | 219906 | 151243 |
| Nrcam | 020598 | 220082 | 151824 |
| Nrcam | 020598 | 217796 | N/A |
| Nrcam | 020598 | 218062 | 151475 |
| Nrg1 | 062991 | 207470 | 146456 |
| Nrg1 | 062991 | 207417 | 146905 |
| Nrg1 | 062991 | 209107 | 146617 |
| Nrg1 | 062991 | 208617 | 146857 |
| Nrg1 | 062991 | 208205 | 147156 |
| Nrg1 | 062991 | 073884 | 073546 |
| Nrg1 | 062991 | 208488 | 147121 |
| Nrg1 | 062991 | 208819 | 146403 |
| Nrg1 | 062991 | 208335 | 146375 |
| Nrg1 | 062991 | 208598 | 146478 |
| Nrg1 | 062991 | 208497 | 146816 |
| Nrg1 | 062991 | 207678 | N/A |
| Nrg1 | 062991 | 208355 | N/A |
| Nrg1 | 062991 | 208931 | 146507 |
| Nrg1 | 062991 | 209022 | 146842 |
| Nrg1 | 062991 | 207584 | N/A |
| Nrg1 | 062991 | 208820 | N/A |
| Nrg1 | 062991 | 208206 | N/A |
| Nrg2 | 060275 | 115713 | 111378 |
| Nrg2 | 060275 | 115712 | 111377 |
| Nrg2 | 060275 | 115705 | N/A |
| Nrg2 | 060275 | 225173 | N/A |
| Nrg3 | 041014 | 166968 | 136884 |
| Nrg3 | 041014 | 168810 | 129783 |
| Nrg3 | 041014 | 173780 | 134727 |
| Nrg3 | 041014 | 176122 | N/A |
| Nrgn | 053310 | 065668 | 070113 |
| Nrgn | 053310 | 182070 | N/A |
| Nrk | 052854 | 113052 | 108675 |
| Nrk | 052854 | 131829 | 115962 |
| Nrk | 052854 | 155201 | N/A |
| Nrk | 052854 | 142132 | N/A |
| Nrk | 052854 | 064937 | 063397 |
| Nrxn1 | 024109 | 072671 | 072458 |
| Nrxn1 | 024109 | 160844 | 125407 |
| Nrxn1 | 024109 | 197268 | 142815 |
| Nrxn1 | 024109 | 174331 | 133491 |
| Nrxn1 | 024109 | 159778 | 125561 |
| Nrxn1 | 024109 | 173917 | 133389 |
| Nrxn1 | 024109 | 174337 | 133724 |
| Nrxn1 | 024109 | 161402 | 124116 |
| Nrxn1 | 024109 | 173222 | 146701 |
| Nrxn1 | 024109 | 054059 | 057294 |
| Nrxn1 | 024109 | 172466 | 134402 |
| Nrxn1 | 024109 | 160800 | 124561 |
| Nrxn1 | 024109 | 197104 | 142621 |
| Nrxn1 | 024109 | 176918 | N/A |
| Nrxn1 | 024109 | 196269 | N/A |
| Nrxn1 | 024109 | 161102 | N/A |
| Nrxn1 | 024109 | 196559 | 142891 |
| Nrxn1 | 024109 | 176118 | 135241 |
| Nrxn1 | 024109 | 198899 | N/A |
| Nrxn1 | 024109 | 161637 | N/A |
| Nrxn1 | 024109 | 177342 | 135301 |
| Nrxn1 | 024109 | 197224 | 142650 |
| Nrxn1 | 024109 | 162227 | N/A |
| Nrxn1 | 024109 | 160467 | N/A |
| Nrxn1 | 024109 | 159419 | N/A |
| Nrxn1 | 024109 | 162002 | N/A |
| Ntf3 | 049107 | 204542 | 144828 |
| Ntf3 | 049107 | 112244 | 107863 |
| Ntf3 | 049107 | 050484 | 052302 |
| Ntm | 059974 | 075069 | 074578 |
| Ntm | 059974 | 124119 | N/A |
| Ntm | 059974 | 151977 | N/A |
| Ntm | 059974 | 115237 | 110892 |
| Ntm | 059974 | 152513 | N/A |
| Ntm | 059974 | 140118 | 114810 |
| Ntm | 059974 | 155308 | 119030 |
| Ntm | 059974 | 115236 | 110891 |
| Ntm | 059974 | 148606 | N/A |
| Ntm | 059974 | 126044 | N/A |
| Ntm | 059974 | 146651 | N/A |
| Ntn1 | 020902 | 108674 | 104314 |
| Ntn1 | 020902 | 135141 | 121193 |
| Ntn1 | 020902 | 021284 | 021284 |
| Ntn4 | 020019 | 147080 | 123306 |
| Ntn4 | 020019 | 020204 | 020204 |
| Ntsr1 | 027568 | 029084 | 029084 |
| Ntsr1 | 027568 | 170448 | 127548 |
| Ntsr2 | 020591 | 221596 | 152110 |
| Ntsr2 | 020591 | 111064 | 106693 |
| Ntsr2 | 020591 | 220892 | 152290 |
| Ntsr2 | 020591 | 222957 | N/A |
| Ntsr2 | 020591 | 221049 | 152592 |
| Nudt4 | 020029 | 020217 | 020217 |
| Nup62cl | 072944 | 101212 | 098772 |
| Nup62cl | 072944 | 154385 | 121310 |
| Nup62cl | 072944 | 133780 | 116491 |
| Nup62cl | 072944 | 125678 | 116128 |
| Nup62cl | 072944 | 124075 | 122713 |
| Nwd1 | 048148 | 161386 | N/A |

TABLE 3-continued

| ENSEMBL IDs for rats | | | |
| --- | --- | --- | --- |
| Symbol | MUSG | MUST | MUSP |
| Nwd1 | 048148 | 161557 | 125470 |
| Nwd1 | 048148 | 161254 | 124804 |
| Nwd1 | 048148 | 228312 | 154488 |
| Nwd1 | 048148 | 160443 | 124446 |
| Nwd1 | 048148 | 163026 | N/A |
| Nwd1 | 048148 | 160912 | N/A |
| Nwd1 | 048148 | 162248 | N/A |
| Nwd1 | 048148 | 093427 | 091135 |
| Nxn | 020844 | 021204 | 021204 |
| Nxn | 020844 | 131472 | N/A |
| Nxpe3 | 075033 | 099705 | 097296 |
| Ogdhl | 021913 | 228529 | 154185 |
| Ogdhl | 021913 | 228286 | N/A |
| Ogdhl | 021913 | 022480 | 022480 |
| Olfm1 | 026833 | 028177 | 028177 |
| Olfm1 | 026833 | 113920 | 109553 |
| Olfm1 | 026833 | 102879 | 099943 |
| Olfm1 | 026833 | 152415 | N/A |
| Olfm1 | 026833 | 100244 | 097815 |
| Olfm3 | 027965 | 081752 | 080448 |
| Olfm3 | 027965 | 149158 | 121097 |
| Olfm3 | 027965 | 051309 | 060985 |
| Olig1 | 046160 | 056882 | 061408 |
| Olig2 | 039830 | 035608 | 036797 |
| Onecut2 | 045991 | 175965 | 135692 |
| Onecut2 | 045991 | 115145 | 110798 |
| Opalin | 050121 | 087176 | 084422 |
| Ophn1 | 031214 | 033560 | 033560 |
| Ophn1 | 031214 | 142267 | 119361 |
| Ophn1 | 031214 | 156634 | N/A |
| Ophn1 | 031214 | 113826 | 109457 |
| Ophn1 | 031214 | 125150 | N/A |
| Ophn1 | 031214 | 147805 | N/A |
| Ophn1 | 031214 | 156917 | N/A |
| Ophn1 | 031214 | 140598 | N/A |
| Ophn1 | 031214 | 147529 | 121723 |
| Ophn1 | 031214 | 154920 | N/A |
| Oplah | 022562 | 171340 | 129100 |
| Oplah | 022562 | 170261 | N/A |
| Oplah | 022562 | 169664 | N/A |
| Oplah | 022562 | 170063 | N/A |
| Oplah | 022562 | 163127 | N/A |
| Oplah | 022562 | 164189 | 131967 |
| Oplah | 022562 | 163977 | N/A |
| Oplah | 022562 | 210024 | 148028 |
| Oplah | 022562 | 165279 | 127955 |
| Oplah | 022562 | 023222 | 023222 |
| Oprd1 | 050511 | 056336 | 050077 |
| Optc | 010311 | 124051 | 120568 |
| Optc | 010311 | 153617 | 123262 |
| Optc | 010311 | 149380 | 115661 |
| Optc | 010311 | 126123 | 117086 |
| Optc | 010311 | 124245 | N/A |
| Osbp | 024687 | 025590 | 025590 |
| Osbpl10 | 040875 | 183104 | 138287 |
| Osbpl10 | 040875 | 182384 | 138552 |
| Osbpl10 | 040875 | 183141 | 138760 |
| Osbpl10 | 040875 | 182199 | 138206 |
| Osbpl10 | 040875 | 182920 | 138266 |
| Osbpl10 | 040875 | 182363 | N/A |
| Osbpl10 | 040875 | 182413 | N/A |
| Osbpl10 | 040875 | 046627 | 038013 |
| Osbpl3 | 029822 | 114468 | 110112 |
| Osbpl3 | 029822 | 141466 | N/A |
| Osbpl3 | 029822 | 090019 | 087473 |
| Osbpl3 | 029822 | 071728 | 071643 |
| Osbpl3 | 029822 | 114466 | 110110 |
| Osbpl3 | 029822 | 133141 | N/A |
| Osbpl3 | 029822 | 203907 | 145249 |
| Osbpl3 | 029822 | 146341 | 114472 |
| Osbpl3 | 029822 | 136926 | 144934 |
| Osbpl3 | 029822 | 154333 | N/A |
| P2ry1 | 027765 | 029331 | 029331 |
| P2ry1 | 027765 | 193201 | 142006 |
| P2ry1 | 027765 | 193943 | 141371 |
| P2ry12 | 036353 | 196583 | 143036 |

TABLE 3-continued

| ENSEMBL IDs for rats | | | |
| --- | --- | --- | --- |
| Symbol | MUSG | MUST | MUSP |
| P2ry12 | 036353 | 050360 | 051353 |
| P2ry12 | 036353 | 199609 | 143521 |
| P2ry12 | 036353 | 199675 | 143706 |
| P2ry12 | 036353 | 170388 | 126819 |
| Pak7 | 039913 | 035264 | 047285 |
| Pak7 | 039913 | 077200 | 076440 |
| Pak7 | 039913 | 143329 | N/A |
| Palm2 | 090053 | 102905 | 099969 |
| Palm2 | 090053 | 102904 | 099968 |
| Palm2 | 090053 | 142556 | 129817 |
| Palm2 | 090053 | 131201 | N/A |
| Pam | 026335 | 159041 | 124284 |
| Pam | 026335 | 058762 | 057112 |
| Pam | 026335 | 161567 | 125418 |
| Pam | 026335 | 162681 | 125133 |
| Pam | 026335 | 159585 | N/A |
| Pam | 026335 | 160210 | N/A |
| Pam | 026335 | 162803 | N/A |
| Pam | 026335 | 159131 | N/A |
| Pam | 026335 | 161071 | N/A |
| Pam | 026335 | 159841 | 124479 |
| Pam | 026335 | 159428 | N/A |
| Pam | 026335 | 162426 | N/A |
| Pam | 026335 | 186731 | N/A |
| Pam | 026335 | 163007 | N/A |
| Pam | 026335 | 097625 | 095228 |
| Panx2 | 058441 | 161372 | 125514 |
| Panx2 | 058441 | 162424 | 124354 |
| Panx2 | 058441 | 161372 | 125514 |
| Panx2 | 058441 | 162424 | 124354 |
| Panx2 | 058441 | 159960 | 124928 |
| Paqr6 | 041423 | 147948 | 119656 |
| Paqr6 | 041423 | 147991 | 114166 |
| Paqr6 | 041423 | 149640 | N/A |
| Paqr6 | 041423 | 123200 | N/A |
| Paqr6 | 041423 | 147818 | N/A |
| Pard3 | 025812 | 162309 | 124282 |
| Pard3 | 025812 | 160272 | 125453 |
| Pard3 | 025812 | 162907 | 124319 |
| Pard3 | 025812 | 160717 | 125612 |
| Pard3 | 025812 | 160593 | N/A |
| Pard3 | 025812 | 026921 | 026921 |
| Pard3 | 025812 | 162456 | 124162 |
| Pard3 | 025812 | 162665 | 124718 |
| Pard3 | 025812 | 161348 | 123951 |
| Pard3 | 025812 | 162035 | N/A |
| Pard3 | 025812 | 162176 | 123944 |
| Pard3 | 025812 | 159537 | 124934 |
| Pard3 | 025812 | 161277 | 124789 |
| Pard3 | 025812 | 160766 | 124533 |
| Pard3 | 025812 | 162602 | 125450 |
| Pard3 | 025812 | 162531 | 125610 |
| Pard3 | 025812 | 160581 | 124141 |
| Pard3 | 025812 | 162536 | 125212 |
| Pard3 | 025812 | 161355 | 125064 |
| Pard3 | 025812 | 159141 | 124733 |
| Pard3 | 025812 | 159818 | 124339 |
| Pard3 | 025812 | 163021 | N/A |
| Pard3 | 025812 | 162727 | 124359 |
| Pard3 | 025812 | 163002 | N/A |
| Pard3 | 025812 | 159511 | 124441 |
| Pard3 | 025812 | 159940 | N/A |
| Pard3 | 025812 | 079777 | 078710 |
| Pard3 | 025812 | 108752 | 104383 |
| Pard3b | 052062 | 138768 | N/A |
| Pard3b | 052062 | 075374 | 074837 |
| Pard3b | 052062 | 129030 | N/A |
| Pard3b | 052062 | 188325 | N/A |
| Pard3b | 052062 | 046673 | 040439 |
| Pard3b | 052062 | 094906 | 092510 |
| Pard6g | 056214 | 070219 | 069182 |
| Parm1 | 034981 | 040576 | 042844 |
| Patj | 061859 | 141796 | N/A |
| Patj | 061859 | 041284 | 049176 |
| Patj | 061859 | 107033 | 102648 |
| Patj | 061859 | 107034 | 102649 |

TABLE 3-continued

| | ENSEMBL IDs for rats | | |
|---|---|---|---|
| Symbol | MUSG | MUST | MUSP |
| Patj | 061859 | 107030 | 102645 |
| Patj | 061859 | 136675 | N/A |
| Patj | 061859 | 141965 | N/A |
| Patj | 061859 | 142103 | 116021 |
| Patj | 061859 | 107029 | 102644 |
| Patj | 061859 | 135606 | N/A |
| Patj | 061859 | 134901 | 115936 |
| Patj | 061859 | 102792 | 099854 |
| Patj | 061859 | 030290 | 030290 |
| Pax2 | 004231 | 174490 | 134661 |
| Pax2 | 004231 | 173346 | 134311 |
| Pax2 | 004231 | 004340 | 004340 |
| Pax3 | 004872 | 004994 | 004994 |
| Pax3 | 004872 | 087086 | 084320 |
| Pax3 | 004872 | 172555 | N/A |
| Paxbp1 | 022974 | 118522 | 113835 |
| Paxbp1 | 022974 | 023698 | 023698 |
| Paxbp1 | 022974 | 150397 | N/A |
| Paxbp1 | 022974 | 146281 | N/A |
| Paxbp1 | 022974 | 145136 | 117142 |
| Paxbp1 | 022974 | 128922 | N/A |
| Paxbp1 | 022974 | 124653 | N/A |
| Paxbp1 | 022974 | 127002 | N/A |
| Pbx3 | 038718 | 113132 | 108757 |
| Pbx3 | 038718 | 040638 | 045281 |
| Pbx3 | 038718 | 176213 | N/A |
| Pbx3 | 038718 | 153278 | 123567 |
| Pbx3 | 038718 | 143776 | 119914 |
| Pbx3 | 038718 | 175855 | 135838 |
| Pbx3 | 038718 | 138021 | 135226 |
| Pbx3 | 038718 | 141653 | 115710 |
| Pbx3 | 038718 | 127353 | 114695 |
| Pbx3 | 038718 | 155423 | N/A |
| Pkd1 | 032855 | 228550 | 154062 |
| Pkd1 | 032855 | 035565 | 049296 |
| Pkd1 | 032855 | 228745 | 153873 |
| Pkd1 | 032855 | 227107 | 154792 |
| Pkd1 | 032855 | 226883 | 154668 |
| Pkd1 | 032855 | 226178 | N/A |
| Pkd1 | 032855 | 227836 | 154626 |
| Pkd1 | 032855 | 228750 | N/A |
| Pkd1 | 032855 | 227058 | 153867 |
| Pkd1 | 032855 | 228581 | 154141 |
| Pkd2 | 034462 | 086831 | 084041 |
| Pkd2 | 034462 | 130931 | N/A |
| Pkd2 | 034462 | 133540 | N/A |
| Pcsk1 | 021587 | 022075 | 022075 |
| Pcsk1 | 021587 | 135349 | N/A |
| Pcsk1 | 021587 | 222727 | 152702 |
| Ifrd1 | 001627 | 001672 | 001672 |
| Ifrd1 | 001627 | 164047 | 127553 |
| Ifrd1 | 001627 | 170119 | N/A |
| Ifrd1 | 001627 | 165027 | 133028 |
| Ifrd1 | 001627 | 171530 | 128635 |
| Ifrd1 | 001627 | 169926 | 127673 |
| Ifrd1 | 001627 | 169319 | 130824 |
| Ifrd1 | 001627 | 170752 | N/A |
| Ifrd1 | 001627 | 164354 | 130846 |
| Ifrd1 | 001627 | 171553 | N/A |
| Pcsk5 | 024713 | 025618 | 025618 |
| Pcsk5 | 024713 | 050715 | 050272 |
| Pcsk5 | 024713 | 025618 | 025618 |
| Pcsk5 | 024713 | 050715 | 050272 |
| Pcsk7 | 035382 | 039059 | 047508 |
| Pcsk7 | 035382 | 215535 | N/A |
| Pcsk7 | 035382 | 215189 | 150500 |
| Pcsk7 | 035382 | 216672 | 150393 |
| Pcsk7 | 035382 | 213854 | 150379 |
| Pcsk7 | 035382 | 216614 | N/A |
| Pcsk7 | 035382 | 216504 | N/A |
| Pcsk7 | 035382 | 216514 | N/A |
| Pcsk7 | 035382 | 214425 | N/A |
| Pcdh1 | 051375 | 160721 | 124732 |
| Pcdh1 | 051375 | 161701 | 125576 |
| Pcdh1 | 051375 | 057185 | 055199 |
| Pcdh1 | 051375 | 159405 | 125309 |

TABLE 3-continued

| | ENSEMBL IDs for rats | | |
|---|---|---|---|
| Symbol | MUSG | MUST | MUSP |
| Pcdh1 | 051375 | 194312 | 141877 |
| Pcdh1 | 051375 | 193828 | 142328 |
| Pcdh15 | 052613 | 123398 | N/A |
| Pcdh15 | 052613 | 148572 | N/A |
| Pcdh15 | 052613 | 156999 | N/A |
| Pcdh15 | 052613 | 193174 | 142238 |
| Pcdh15 | 052613 | 105426 | 101066 |
| Pcdh15 | 052613 | 129404 | 117731 |
| Pcdh15 | 052613 | 131321 | 122911 |
| Pcdh15 | 052613 | 126920 | 121939 |
| Pcdh15 | 052613 | 147189 | 122940 |
| Pcdh15 | 052613 | 105424 | 101064 |
| Pcdh15 | 052613 | 092420 | 090076 |
| Pcdh15 | 052613 | 136096 | 121534 |
| Pcdh15 | 052613 | 105429 | 101069 |
| Pcdh15 | 052613 | 125055 | 114326 |
| Pcdh15 | 052613 | 193361 | 141792 |
| Pcdh15 | 052613 | 131724 | 122466 |
| Pcdh15 | 052613 | 152655 | 118201 |
| Pcdh15 | 052613 | 144302 | 122606 |
| Pcdh15 | 052613 | 151116 | 119662 |
| Pcdh15 | 052613 | 155701 | 135495 |
| Pcdh15 | 052613 | 152819 | 123647 |
| Pcdh15 | 052613 | 125517 | 115399 |
| Pcdh15 | 052613 | 124046 | 121130 |
| Pcdh15 | 052613 | 146682 | 134863 |
| Pcdh15 | 052613 | 177107 | 135501 |
| Pcdh15 | 052613 | 149977 | 118833 |
| Pcdh15 | 052613 | 191854 | 141973 |
| Pcdh15 | 052613 | 134009 | 120618 |
| Pcdh15 | 052613 | 177420 | 135849 |
| Pcdh15 | 052613 | 125006 | 120056 |
| Pcdh15 | 052613 | 191709 | 142313 |
| Pcdh15 | 052613 | 193739 | 142173 |
| Pcdh15 | 052613 | 195531 | 141920 |
| Pcdh15 | 052613 | 147455 | N/A |
| Pcdh15 | 052613 | 194315 | 141594 |
| Pcdh15 | 052613 | 139106 | N/A |
| Pcdh15 | 052613 | 128843 | N/A |
| Pcdh15 | 052613 | 127928 | N/A |
| Pcdh15 | 052613 | 194729 | N/A |
| Pcdh15 | 052613 | 192370 | N/A |
| Pcdh15 | 052613 | 064562 | 068561 |
| Pcdh17 | 035566 | 071370 | 071325 |
| Pcdh17 | 035566 | 226362 | N/A |
| Pcdh9 | 055421 | 195826 | 141396 |
| Pcdh9 | 055421 | 193901 | 141759 |
| Pcdh9 | 055421 | 192221 | 142260 |
| Pcdh9 | 055421 | 195376 | 142224 |
| Pcdh9 | 055421 | 194129 | 141205 |
| Pcdh9 | 055421 | 192817 | N/A |
| Pcdh9 | 055421 | 194056 | 141602 |
| Pcdh9 | 055421 | 068992 | 070935 |
| Pcdha1 | 103442 | 193839 | 142308 |
| Pcdha1 | 103442 | 070797 | 068828 |
| Pcdha3 | 102312 | 192503 | 141989 |
| Pcp2 | 004630 | 136105 | 121079 |
| Pcp2 | 004630 | 145855 | N/A |
| Pcp2 | 004630 | 142431 | 121403 |
| Pcp2 | 004630 | 133459 | 122902 |
| Pcp2 | 004630 | 004749 | 004749 |
| Pcp2 | 004630 | 128566 | 146683 |
| Pcp2 | 004630 | 144977 | 146399 |
| Pcp4 | 090223 | 061739 | 062539 |
| Pcsk6 | 030513 | 176199 | 135851 |
| Pcsk6 | 030513 | 055576 | 053742 |
| Pcsk6 | 030513 | 098391 | 095992 |
| Pcsk6 | 030513 | 176209 | 135033 |
| Pcsk6 | 030513 | 177369 | N/A |
| Pcsk6 | 030513 | 177272 | N/A |
| Pcx | 024892 | 224726 | 153479 |
| Pcx | 024892 | 223659 | N/A |
| Pcx | 024892 | 225189 | 152918 |
| Pcx | 024892 | 113825 | 109456 |
| Pcx | 024892 | 068004 | 063825 |
| Pdc | 006007 | 191228 | 141136 |

TABLE 3-continued

TABLE 3-continued

| | ENSEMBL IDs for rats | | | | | ENSEMBL IDs for rats | | |
| --- | --- | --- | --- | --- | --- | --- | --- | --- |
| Symbol | MUSG | MUST | MUSP | | Symbol | MUSG | MUST | MUSP |
| Pdc | 006007 | 186572 | 140843 | | Pde8b | 021684 | 172104 | 128987 |
| Pdc | 006007 | 185698 | 140669 | | Pde8b | 021684 | 067082 | 070465 |
| Pdc | 006007 | 165062 | 131631 | | Pde8b | 021684 | 022192 | 022192 |
| Pde1a | 059173 | 102655 | 099715 | | Pde8b | 021684 | 159608 | 125191 |
| Pde1a | 059173 | 183775 | 139327 | | Pde8b | 021684 | 160957 | 125115 |
| Pde1a | 059173 | 102653 | 099713 | | Pde8b | 021684 | 160412 | N/A |
| Pde1a | 059173 | 090756 | 088260 | | Pde8b | 021684 | 162328 | N/A |
| Pde1a | 059173 | 102652 | 099712 | | Pde8b | 021684 | 159598 | 124447 |
| Pde1a | 059173 | 102651 | 099711 | | Pde8b | 021684 | 162716 | N/A |
| Pde1a | 059173 | 134739 | 120188 | | Pde9a | 041119 | 047168 | 038005 |
| Pde1a | 059173 | 146076 | N/A | | Pde9a | 041119 | 143549 | 117911 |
| Pde1a | 059173 | 125887 | N/A | | Pde9a | 041119 | 131417 | 115188 |
| Pde1a | 059173 | 102654 | 099714 | | Pde9a | 041119 | 134525 | 121003 |
| Pde1b | 022489 | 226468 | 153865 | | Pde9a | 041119 | 127929 | 117611 |
| Pde1b | 022489 | 023132 | 023132 | | Pde9a | 041119 | 137927 | 121126 |
| Pde1b | 022489 | 226493 | 154483 | | Pde9a | 041119 | 124902 | 118869 |
| Pde1b | 022489 | 227955 | 153722 | | Pde9a | 041119 | 154567 | N/A |
| Pde1b | 022489 | 227925 | N/A | | Pde9a | 041119 | 141314 | 117364 |
| Pde1c | 004347 | 044505 | 046601 | | Pde9a | 041119 | 136384 | 116724 |
| Pde1c | 004347 | 203372 | 145508 | | Pde9a | 041119 | 130547 | N/A |
| Pde1c | 004347 | 203967 | N/A | | Pde9a | 041119 | 155395 | N/A |
| Pde1c | 004347 | 114327 | 109966 | | Pde9a | 041119 | 154392 | 117065 |
| Pde1c | 004347 | 170774 | 133170 | | Pde9a | 041119 | 155113 | N/A |
| Pde1c | 004347 | 203462 | 145419 | | Pdgfc | 028019 | 029652 | 029652 |
| Pde1c | 004347 | 168944 | 128364 | | Pdgfc | 028019 | 129285 | 118970 |
| Pde1c | 004347 | 166102 | 131350 | | Pdgfc | 028019 | 143721 | 122047 |
| Pde1c | 004347 | 166890 | 131892 | | Pdgfd | 032006 | 058692 | 056240 |
| Pde1c | 004347 | 164752 | 129185 | | Pdgfd | 032006 | 168039 | 128388 |
| Pde1c | 004347 | 164037 | 130139 | | Pdgfd | 032006 | 214892 | 149162 |
| Pde1c | 004347 | 204821 | N/A | | Pdgfra | 029231 | 202681 | 143906 |
| Pde1c | 004347 | 203492 | N/A | | Pdgfra | 029231 | 000476 | 000476 |
| Pde1c | 004347 | 203689 | N/A | | Pdgfra | 029231 | 202186 | 144543 |
| Pde3b | 030671 | 032909 | 032909 | | Pdgfra | 029231 | 201711 | 143891 |
| Pde3b | 030671 | 140007 | N/A | | Pdgfra | 029231 | 201241 | N/A |
| Pde3b | 030671 | 210411 | N/A | | Pdgfra | 029231 | 202161 | 144485 |
| Pde3b | 030671 | 149455 | N/A | | Pdgfra | 029231 | 168162 | 127173 |
| Pde4d | 021699 | 133929 | N/A | | Pdgfra | 029231 | 202992 | 144132 |
| Pde4d | 021699 | 151111 | N/A | | Pdgfra | 029231 | 200822 | 144634 |
| Pde4d | 021699 | 122041 | 113488 | | Pdk3 | 035232 | 045748 | 036604 |
| Pde4d | 021699 | 129374 | N/A | | Pdk3 | 035232 | 134502 | N/A |
| Pde4d | 021699 | 138938 | N/A | | Pdk3 | 035232 | 154717 | N/A |
| Pde4d | 021699 | 120671 | 112991 | | Pdlim4 | 020388 | 018755 | 018755 |
| Pde4d | 021699 | 153234 | 121592 | | Pdlim4 | 020388 | 093109 | 090797 |
| Pde4d | 021699 | 119507 | 114089 | | Pdlim4 | 020388 | 144477 | 121248 |
| Pde4d | 021699 | 079975 | 078891 | | Pdlim4 | 020388 | 127271 | N/A |
| Pde4d | 021699 | 135275 | 119583 | | Pdlim4 | 020388 | 151948 | N/A |
| Pde4d | 021699 | 074103 | 073742 | | Pdzd3 | 032105 | 034618 | 034618 |
| Pde4d | 021699 | 134973 | N/A | | Pdzd3 | 032105 | 213186 | N/A |
| Pde4d | 021699 | 152630 | N/A | | Pdzph1 | 024227 | 177108 | N/A |
| Pde4d | 021699 | 119672 | 113567 | | Pdzph1 | 024227 | 025064 | 025064 |
| Pde4d | 021699 | 120664 | 113024 | | Pdzph1 | 024227 | 177360 | 135180 |
| Pde4d | 021699 | 151429 | N/A | | Pdzm4 | 036218 | 169942 | 133159 |
| Pde4d | 021699 | 117879 | 112774 | | Pdzm4 | 036218 | 035399 | 040456 |
| Pde4d | 021699 | 117420 | 113610 | | Pea15a | 013698 | 013842 | 013842 |
| Pde4d | 021699 | 155459 | 114945 | | Pea15a | 013698 | 111247 | 106878 |
| Pde4d | 021699 | 177907 | 136485 | | Pea15a | 013698 | 125361 | N/A |
| Pde5a | 053965 | 066728 | 069011 | | Pea15a | 013698 | 155109 | 117735 |
| Pde5a | 053965 | 200389 | 143042 | | Pea15a | 013698 | 152432 | N/A |
| Pde5a | 053965 | 198314 | N/A | | Peg3 | 002265 | 051209 | 050750 |
| Pde5a | 053965 | 199253 | N/A | | Peg3 | 002265 | 150182 | 116161 |
| Pde7b | 019990 | 020165 | 020165 | | Peg3 | 002265 | 143703 | 122423 |
| Pde7b | 019990 | 169016 | 130596 | | Peg3 | 002265 | 155910 | N/A |
| Pde7b | 019990 | 169404 | 132378 | | Penk | 045573 | 070375 | 066822 |
| Pde7b | 019990 | 170265 | 126324 | | Penk | 045573 | 133567 | 122389 |
| Pde7b | 019990 | 164195 | 126913 | | Pet100 | 087687 | 208950 | 146433 |
| Pde7b | 019990 | 217240 | N/A | | Pet100 | 087687 | 208185 | N/A |
| Pde7b | 019990 | 170683 | N/A | | Pet100 | 087687 | 156380 | 137626 |
| Pde7b | 019990 | 166147 | N/A | | Pet100 | 087687 | 207257 | N/A |
| Pde8a | 025584 | 026672 | 026672 | | Pet100 | 087687 | 207428 | 146950 |
| Pde8a | 025584 | 128154 | N/A | | Pet100 | 087687 | 207389 | 146942 |
| Pde8a | 025584 | 130494 | N/A | | Pex5l | 027674 | 194016 | 142196 |
| Pde8b | 021684 | 162412 | 124409 | | Pex5l | 027674 | 193681 | 141454 |
| Pde8b | 021684 | 162670 | 125237 | | Pex5l | 027674 | 192093 | 141387 |
| Pde8b | 021684 | 162292 | 124068 | | Pex5l | 027674 | 193289 | 142008 |
| Pde8b | 021684 | 162882 | N/A | | Pex5l | 027674 | 078226 | 077353 |
| Pde8b | 021684 | 162153 | 124704 | | Pex5l | 027674 | 108224 | 103859 |

TABLE 3-continued

| Symbol | MUSG | MUST | MUSP |
|---|---|---|---|
| | ENSEMBL IDs for rats | | |
| Pex5l | 027674 | 108226 | 103861 |
| Pex5l | 027674 | 108221 | 103856 |
| Pex5l | 027674 | 108219 | N/A |
| Pex5l | 027674 | 155264 | N/A |
| Pex5l | 027674 | 194627 | N/A |
| Pex5l | 027674 | 108225 | 103860 |
| Pfkfb4 | 025648 | 198140 | 142378 |
| Pfkfb4 | 025648 | 051873 | 057197 |
| Pfkfb4 | 025648 | 198277 | N/A |
| Pfkfb4 | 025648 | 199620 | N/A |
| Pfkfb4 | 025648 | 196249 | 143249 |
| Pfkfb4 | 025648 | 199591 | 142992 |
| Pfkfb4 | 025648 | 199184 | N/A |
| Pfkfb4 | 025648 | 200229 | N/A |
| Pfkfb4 | 025648 | 200015 | 142339 |
| Pfkfb4 | 025648 | 198763 | N/A |
| Pfkm | 033065 | 163507 | 132803 |
| Pfkm | 033065 | 051226 | 059801 |
| Pfkp | 021196 | 131648 | N/A |
| Pfkp | 021196 | 138703 | 117030 |
| Pfkp | 021196 | 021614 | 021614 |
| Pfkp | 021196 | 142972 | 114439 |
| Pfkp | 021196 | 154100 | 116523 |
| Pfkp | 021196 | 133041 | 123662 |
| Pfkp | 021196 | 142372 | N/A |
| Pfkp | 021196 | 151894 | N/A |
| Pfkp | 021196 | 144053 | N/A |
| Pfkp | 021196 | 148999 | N/A |
| Pfkp | 021196 | 135761 | N/A |
| Pfkp | 021196 | 137327 | N/A |
| Pfkp | 021196 | 136585 | 115313 |
| Pgghg | 062031 | 164337 | N/A |
| Pgghg | 062031 | 164580 | 128214 |
| Pgghg | 062031 | 169736 | N/A |
| Pgghg | 062031 | 168084 | N/A |
| Pgghg | 062031 | 079403 | 078372 |
| Pgghg | 062031 | 163094 | 128478 |
| Pgm2l1 | 030729 | 084935 | 081998 |
| Pgm2l1 | 030729 | 208158 | N/A |
| Pgm2l1 | 030729 | 162108 | 124851 |
| Pgm2l1 | 030729 | 054436 | 054782 |
| Pgr | 031870 | 070463 | 063562 |
| Pgr | 031870 | 098986 | 096584 |
| Pgr | 031870 | 151080 | N/A |
| Pgr | 031870 | 189181 | 140124 |
| Phf21b | 016624 | 016768 | 016768 |
| Phf21b | 016624 | 162996 | N/A |
| Phf21b | 016624 | 159939 | 125355 |
| Phf21b | 016624 | 162044 | 124941 |
| Phf21b | 016624 | 159502 | N/A |
| Phf21b | 016624 | 160389 | N/A |
| Phf24 | 036062 | 151824 | N/A |
| Phf24 | 036062 | 132173 | 138443 |
| Phf24 | 036062 | 107975 | 103609 |
| Phf24 | 036062 | 107976 | 103610 |
| Phf24 | 036062 | 069184 | 071011 |
| Phf24 | 036062 | 124380 | 138593 |
| Phf24 | 036062 | 139100 | 138130 |
| Phf24 | 036062 | 138425 | 115816 |
| Phf24 | 036062 | 131234 | 138332 |
| Phkg1 | 025537 | 026617 | 026617 |
| Phkg1 | 025537 | 154932 | 122040 |
| Phkg1 | 025537 | 140667 | 117510 |
| Phkg1 | 025537 | 154495 | N/A |
| Phkg1 | 025537 | 200832 | N/A |
| Phkg1 | 025537 | 200922 | N/A |
| Phox2a | 007946 | 008090 | 008090 |
| Phox2a | 007946 | 209878 | N/A |
| Phyhip | 003469 | 003561 | 003561 |
| Phyhip | 003469 | 159180 | 125254 |
| Pid1 | 045658 | 168574 | 127716 |
| Pid1 | 045658 | 176559 | 135164 |
| Pid1 | 045658 | 175948 | N/A |
| Pid1 | 045658 | 176720 | 134961 |
| Pid1 | 045658 | 175996 | 134979 |
| Pid1 | 045658 | 176822 | 135425 |

TABLE 3-continued

| Symbol | MUSG | MUST | MUSP |
|---|---|---|---|
| | ENSEMBL IDs for rats | | |
| Pid1 | 045658 | 177458 | 135120 |
| Pid1 | 045658 | 187992 | N/A |
| Piezo2 | 041482 | 047480 | 040019 |
| Piezo2 | 041482 | 137141 | 117107 |
| Piezo2 | 041482 | 132576 | N/A |
| Piezo2 | 041482 | 123322 | N/A |
| Piezo2 | 041482 | 183217 | 138758 |
| Piezo2 | 041482 | 182233 | 138170 |
| Piezo2 | 041482 | 182166 | 138754 |
| Piezo2 | 041482 | 182177 | N/A |
| Piezo2 | 041482 | 046860 | 036099 |
| Piga | 031381 | 208741 | 147146 |
| Piga | 031381 | 112257 | 137831 |
| Piga | 031381 | 033754 | 033754 |
| Piga | 031381 | 151911 | 138077 |
| Piga | 031381 | 208697 | 146731 |
| Piga | 031381 | 208261 | 146808 |
| Piga | 031381 | 112255 | 107874 |
| Piga | 031381 | 133813 | 122176 |
| Piga | 031381 | 155849 | N/A |
| Pigh | 021120 | 072154 | 072018 |
| Pigh | 021120 | 217998 | 151930 |
| Pigh | 021120 | 217979 | N/A |
| Pigs | 041958 | 048073 | 044871 |
| Pigz | 045625 | 052174 | 057509 |
| Pigz | 045625 | 151412 | N/A |
| Pigz | 045625 | 134928 | N/A |
| Pigz | 045625 | 134666 | N/A |
| Pihlh3b | 042433 | 044806 | 048754 |
| Pik3c2b | 026447 | 153707 | 115469 |
| Pik3c2b | 026447 | 145153 | N/A |
| Pik3c2b | 026447 | 124934 | N/A |
| Pik3c2b | 026447 | 077730 | 076911 |
| Pik3r1 | 041417 | 055518 | 056774 |
| Pik3r1 | 041417 | 035532 | 047004 |
| Pik3r1 | 041417 | 187009 | 140256 |
| Pik3r1 | 041417 | 185795 | 140312 |
| Pik3r1 | 041417 | 190171 | N/A |
| Pik3r1 | 041417 | 185701 | N/A |
| Pik3r1 | 041417 | 189426 | N/A |
| Pitpnm3 | 040543 | 075258 | 074737 |
| Pitpnm3 | 040543 | 134210 | N/A |
| Pitpnm3 | 040543 | 132781 | N/A |
| Pitpnm3 | 040543 | 142471 | N/A |
| Pitpnm3 | 040543 | 108508 | 104148 |
| Pkd2l1 | 037578 | 042026 | 045675 |
| Pkd2l1 | 037578 | 161357 | N/A |
| Pkia | 027499 | 192468 | 142120 |
| Pkia | 027499 | 028999 | 028999 |
| Pkia | 027499 | 193330 | 141466 |
| Pknox2 | 035934 | 177218 | 135581 |
| Pknox2 | 035934 | 039674 | 035806 |
| Pknox2 | 035934 | 175938 | 138866 |
| Pknox2 | 035934 | 177080 | N/A |
| Pknox2 | 035934 | 176562 | N/A |
| Pknox2 | 035934 | 176622 | N/A |
| Pknox2 | 035934 | 177444 | 135641 |
| Pknox2 | 035934 | 188348 | 139976 |
| Pknox2 | 035934 | 188057 | 140793 |
| Pknox2 | 035934 | 189294 | 139728 |
| Pknox2 | 035934 | 188433 | N/A |
| Pknox2 | 035934 | 213653 | N/A |
| Pknox2 | 035934 | 215175 | N/A |
| Pknox2 | 035934 | 080754 | 079578 |
| Pkp3 | 054065 | 106039 | 101654 |
| Pkp3 | 054065 | 159375 | 124572 |
| Pkp3 | 054065 | 066873 | 069961 |
| Pkp3 | 054065 | 163041 | 124434 |
| Pkp3 | 054065 | 160869 | 124013 |
| Pkp3 | 054065 | 160615 | N/A |
| Pkp3 | 054065 | 160403 | N/A |
| Pkp3 | 054065 | 159253 | N/A |
| Pkp3 | 054065 | 161142 | N/A |
| Pla2g16 | 060675 | 025925 | 025925 |
| Pla2g16 | 060675 | 136756 | 115151 |
| Pla2g16 | 060675 | 136465 | 119403 |

TABLE 3-continued

ENSEMBL IDs for rats

| Symbol | MUSG | MUST | MUSP |
|--------|------|------|------|
| Pla2g16 | 060675 | 141887 | 123524 |
| Pla2g4a | 056220 | 070200 | 070868 |
| Pla2g4a | 056220 | 111926 | 107557 |
| Pla2g4a | 056220 | 190507 | 139851 |
| Pla2g4a | 056220 | 155438 | N/A |
| Pla2g4a | 056220 | 142040 | N/A |
| Pla2g4a | 056220 | 134676 | N/A |
| Pla2g4e | 050211 | 090071 | 087525 |
| Pla2g4e | 050211 | 127009 | N/A |
| Pla2g4e | 050211 | 136845 | N/A |
| Pla2g4e | 050211 | 152263 | N/A |
| Pla2g5 | 041193 | 102512 | 099570 |
| Pla2g5 | 041193 | 102513 | 099571 |
| Pla2g5 | 041193 | 102511 | 099569 |
| Pla2g5 | 041193 | 127183 | N/A |
| Pla2g5 | 041193 | 136393 | N/A |
| Pla2g5 | 041193 | 140117 | N/A |
| Pla2g5 | 041193 | 154844 | N/A |
| Pla2g5 | 041193 | 140100 | N/A |
| Pla2g5 | 041193 | 030524 | 030524 |
| Pla2g7 | 023913 | 167214 | 130404 |
| Pla2g7 | 023913 | 024706 | 024706 |
| Pla2g7 | 023913 | 167418 | 131898 |
| Pla2g7 | 023913 | 165706 | N/A |
| Pla2g7 | 023913 | 169694 | 132027 |
| Pla2g7 | 023913 | 163489 | N/A |
| Plag1 | 003282 | 003369 | 003369 |
| Plag1 | 003282 | 137439 | 117532 |
| Plag1 | 003282 | 151543 | 119937 |
| Plag1 | 003282 | 147035 | N/A |
| Plat | 031538 | 210960 | N/A |
| Plat | 031538 | 033941 | 033941 |
| Plat | 031538 | 211033 | N/A |
| Plcb1 | 051177 | 131552 | 118756 |
| Plcb1 | 051177 | 110116 | 105743 |
| Plcb1 | 051177 | 130524 | N/A |
| Plcb1 | 051177 | 202531 | N/A |
| Plcb1 | 051177 | 070724 | 064844 |
| Plcb1 | 051177 | 129382 | N/A |
| Plcb1 | 051177 | 201485 | 144399 |
| Plcb1 | 051177 | 201524 | N/A |
| Plce1 | 024998 | 181994 | N/A |
| Plce1 | 024998 | 182481 | 138360 |
| Plce1 | 024998 | 169713 | 130604 |
| Plce1 | 024998 | 182267 | 138330 |
| Plce1 | 024998 | 182999 | 138098 |
| Plce1 | 024998 | 182589 | N/A |
| Plce1 | 024998 | 183131 | N/A |
| Plch1 | 036834 | 048134 | 047693 |
| Plch1 | 036834 | 159374 | N/A |
| Plch1 | 036834 | 159982 | N/A |
| Plch1 | 036834 | 084105 | 081122 |
| Plch1 | 036834 | 162269 | 124463 |
| Plch1 | 036834 | 159676 | 124632 |
| Plch1 | 036834 | 059973 | 058524 |
| Plch1 | 036834 | 177143 | 135424 |
| Plch1 | 036834 | 176861 | 135562 |
| Plch1 | 036834 | 175947 | 135353 |
| Plch1 | 036834 | 159188 | 124491 |
| Plch1 | 036834 | 161052 | 125581 |
| Plch1 | 036834 | 160638 | 123921 |
| Plcl1 | 038349 | 042986 | 037854 |
| Plcl1 | 038349 | 187059 | N/A |
| Pld5 | 055214 | 125404 | 121428 |
| Pld5 | 055214 | 065967 | 069326 |
| Pld5 | 055214 | 156184 | N/A |
| Pld5 | 055214 | 144340 | N/A |
| Pld5 | 055214 | 111166 | 106796 |
| Pld5 | 055214 | 111167 | 106797 |
| Plekhd1 | 066438 | 153762 | N/A |
| Plekhd1 | 066438 | 142760 | 121812 |
| Plekhd1 | 066438 | 152465 | N/A |
| Plekhd1 | 066438 | 140770 | 119711 |
| Plekhg3 | 052609 | 217730 | 151564 |
| Plekhg3 | 052609 | 075249 | 074729 |
| Plekhg3 | 052609 | 218461 | N/A |

| Symbol | MUSG | MUST | MUSP |
|--------|------|------|------|
| Plekhg3 | 052609 | 219063 | 151851 |
| Plekhg3 | 052609 | 218380 | 151867 |
| Plekhg3 | 052609 | 219751 | 151704 |
| Plekhg3 | 052609 | 218357 | N/A |
| Plekhg3 | 052609 | 219426 | N/A |
| Plekhg3 | 052609 | 218427 | N/A |
| Plekhh1 | 060716 | 039928 | 049460 |
| Plekhh1 | 060716 | 217954 | 151944 |
| Plekhh1 | 060716 | 219956 | 151747 |
| Plekhh1 | 060716 | 219946 | N/A |
| Plekhh2 | 040852 | 047206 | 039628 |
| Plekho2 | 050721 | 214740 | N/A |
| Plekho2 | 050721 | 213554 | N/A |
| Plekho2 | 050721 | 068944 | 063677 |
| Plekho2 | 050721 | 213652 | N/A |
| Pllp | 031775 | 034227 | 034227 |
| Pllp | 031775 | 212555 | N/A |
| Pllp | 031775 | 213043 | 148729 |
| Plp1 | 031425 | 033800 | 033800 |
| Plp1 | 031425 | 113085 | 108708 |
| Plp1 | 031425 | 125644 | N/A |
| Plp1 | 031425 | 144880 | N/A |
| Plpp3 | 028517 | 064139 | 065719 |
| Plpp4 | 070366 | 094018 | 091557 |
| Plpp4 | 070366 | 206551 | N/A |
| Plpp4 | 070366 | 206918 | N/A |
| Plpp4 | 070366 | 205630 | 145851 |
| Plpp4 | 070366 | 205896 | 145944 |
| Plppr4 | 044667 | 061071 | 052306 |
| Plppr4 | 044667 | 125664 | N/A |
| Plppr4 | 044667 | 197743 | 143753 |
| Pls1 | 049493 | 093800 | 091317 |
| Pls1 | 049493 | 119760 | 113200 |
| Pls1 | 049493 | 135816 | N/A |
| Plscr1 | 032369 | 093801 | 091318 |
| Plscr1 | 032369 | 186364 | 139479 |
| Plscr1 | 032369 | 187952 | N/A |
| Plscr4 | 032377 | 034941 | 034941 |
| Plscr4 | 032377 | 143866 | N/A |
| Pltp | 017754 | 109316 | 104939 |
| Pltp | 017754 | 109317 | 104940 |
| Pltp | 017754 | 059954 | 061519 |
| Pltp | 017754 | 142603 | N/A |
| Pltp | 017754 | 148912 | N/A |
| Pltp | 017754 | 156255 | 119955 |
| Pltp | 017754 | 128110 | 122760 |
| Plxdc1 | 017417 | 017561 | 017561 |
| Plxdc1 | 017417 | 107565 | 103191 |
| Plxdc1 | 017417 | 141708 | N/A |
| Plxdc1 | 017417 | 107564 | 103190 |
| Plxna4 | 029765 | 115096 | 110748 |
| Plxna4 | 029765 | 200732 | N/A |
| Plxnb1 | 053646 | 072093 | 071966 |
| Plxnb1 | 053646 | 131462 | 115265 |
| Plxnb1 | 053646 | 130366 | 114358 |
| Plxnb1 | 053646 | 192988 | 142431 |
| Plxnb1 | 053646 | 195364 | N/A |
| Plxnb1 | 053646 | 192117 | N/A |
| Plxnb1 | 053646 | 194734 | N/A |
| Plxnb3 | 031385 | 149478 | N/A |
| Plxnb3 | 031385 | 146812 | N/A |
| Plxnb3 | 031385 | 147127 | N/A |
| Plxnb3 | 031385 | 002079 | 002079 |
| Plxnb3 | 031385 | 155096 | N/A |
| Plxnc1 | 074785 | 099337 | 096939 |
| Plxnc1 | 074785 | 218839 | N/A |
| Plxnc1 | 074785 | 180514 | N/A |
| Plxnc1 | 074785 | 181244 | 138038 |
| Plxnc1 | 074785 | 180573 | N/A |
| Pmepa1 | 038400 | 124124 | N/A |
| Pmepa1 | 038400 | 139306 | 115534 |
| Pmepa1 | 038400 | 036248 | 039950 |
| Pmp2 | 052468 | 029034 | 029034 |
| Pmp22 | 018217 | 018361 | 018361 |
| Pmp22 | 018217 | 108702 | 104342 |
| Pmp22 | 018217 | 108701 | 104341 |

TABLE 3-continued

TABLE 3-continued

| Symbol | MUSG | MUST | MUSP |
|---|---|---|---|
| Pmp22 | 018217 | 140648 | N/A |
| Pmp22 | 018217 | 108700 | 104340 |
| Polr2a | 005198 | 058470 | 050771 |
| Polr2a | 005198 | 156588 | N/A |
| Polr2a | 005198 | 151586 | N/A |
| Polr2a | 005198 | 071213 | 071200 |
| Pon2 | 032667 | 057792 | 062670 |
| Pon2 | 032667 | 123838 | N/A |
| Pon2 | 032667 | 135342 | N/A |
| Pon2 | 032667 | 203882 | N/A |
| Por | 005514 | 153500 | 121531 |
| Por | 005514 | 150058 | N/A |
| Por | 005514 | 153515 | 121022 |
| Por | 005514 | 005651 | 005651 |
| Por | 005514 | 122113 | 112924 |
| Por | 005514 | 147515 | N/A |
| Por | 005514 | 127096 | 119138 |
| Por | 005514 | 149684 | N/A |
| Por | 005514 | 132084 | N/A |
| Pparg | 000440 | 171644 | 131962 |
| Pparg | 000440 | 203732 | 145525 |
| Pparg | 000440 | 204305 | 145083 |
| Pparg | 000440 | 203308 | N/A |
| Pparg | 000440 | 205213 | 144975 |
| Pparg | 000440 | 000450 | 000450 |
| Pparg | 000440 | 203896 | N/A |
| Ppfia4 | 026458 | 168515 | 128314 |
| Ppfia4 | 026458 | 186730 | 139800 |
| Ppfia4 | 026158 | 186964 | N/A |
| Ppfia4 | 026158 | 189862 | N/A |
| Ppfia4 | 026158 | 189361 | 139833 |
| Ppfia4 | 026158 | 186553 | N/A |
| Ppfibp1 | 016187 | 133825 | N/A |
| Ppfibp1 | 016187 | 155415 | 121270 |
| Ppfibp1 | 016187 | 204028 | N/A |
| Ppfibp1 | 016187 | 136837 | 114340 |
| Ppfibp1 | 016187 | 123902 | N/A |
| Ppfibp1 | 016187 | 149203 | N/A |
| Ppfibp1 | 016187 | 126774 | N/A |
| Ppfibp1 | 016487 | 203730 | 145088 |
| Ppfibp1 | 016487 | 111623 | 107250 |
| Ppfibp1 | 016487 | 204660 | 144887 |
| Ppfibp1 | 016487 | 154221 | 122515 |
| Ppfibp1 | 016487 | 016631 | 016631 |
| Ppfibp2 | 036528 | 207852 | N/A |
| Ppfibp2 | 036528 | 040056 | 042574 |
| Ppfibp2 | 036528 | 208504 | N/A |
| Ppfibp2 | 036528 | 208956 | 146889 |
| Ppfibp2 | 036528 | 098134 | 095738 |
| Ppfibp2 | 036528 | 208159 | 147038 |
| Ppm1e | 046442 | 055438 | 061278 |
| Ppm1e | 046442 | 155154 | N/A |
| Ppm1h | 034613 | 162853 | N/A |
| Ppm1h | 034613 | 161487 | 124982 |
| Ppm1h | 034613 | 067918 | 066561 |
| Ppm1h | 034613 | 160315 | N/A |
| Ppm1h | 034613 | 159885 | N/A |
| Ppm1h | 034613 | 161065 | N/A |
| Ppm1h | 034613 | 161371 | N/A |
| Ppm1h | 034613 | 162969 | 124006 |
| Ppp1r14a | 037166 | 207714 | 146684 |
| Ppp1r14a | 037166 | 048187 | 035642 |
| Ppp1r16b | 037754 | 052927 | 062615 |
| Ppp1r16b | 037754 | 045503 | 039540 |
| Ppp1r16b | 037754 | 129902 | N/A |
| Ppp1r16b | 037754 | 145073 | 117310 |
| Ppp1r16b | 037754 | 103116 | 099405 |
| Ppp1r17 | 002930 | 052827 | 059708 |
| Ppp4r4 | 021209 | 021631 | 021631 |
| Ppp4r4 | 021209 | 189871 | 139786 |
| Ppp4r4 | 021209 | 187155 | 140874 |
| Ppp4r4 | 021209 | 190664 | 140295 |
| Ppp4r4 | 021209 | 190151 | 139815 |
| Prag1 | 050271 | 110492 | 106118 |
| Prag1 | 050271 | 145386 | N/A |
| Prag1 | 050271 | 150295 | N/A |

| Symbol | MUSG | MUST | MUSP |
|---|---|---|---|
| Prex1 | 039621 | 036719 | 037180 |
| Prex1 | 039621 | 127553 | N/A |
| Prex1 | 039621 | 099080 | 096679 |
| Prex1 | 039621 | 109246 | 104869 |
| Prex1 | 039621 | 140624 | N/A |
| Prex1 | 039621 | 152238 | N/A |
| Prex1 | 039621 | 136564 | N/A |
| Prex1 | 039621 | 136974 | N/A |
| Prex2 | 048960 | 027056 | 027056 |
| Prex2 | 048960 | 190935 | N/A |
| Prex2 | 048960 | 189822 | N/A |
| Prex2 | 048960 | 187694 | N/A |
| Prex2 | 048960 | 188189 | 140621 |
| Prex2 | 048960 | 187745 | 140788 |
| Prex2 | 048960 | 189385 | 140863 |
| Prex2 | 048960 | 188154 | 140580 |
| Prickle1 | 036158 | 048982 | 049204 |
| Prickle1 | 036158 | 109255 | 104878 |
| Prima1 | 041669 | 123655 | N/A |
| Prima1 | 041669 | 127843 | 114309 |
| Prima1 | 041669 | 074416 | 074017 |
| Prima1 | 041669 | 156176 | 123331 |
| Prima1 | 041669 | 155547 | N/A |
| Prkag3 | 006542 | 160732 | 125344 |
| Prkag3 | 006542 | 113672 | 109302 |
| Prkag3 | 006542 | 081636 | 080342 |
| Prkag3 | 006542 | 162093 | 125242 |
| Prkag3 | 006542 | 159728 | 124979 |
| Prkag3 | 006542 | 188073 | 139909 |
| Prkcb | 052889 | 143692 | 138788 |
| Prkcb | 052889 | 064989 | 070019 |
| Prkcb | 052889 | 064921 | 064812 |
| Prkcb | 052889 | 131167 | N/A |
| Prkcb | 052889 | 149583 | N/A |
| Prkcb | 052889 | 205550 | N/A |
| Prkcb | 052889 | 127910 | N/A |
| Prkcb | 052889 | 206495 | N/A |
| Prkcd | 021948 | 112210 | 107829 |
| Prkcd | 021948 | 022521 | 022521 |
| Prkcd | 021948 | 112207 | 107826 |
| Prkcd | 021948 | 112206 | 107825 |
| Prkcd | 021948 | 140701 | N/A |
| Prkcd | 021948 | 112202 | 107821 |
| Prkcd | 021948 | 112203 | 107822 |
| Prkcd | 021948 | 130736 | N/A |
| Prkcd | 021948 | 135714 | N/A |
| Prkcd | 021948 | 145806 | N/A |
| Prkcd | 021948 | 112208 | N/A |
| Prkcd | 021948 | 227078 | N/A |
| Prkcd | 021948 | 112211 | 107830 |
| Prkcg | 078816 | 203600 | N/A |
| Prkcg | 078816 | 100301 | 097874 |
| Prkcg | 078816 | 172109 | 131351 |
| Prkcg | 078816 | 203081 | 145498 |
| Prkcg | 078816 | 203454 | N/A |
| Prkcg | 097449 | 181455 | 137923 |
| Prkcg | 097449 | 181221 | 137836 |
| Prkcq | 026778 | 028118 | 028118 |
| Prkcq | 026778 | 114853 | N/A |
| Prkcq | 026778 | 195207 | N/A |
| Prkcq | 026778 | 102970 | 100035 |
| Prkcq | 026778 | 192461 | N/A |
| Prkcq | 026778 | 195628 | N/A |
| Prkd3 | 024070 | 003191 | 003191 |
| Prkd3 | 024070 | 119284 | 113395 |
| Prkd3 | 024070 | 146917 | N/A |
| Prkd3 | 024070 | 118768 | 113232 |
| Prkd3 | 024070 | 118991 | 112775 |
| Prkd3 | 024070 | 124229 | N/A |
| Prkd3 | 024070 | 130070 | N/A |
| Prkd3 | 024070 | 168887 | 132004 |
| Prkg2 | 029334 | 161490 | 124963 |
| Prkg2 | 029334 | 162619 | 142743 |
| Prkg2 | 029334 | 162147 | 143708 |
| Prkg2 | 029334 | 031277 | 031277 |
| Prkg2 | 029334 | 160765 | N/A |

TABLE 3-continued

| | ENSEMBL IDs for rats | | |
|---|---|---|---|
| Symbol | MUSG | MUST | MUSP |
| Prmt8 | 030350 | 032500 | 032500 |
| Procr | 027611 | 029140 | 029140 |
| Procr | 027611 | 143493 | N/A |
| Procr | 027611 | 155095 | N/A |
| Procr | 027611 | 132608 | 114567 |
| Prr5 | 036106 | 171460 | 127890 |
| Prr5 | 036106 | 065499 | 066396 |
| Prr5l | 032841 | 043845 | 042167 |
| Prr5l | 032841 | 141814 | 118537 |
| Prr5l | 032841 | 125985 | 122996 |
| Prr5l | 032841 | 154525 | 120192 |
| Prr5l | 032841 | 124802 | 118502 |
| Prr5l | 032841 | 144549 | 116266 |
| Prr5l | 032841 | 140387 | N/A |
| Prr5l | 032841 | 127358 | N/A |
| Prr5l | 032841 | 163762 | 127530 |
| Prr5l | 032841 | 171088 | 130152 |
| Prrc1 | 024594 | 025490 | 025490 |
| Prrg3 | 033361 | 126362 | 118155 |
| Prrg3 | 033361 | 048790 | 038947 |
| Prrg3 | 033361 | 170096 | 128073 |
| Prrx1 | 026586 | 075805 | 075203 |
| Prrx1 | 026586 | 027878 | 027878 |
| Prrx1 | 026586 | 183691 | N/A |
| Prrx1 | 026586 | 174397 | 134338 |
| Prrx1 | 026586 | 174098 | N/A |
| Psd2 | 024347 | 115716 | 111381 |
| Psd2 | 024347 | 176873 | 135616 |
| Psd2 | 024347 | 177432 | 135431 |
| Psd2 | 024347 | 176472 | 135285 |
| Psd2 | 024347 | 175734 | 135795 |
| Psd2 | 024347 | 175720 | N/A |
| Pstpip2 | 025429 | 114741 | 110389 |
| Ptchd1 | 041552 | 038665 | 039443 |
| Ptchd1 | 041552 | 170236 | 132293 |
| Ptchd1 | 041552 | 141356 | N/A |
| Ptchd4 | 042256 | 048691 | 047640 |
| Pter | 026730 | 154269 | 118645 |
| Pter | 026730 | 150283 | N/A |
| Pter | 026730 | 114796 | 110444 |
| Pter | 026730 | 134794 | 117009 |
| Pter | 026730 | 028063 | 028063 |
| Pter | 026730 | 193742 | N/A |
| Pter | 026730 | 195521 | N/A |
| Ptgfrn | 027864 | 102694 | 099755 |
| Ptgfrn | 027864 | 198037 | N/A |
| Ptgfrn | 027864 | 200065 | N/A |
| Ptk2b | 059456 | 022622 | 022622 |
| Ptk2b | 059456 | 154865 | 122683 |
| Ptk2b | 059456 | 089250 | 086661 |
| Ptk2b | 059456 | 136216 | N/A |
| Ptk2b | 059456 | 111121 | 106750 |
| Ptk2b | 059456 | 148104 | N/A |
| Ptk2b | 059456 | 127083 | N/A |
| Ptk2b | 059456 | 178730 | 137008 |
| Ptn | 029838 | 101534 | 099073 |
| Ptn | 029838 | 201321 | 144184 |
| Ptpn14 | 026604 | 097442 | 095051 |
| Ptpn14 | 026604 | 194127 | N/A |
| Ptpn14 | 026604 | 128275 | N/A |
| Ptpn14 | 026604 | 027898 | 027898 |
| Ptpn14 | 026604 | 195038 | N/A |
| Ptpn14 | 026604 | 148129 | N/A |
| Ptpn22 | 027843 | 146071 | 122307 |
| Ptpn22 | 027843 | 029433 | 029433 |
| Ptpn22 | 027843 | 198530 | N/A |
| Ptpn22 | 027843 | 197997 | N/A |
| Ptpn22 | 027843 | 196385 | N/A |
| Ptpn22 | 027843 | 198701 | N/A |
| Ptpn22 | 027843 | 134373 | N/A |
| Ptpn22 | 027843 | 126548 | N/A |
| Ptpn5 | 030854 | 102626 | 099686 |
| Ptpn5 | 030854 | 209161 | N/A |
| Ptpn5 | 030854 | 033142 | 033142 |
| Ptpn5 | 030854 | 208324 | N/A |
| Ptpn5 | 030854 | 208531 | N/A |

TABLE 3-continued

| | ENSEMBL IDs for rats | | |
|---|---|---|---|
| Symbol | MUSG | MUST | MUSP |
| Ptpn5 | 030854 | 207172 | N/A |
| Ptpn5 | 030854 | 208437 | N/A |
| Ptpn5 | 030854 | 209179 | N/A |
| Ptpn5 | 030854 | 209184 | N/A |
| Ptpn5 | 030854 | 207344 | N/A |
| Ptpn5 | 030854 | 209057 | N/A |
| Ptprk | 019889 | 166468 | 126279 |
| Ptprk | 019889 | 218359 | 151986 |
| Ptprk | 019889 | 218276 | 151866 |
| Ptprk | 019889 | 219478 | N/A |
| Ptprk | 019889 | 218633 | N/A |
| Ptprk | 019889 | 219107 | N/A |
| Ptprk | 019889 | 218584 | N/A |
| Ptprk | 019889 | 219761 | N/A |
| Ptprk | 019889 | 219621 | 151294 |
| Ptprk | 019889 | 220357 | 151493 |
| Ptprk | 019889 | 220404 | N/A |
| Ptprm | 033278 | 037974 | 045603 |
| Ptprm | 033278 | 223982 | 153662 |
| Ptprm | 033278 | 225074 | N/A |
| Ptprm | 033278 | 224091 | 153463 |
| Ptprm | 033278 | 225554 | 153042 |
| Ptprm | 033278 | 225688 | N/A |
| Ptprm | 033278 | 224862 | 153179 |
| Ptpro | 030223 | 203010 | N/A |
| Ptpro | 030223 | 167679 | 127112 |
| Ptpro | 030223 | 077115 | 076364 |
| Ptpro | 030223 | 167002 | 131764 |
| Ptpro | 030223 | 203914 | 144870 |
| Ptpro | 030223 | 204780 | N/A |
| Ptpro | 030223 | 203255 | N/A |
| Ptpro | 030223 | 203127 | N/A |
| Ptprr | 020151 | 063470 | 064392 |
| Ptprr | 020151 | 142617 | N/A |
| Ptprr | 020151 | 105271 | 100907 |
| Ptprr | 020151 | 148731 | 120965 |
| Ptprr | 020151 | 155606 | 122259 |
| Ptprr | 020151 | 128399 | 114455 |
| Ptprr | 020151 | 124369 | N/A |
| Ptprt | 053141 | 109445 | 105071 |
| Ptprt | 053141 | 109443 | 105069 |
| Ptprt | 053141 | 109442 | 105068 |
| Ptprt | 053141 | 109441 | 105067 |
| Ptprt | 053141 | 153770 | N/A |
| Ptprt | 053141 | 129015 | N/A |
| Ptprz1 | 068748 | 090568 | 088056 |
| Ptprz1 | 068748 | 202579 | 144605 |
| Ptprz1 | 068748 | 202102 | 143902 |
| Ptprz1 | 068748 | 202341 | N/A |
| Ptprz1 | 068748 | 201827 | N/A |
| Ptprz1 | 068748 | 200769 | N/A |
| Pttg1 | 020415 | 020687 | 020687 |
| Pttg1 | 020415 | 117446 | 112841 |
| Pttg1 | 020415 | 140434 | 122019 |
| Pttg1 | 020415 | 101340 | 098894 |
| Pttg1 | 020415 | 118368 | 112834 |
| Pttg1 | 020415 | 121638 | 112815 |
| Pttg1 | 020415 | 152115 | 119554 |
| Pttg1 | 020415 | 020685 | 020685 |
| Pttg1 | 020415 | 150726 | N/A |
| Pttg1 | 020415 | 148130 | N/A |
| Purb | 094483 | 179343 | 136957 |
| Pvalb | 005716 | 005860 | 005860 |
| Pvalb | 005716 | 120592 | 112598 |
| Pxdc1 | 021411 | 053459 | 051246 |
| Pxdc1 | 021411 | 021847 | 021847 |
| Pxdc1 | 021411 | 125037 | 117791 |
| Pxdc1 | 021411 | 152392 | N/A |
| Pxdn | 020674 | 220271 | 151320 |
| Pxdn | 020674 | 122328 | 113703 |
| Pxdn | 020674 | 118321 | 113477 |
| Pxdn | 020674 | 155318 | N/A |
| Pxdn | 020674 | 155190 | N/A |
| Pxdn | 020674 | 126233 | N/A |
| Pxdn | 020674 | 137316 | N/A |
| Pxdn | 020674 | 218620 | N/A |

TABLE 3-continued

| ENSEMBL IDs for rats | | | |
| --- | --- | --- | --- |
| Symbol | MUSG | MUST | MUSP |
| Pxk | 033885 | 036682 | 035265 |
| Pxk | 033885 | 225827 | N/A |
| Pxk | 033885 | 225616 | N/A |
| Pxk | 033885 | 225653 | 152987 |
| Pxk | 033885 | 224462 | N/A |
| Pxk | 033885 | 112689 | 108309 |
| Pxylp1 | 043587 | 112951 | 108574 |
| Pxylp1 | 043587 | 078478 | 077571 |
| Pxylp1 | 043587 | 120101 | 113210 |
| Pxylp1 | 043587 | 119141 | 113489 |
| Pxylp1 | 043587 | 126411 | 121537 |
| Pxylp1 | 043587 | 121077 | 113059 |
| Pxylp1 | 043587 | 135834 | N/A |
| Pxylp1 | 043587 | 154146 | 114946 |
| Pxylp1 | 043587 | 137770 | N/A |
| Pxylp1 | 043587 | 124923 | 120377 |
| Pxylp1 | 043587 | 141127 | N/A |
| Pxylp1 | 043587 | 136987 | N/A |
| Pxylp1 | 043587 | 185561 | N/A |
| Pyroxd2 | 060224 | 076505 | 075825 |
| Qdpr | 015806 | 198258 | 143741 |
| Qdpr | 015806 | 197946 | 143584 |
| Qdpr | 015806 | 117425 | 112469 |
| Qdpr | 015806 | 120867 | 113203 |
| Qdpr | 015806 | 118097 | 113958 |
| Qdpr | 015806 | 015950 | 015950 |
| Qdpr | 015806 | 200259 | N/A |
| Qdpr | 015806 | 149290 | N/A |
| Qdpr | 015806 | 154962 | 122081 |
| Qdpr | 015806 | 127562 | 115453 |
| Qk | 062078 | 042296 | 046740 |
| Qk | 062078 | 097414 | 095025 |
| Rab11fip1 | 031488 | 054212 | 058042 |
| Rab11fip1 | 031488 | 033878 | 033878 |
| Rab11fip1 | 031488 | 209377 | 147543 |
| Rab11fip1 | 031488 | 210187 | N/A |
| Rab11fip1 | 031488 | 210919 | N/A |
| Rab11fip1 | 031488 | 211646 | N/A |
| Rab15 | 021062 | 021459 | 021459 |
| Rab15 | 021062 | 143863 | N/A |
| Rab15 | 021062 | 122419 | 112457 |
| Rab15 | 021062 | 121716 | 113299 |
| Rab15 | 021062 | 118604 | 112789 |
| Rab15 | 021062 | 154765 | 122067 |
| Rab15 | 021062 | 141622 | 115720 |
| Rab15 | 021062 | 134124 | N/A |
| Rab27a | 032202 | 184146 | 139310 |
| Rab27a | 032202 | 034722 | 034722 |
| Rab27a | 032202 | 184575 | N/A |
| Rab27a | 032202 | 184032 | N/A |
| Rab27b | 024511 | 121693 | 114094 |
| Rab27b | 024511 | 127217 | N/A |
| Rab27b | 024511 | 117692 | 112807 |
| Rab27b | 024511 | 069749 | 068349 |
| Rab31 | 056515 | 070673 | 068195 |
| Rab3a | 031840 | 110093 | 105720 |
| Rab3a | 031840 | 143118 | 123384 |
| Rab3a | 031840 | 034301 | 034301 |
| Rab3a | 031840 | 110090 | 105717 |
| Rab3a | 031840 | 110092 | 105719 |
| Rab3a | 031840 | 130468 | N/A |
| Rab3a | 111277 | 217185 | 150125 |
| Rab3b | 003411 | 106650 | 102261 |
| Rab3b | 003411 | 106651 | 102262 |
| Rab3b | 003411 | 003502 | 003502 |
| Rab3b | 003411 | 157062 | N/A |
| Rab3c | 021700 | 167824 | 132945 |
| Rab3c | 021700 | 223922 | 153347 |
| Rab3c | 021700 | 224180 | 153136 |
| Rab3c | 021700 | 224287 | N/A |
| Rab3c | 021700 | 226040 | N/A |
| Rai2 | 043518 | 112338 | 107957 |
| Rai2 | 043518 | 061514 | 051618 |
| Ralgps2 | 026594 | 172057 | 132533 |
| Ralgps2 | 026594 | 027886 | 027886 |
| Ralgps2 | 026594 | 192343 | 142004 |

TABLE 3-continued

| ENSEMBL IDs for rats | | | |
| --- | --- | --- | --- |
| Symbol | MUSG | MUST | MUSP |
| Ralgps2 | 026594 | 171292 | 130581 |
| Ralgps2 | 026594 | 063199 | 063872 |
| Ralgps2 | 026594 | 191605 | 139645 |
| Ralgps2 | 026594 | 189208 | N/A |
| Ralgps2 | 026594 | 185198 | 139618 |
| Ralgps2 | 026594 | 189316 | 140230 |
| Ralgps2 | 026594 | 190648 | 140055 |
| Ralgps2 | 026594 | 188656 | 140342 |
| Ralgps2 | 026594 | 191503 | N/A |
| Ralgps2 | 026594 | 185970 | N/A |
| Ralgps2 | 026594 | 190762 | 139822 |
| Ralgps2 | 026594 | 189648 | 140108 |
| Ralyl | 039717 | 191806 | 148406 |
| Ralyl | 039717 | 193117 | 148795 |
| Ralyl | 039717 | 211860 | 148430 |
| Ralyl | 039717 | 192209 | 142094 |
| Ralyl | 039717 | 171075 | 125848 |
| Ralyl | 039717 | 108372 | 104009 |
| Ralyl | 039717 | 108373 | 148751 |
| Ramp2 | 001240 | 129680 | 122072 |
| Ramp2 | 001240 | 149006 | N/A |
| Ramp2 | 001240 | 128260 | 127718 |
| Ramp2 | 001240 | 122006 | 114061 |
| Ramp2 | 001240 | 149585 | 116331 |
| Ramp2 | 001240 | 151830 | 123150 |
| Ramp2 | 001240 | 138229 | N/A |
| Ramp2 | 001240 | 107282 | 102903 |
| Rapgef3 | 022469 | 126854 | 116426 |
| Rapgef3 | 022469 | 129223 | 118148 |
| Rapgef3 | 022469 | 128775 | 120126 |
| Rapgef3 | 022469 | 177352 | 135238 |
| Rapgef3 | 022469 | 134885 | 135317 |
| Rapgef3 | 022469 | 175894 | 135194 |
| Rapgef3 | 022469 | 125002 | N/A |
| Rapgef3 | 022469 | 123397 | N/A |
| Rapgef3 | 022469 | 155810 | N/A |
| Rapgef3 | 022469 | 146214 | N/A |
| Rapgef3 | 022469 | 134371 | 122746 |
| Rapgef3 | 022469 | 153241 | N/A |
| Rapgef3 | 022469 | 149419 | 122285 |
| Rapgef3 | 022469 | 153464 | N/A |
| Rapgef3 | 022469 | 146620 | 116673 |
| Rapgef3 | 022469 | 142196 | N/A |
| Rapgef3 | 022469 | 135080 | 117337 |
| Rapgef4 | 049044 | 090826 | 088336 |
| Rapgef4 | 049044 | 150234 | N/A |
| Rapgef4 | 049044 | 102698 | 099759 |
| Rapgef4 | 049044 | 151236 | N/A |
| Rapgef4 | 049044 | 028525 | 028525 |
| Rapgef4 | 049044 | 153887 | N/A |
| Rapgef4 | 049044 | 149421 | N/A |
| Rapgef4 | 049044 | 124004 | N/A |
| Rapgef4 | 049044 | 122975 | N/A |
| Rapgef4 | 049044 | 156031 | N/A |
| Rapgef4 | 049044 | 146970 | N/A |
| Rarb | 017491 | 063750 | 067694 |
| Rarb | 017491 | 225921 | 152980 |
| Rarb | 017491 | 223576 | 153098 |
| Rarb | 017491 | 225594 | 153178 |
| Rarb | 017491 | 223976 | 153519 |
| Rarb | 017491 | 225356 | N/A |
| Rarb | 017491 | 225245 | 153454 |
| Rasal2 | 070565 | 078308 | 077423 |
| Rasal2 | 070565 | 132699 | 114964 |
| Rasal2 | 070565 | 129880 | 118367 |
| Rasal2 | 070565 | 134543 | 119623 |
| Rasal2 | 070565 | 128538 | N/A |
| Rasal2 | 070565 | 143358 | 116974 |
| Rasal2 | 070565 | 143080 | N/A |
| Rasgef1b | 089809 | 031276 | 031276 |
| Rasgef1b | 089809 | 168092 | 129652 |
| Rasgef1b | 089809 | 209346 | 147997 |
| Rasgef1b | 089809 | 166484 | 128947 |
| Rasgef1b | 089809 | 166632 | N/A |
| Rasgef1b | 089809 | 146396 | 125723 |
| Rasgef1b | 089809 | 161516 | 125057 |

TABLE 3-continued

| ENSEMBL IDs for rats | | | |
| --- | --- | --- | --- |
| Symbol | MUSG | MUST | MUSP |
| Rasgef1b | 089809 | 142639 | N/A |
| Rasgef1b | 089809 | 160803 | N/A |
| Rasgef1b | 089809 | 161148 | 125009 |
| Rasgrf1 | 032356 | 189545 | 140921 |
| Rasgrf1 | 032356 | 034909 | 034909 |
| Rasgrf1 | 032356 | 034912 | 034912 |
| Rasgrf1 | 032356 | 190073 | N/A |
| Rasgrp1 | 027347 | 102534 | 099593 |
| Rasgrp1 | 027347 | 174770 | 134167 |
| Rasgrp1 | 027347 | 173541 | 134027 |
| Rasgrp1 | 027347 | 172901 | 133449 |
| Rasgrp1 | 027347 | 173252 | 134592 |
| Rasgrp1 | 027347 | 110898 | N/A |
| Rasgrp1 | 027347 | 178884 | 136423 |
| Rassf2 | 027339 | 028814 | 028814 |
| Rassf2 | 027339 | 103182 | 099471 |
| Rassf2 | 027339 | 155829 | N/A |
| Rassf2 | 027339 | 139047 | 120194 |
| Rassf2 | 027339 | 140791 | 117619 |
| Rbks | 029136 | 201744 | N/A |
| Rbks | 029136 | 031018 | 031018 |
| Rbks | 029136 | 202036 | N/A |
| Rbm24 | 038132 | 037923 | 043120 |
| Rbm24 | 038132 | 225221 | N/A |
| Rbm24 | 038132 | 225727 | N/A |
| Rbm24 | 038132 | 224638 | N/A |
| Rbm24 | 038132 | 225890 | N/A |
| Rbm25 | 010608 | 181983 | 138572 |
| Rbm25 | 010608 | 182004 | 138573 |
| Rbm25 | 010608 | 048155 | 048470 |
| Rbm25 | 010608 | 182618 | 138665 |
| Rbm25 | 010608 | 183154 | 138669 |
| Rbm25 | 010608 | 182036 | 138565 |
| Rbm25 | 010608 | 182347 | 138410 |
| Rbm25 | 010608 | 182633 | 138625 |
| Rbm25 | 010608 | 182881 | N/A |
| Rbm25 | 010608 | 183128 | N/A |
| Rbm25 | 010608 | 182450 | 138416 |
| Rbm25 | 010608 | 182255 | N/A |
| Rbm25 | 010608 | 183039 | N/A |
| Rbm25 | 010608 | 182032 | N/A |
| Rbm25 | 010608 | 183242 | N/A |
| Rbm25 | 010608 | 183282 | N/A |
| Rbm25 | 010608 | 182840 | N/A |
| Rbm25 | 010608 | 183181 | N/A |
| Rbms3 | 039607 | 111773 | 107403 |
| Rbms3 | 039607 | 068962 | 066735 |
| Rbms3 | 039607 | 173429 | 133900 |
| Rbms3 | 039607 | 174868 | 133621 |
| Rbms3 | 039607 | 164018 | 131371 |
| Rbms3 | 039607 | 111772 | 107402 |
| Rbms3 | 039607 | 044901 | 039706 |
| Rbms3 | 039607 | 172469 | 134172 |
| Rbms3 | 039607 | 069095 | N/A |
| Rbms3 | 039607 | 172564 | 134528 |
| Rbms3 | 039607 | 174276 | N/A |
| Rbms3 | 039607 | 084824 | N/A |
| Rbp2 | 032454 | 189446 | 140676 |
| Rbp2 | 032454 | 187905 | 140630 |
| Rbp2 | 032454 | 188779 | N/A |
| Rbp2 | 032454 | 035029 | 035029 |
| Rbpjl | 017007 | 137427 | N/A |
| Rbpjl | 017007 | 017151 | 017151 |
| Rbpjl | 017007 | 109356 | N/A |
| Rbpms2 | 032387 | 169003 | 131076 |
| Rbpms2 | 032387 | 055844 | 057600 |
| Rbpms2 | 032387 | 213927 | N/A |
| Rbpms2 | 032387 | 216342 | 149535 |
| Rbpms2 | 032387 | 216382 | 151192 |
| Rbpms2 | 032387 | 216769 | N/A |
| Rcn1 | 005973 | 006128 | 006128 |
| Rcn1 | 005973 | 127019 | N/A |
| Rcn2 | 032320 | 147842 | 120953 |
| Rcn2 | 032320 | 114276 | 109915 |
| Rcn2 | 032320 | 151585 | N/A |
| Rcn2 | 032320 | 144869 | N/A |

TABLE 3-continued

| ENSEMBL IDs for rats | | | |
| --- | --- | --- | --- |
| Symbol | MUSG | MUST | MUSP |
| Reck | 028476 | 030198 | 030198 |
| Reck | 028476 | 128463 | N/A |
| Reck | 028476 | 130415 | N/A |
| Reln | 042453 | 161356 | 124052 |
| Reln | 042453 | 160791 | N/A |
| Reln | 042453 | 062372 | 058025 |
| Reln | 042453 | 200318 | N/A |
| Reln | 042453 | 200667 | N/A |
| Reln | 042453 | 199034 | N/A |
| Reln | 042453 | 159768 | N/A |
| Reln | 042453 | 161353 | N/A |
| Reln | 042453 | 162427 | N/A |
| Reln | 042453 | 159741 | N/A |
| Reln | 042453 | 162876 | 124077 |
| Reln | 042453 | 162637 | N/A |
| Reln | 042453 | 162622 | N/A |
| Reln | 042453 | 160707 | N/A |
| Reln | 042453 | 161782 | N/A |
| Rep15 | 040121 | 036194 | 037503 |
| Rerg | 030222 | 032347 | 032347 |
| Rerg | 030222 | 117919 | 113105 |
| Rerg | 030222 | 119610 | 113702 |
| Rerg | 030222 | 203003 | 144823 |
| Rerg | 030222 | 149100 | 144902 |
| Ret | 030110 | 032201 | 032201 |
| Ret | 030110 | 088790 | 086169 |
| Rftn1 | 039316 | 044503 | 046524 |
| Rftn1 | 039316 | 113195 | 108820 |
| Rftn1 | 039316 | 156094 | N/A |
| Rfx4 | 020037 | 060397 | 051107 |
| Rfx4 | 020037 | 173479 | N/A |
| Rfx4 | 020037 | 165868 | N/A |
| Rfx4 | 020037 | 166696 | 128690 |
| Rfx4 | 020037 | 020226 | N/A |
| Rfx4 | 020037 | 095388 | 093035 |
| Rgcc | 022018 | 022595 | 022595 |
| Rgma | 070509 | 119206 | 112599 |
| Rgma | 070509 | 094312 | 091870 |
| Rgma | 070509 | 128471 | 116552 |
| Rgma | 070509 | 139780 | 145758 |
| Rgma | 070509 | 206253 | N/A |
| Rgs6 | 021219 | 201602 | 144044 |
| Rgs6 | 021219 | 186848 | 141044 |
| Rgs6 | 021219 | 161801 | 125256 |
| Rgs6 | 021219 | 185665 | 139566 |
| Rgs6 | 021219 | 200911 | 143801 |
| Rgs6 | 021219 | 202210 | 143961 |
| Rgs6 | 021219 | 186458 | 139735 |
| Rgs6 | 021219 | 186081 | 140188 |
| Rgs6 | 021219 | 201271 | 144139 |
| Rgs6 | 021219 | 200861 | 144118 |
| Rgs6 | 021219 | 186309 | 140701 |
| Rgs6 | 021219 | 201861 | 144395 |
| Rgs6 | 021219 | 193448 | N/A |
| Rgs6 | 021219 | 191311 | 140723 |
| Rgs6 | 021219 | 191352 | 139718 |
| Rgs6 | 021219 | 191107 | 139725 |
| Rgs6 | 021219 | 186323 | 141079 |
| Rgs6 | 021219 | 185674 | 139940 |
| Rgs6 | 021219 | 190964 | N/A |
| Rgs6 | 021219 | 201767 | 143829 |
| Rgs6 | 021219 | 201512 | N/A |
| Rgs6 | 021219 | 101234 | 098793 |
| Rgs7bp | 021719 | 063551 | 066614 |
| Rgs9 | 020599 | 020920 | 020920 |
| Rgs9 | 020599 | 103062 | 099351 |
| Rgs9 | 020599 | 106706 | 102317 |
| Rgs9 | 020599 | 156785 | N/A |
| Rgs9 | 020599 | 106704 | 102315 |
| Rhpn2 | 030494 | 032705 | 032705 |
| Rhpn2 | 030494 | 155140 | N/A |
| Rhpn2 | 030494 | 187997 | N/A |
| Rhpn2 | 030494 | 085556 | 082692 |
| Rimbp2 | 029420 | 199537 | 143276 |
| Rimbp2 | 029420 | 198941 | 142455 |
| Rimbp2 | 029420 | 196085 | 143725 |

TABLE 3-continued

| ENSEMBL IDs for rats | | | |
|---|---|---|---|
| Symbol | MUSG | MUST | MUSP |
| Rimbp2 | 029420 | 200470 | 143099 |
| Rimbp2 | 029420 | 199737 | 142712 |
| Rimbp2 | 029420 | 196569 | N/A |
| Rimbp2 | 029420 | 111346 | 106978 |
| Rims1 | 041670 | 185942 | 140963 |
| Rims1 | 041670 | 097808 | 095417 |
| Rims1 | 041670 | 081544 | 080259 |
| Rims1 | 041670 | 115273 | 110928 |
| Rims1 | 041670 | 218140 | 151404 |
| Rims1 | 041670 | 097811 | 095420 |
| Rims1 | 041670 | 097810 | 095419 |
| Rims1 | 041670 | 097809 | 095418 |
| Rims1 | 041670 | 164877 | 131808 |
| Rims3 | 032890 | 132895 | N/A |
| Rims3 | 032890 | 071093 | 068178 |
| Rims3 | 032890 | 106283 | 101890 |
| Rims3 | 032890 | 171363 | 130295 |
| Rims4 | 035226 | 044734 | 045637 |
| Rin2 | 001768 | 147976 | 124206 |
| Rin2 | 001768 | 110005 | 105632 |
| Rin2 | 001768 | 142847 | 125476 |
| Rin2 | 001768 | 150449 | 124078 |
| Rin2 | 001768 | 145874 | N/A |
| Rin2 | 001768 | 149269 | N/A |
| Rin2 | 001768 | 144278 | N/A |
| Rin2 | 001768 | 094480 | 092053 |
| Rit2 | 057455 | 153060 | 114323 |
| Rit2 | 057455 | 139924 | 122938 |
| Rit2 | 057455 | 082070 | 080724 |
| Rit2 | 057455 | 153196 | N/A |
| Rlbp1 | 039194 | 179243 | 137143 |
| Rlbp1 | 039194 | 053718 | 054545 |
| Rlbp1 | 039194 | 206624 | N/A |
| Rlbp1 | 039194 | 206162 | 146196 |
| Rlbp1 | 039194 | 206320 | 145611 |
| Rlbp1 | 039194 | 205442 | 145850 |
| Rlbp1 | 039194 | 205638 | 146144 |
| Rlbp1 | 039194 | 206695 | 146075 |
| Rnf112 | 010086 | 060255 | 059903 |
| Rnf112 | 010086 | 054927 | 056464 |
| Rnf112 | 010086 | 102661 | 099722 |
| Rnf112 | 010086 | 152137 | N/A |
| Rnf112 | 010086 | 126859 | N/A |
| Rnf112 | 010086 | 136966 | N/A |
| Rnf112 | 010086 | 130648 | N/A |
| Rnf207 | 058498 | 076183 | 075540 |
| Rnf207 | 058498 | 108688 | N/A |
| Rnf207 | 058498 | 170820 | 129400 |
| Rnf207 | 058498 | 135837 | N/A |
| Rnf207 | 058498 | 127565 | N/A |
| Rnf207 | 058498 | 142427 | N/A |
| Rnf207 | 058498 | 130008 | 127196 |
| Rnf207 | 058498 | 143968 | N/A |
| Rnf207 | 058498 | 134269 | N/A |
| Rnf207 | 058498 | 145311 | N/A |
| Rnf207 | 058498 | 123133 | N/A |
| Rnf207 | 058498 | 146496 | N/A |
| Rnf217 | 063760 | 081989 | 080650 |
| Rnf220 | 028677 | 030439 | 030439 |
| Rnf220 | 028677 | 102690 | 099751 |
| Rnf220 | 028677 | 221654 | 152367 |
| Rnf220 | 028677 | 094853 | 092449 |
| Rnf220 | 028677 | 128122 | N/A |
| Rnf220 | 028677 | 223371 | N/A |
| Rnf220 | 028677 | 221157 | N/A |
| Rnf220 | 028677 | 151829 | 152638 |
| Rnf220 | 028677 | 223182 | N/A |
| Rnf220 | 028677 | 154974 | N/A |
| Rnf220 | 028677 | 133971 | N/A |
| Rnf220 | 028677 | 150148 | N/A |
| Rnf220 | 028677 | 138435 | N/A |
| Rnf220 | 028677 | 123222 | N/A |
| Rnf43 | 034177 | 134684 | N/A |
| Rnf43 | 034177 | 123658 | N/A |
| Rnf43 | 034177 | 092800 | 090476 |
| Rnf43 | 034177 | 121782 | 112748 |

TABLE 3-continued

| ENSEMBL IDs for rats | | | |
|---|---|---|---|
| Symbol | MUSG | MUST | MUSP |
| Rnf43 | 034177 | 040089 | 044241 |
| Rnf43 | 034177 | 162740 | N/A |
| Rnf43 | 034177 | 124625 | N/A |
| Rnf43 | 034177 | 150866 | N/A |
| Rnf43 | 034177 | 165679 | 130685 |
| Robo2 | 052516 | 226478 | 154353 |
| Robo2 | 052516 | 117785 | 112776 |
| Robo2 | 052516 | 117200 | 113795 |
| Robo2 | 052516 | 149114 | N/A |
| Robo2 | 052516 | 137420 | N/A |
| Robo2 | 052516 | 116586 | 112285 |
| Robo2 | 052516 | 138852 | N/A |
| Robo2 | 052516 | 227347 | 154010 |
| Robo2 | 052516 | 147408 | N/A |
| Robo2 | 052516 | 140062 | N/A |
| Robo2 | 052516 | 156010 | N/A |
| Robo3 | 032128 | 167089 | N/A |
| Robo3 | 032128 | 171467 | N/A |
| Robo3 | 032128 | 034643 | 034643 |
| Robo3 | 032128 | 115038 | 110690 |
| Robo3 | 032128 | 170512 | 150639 |
| Robo3 | 032128 | 167216 | N/A |
| Rpa1 | 000751 | 092907 | 090585 |
| Rpa1 | 000751 | 000767 | 000767 |
| Rpa1 | 000751 | 149365 | N/A |
| Rpa1 | 000751 | 154894 | N/A |
| Rpa1 | 000751 | 135770 | N/A |
| Rph3a | 029608 | 079204 | 078198 |
| Rph3a | 029608 | 202406 | 143917 |
| Rph3a | 029608 | 202326 | 144291 |
| Rph3a | 029608 | 200792 | 144437 |
| Rprm | 075334 | 100089 | 097667 |
| Rps6ka1 | 003644 | 105894 | 101514 |
| Rps6ka1 | 003644 | 168974 | 126774 |
| Rps6ka1 | 003644 | 003741 | 003741 |
| Rps6ka1 | 003644 | 157067 | 121341 |
| Rps6ka1 | 003644 | 174481 | 134507 |
| Rps6ka1 | 003644 | 137486 | 119328 |
| Rps6ka1 | 003644 | 173989 | N/A |
| Rps6ka1 | 003644 | 129636 | N/A |
| Rps6ka1 | 003644 | 173961 | N/A |
| Rpusd3 | 051169 | 113092 | 108715 |
| Rpusd3 | 051169 | 060634 | 059057 |
| Rpusd3 | 051169 | 203758 | N/A |
| Rpusd3 | 051169 | 129047 | 120380 |
| Rpusd3 | 051169 | 147726 | 120250 |
| Rpusd3 | 051169 | 124078 | N/A |
| Rpusd3 | 051169 | 151618 | 115950 |
| Rpusd3 | 051169 | 134853 | N/A |
| Rpusd3 | 051169 | 129560 | 114511 |
| Rpusd3 | 051169 | 150452 | N/A |
| Rspo2 | 051920 | 226810 | 154600 |
| Rspo2 | 051920 | 063492 | 067325 |
| Rspo2 | 051920 | 226402 | N/A |
| Rtn1 | 021087 | 150156 | N/A |
| Rtn1 | 021087 | 078505 | 077594 |
| Rtn1 | 021087 | 137990 | 120033 |
| Rtn1 | 021087 | 144181 | N/A |
| Rtn1 | 021087 | 221756 | N/A |
| Rtn1 | 021087 | 021497 | 021497 |
| Rtn1 | 021087 | 150156 | N/A |
| Rtn1 | 021087 | 078505 | 077594 |
| Rtn1 | 021087 | 137990 | 120033 |
| Rtn1 | 021087 | 144181 | N/A |
| Rtn1 | 021087 | 221756 | N/A |
| Rtn1 | 021087 | 021497 | 021497 |
| Rtn4r | 043811 | 059589 | 062924 |
| Rtn4r | 111113 | 213627 | 149817 |
| Rtn4rl1 | 045287 | 102514 | 099572 |
| Rtn4rl2 | 050896 | 151799 | 118362 |
| Rtn4rl2 | 050896 | 151759 | N/A |
| Rtn4rl2 | 050896 | 054514 | 057725 |
| Rubcnl | 034959 | 036072 | 045566 |
| Rubcnl | 034959 | 228689 | N/A |
| Rxfp1 | 034009 | 078527 | 077611 |
| Rxfp1 | 034009 | 182491 | 138578 |

TABLE 3-continued

| | ENSEMBL IDs for rats | | |
|---|---|---|---|
| Symbol | MUSG | MUST | MUSP |
| Rxfp1 | 034009 | 183199 | N/A |
| Rxfp1 | 034009 | 183040 | N/A |
| Ryr1 | 030592 | 214374 | 149042 |
| Ryr1 | 030592 | 179893 | 137123 |
| Ryr1 | 030592 | 208318 | N/A |
| Ryr1 | 030592 | 208010 | N/A |
| Ryr1 | 030592 | 207764 | N/A |
| Ryr1 | 030592 | 207783 | N/A |
| Ryr1 | 030592 | 208922 | N/A |
| Ryr1 | 030592 | 032813 | 032813 |
| Ryr2 | 021313 | 021750 | 021750 |
| Ryr2 | 021313 | 222113 | N/A |
| Ryr2 | 021313 | 222788 | N/A |
| Ryr2 | 021313 | 221527 | 152510 |
| Ryr2 | 021313 | 221916 | N/A |
| Ryr2 | 021313 | 220712 | 152669 |
| Ryr2 | 021313 | 221941 | N/A |
| Ryr2 | 021313 | 221890 | N/A |
| Ryr2 | 021313 | 221609 | N/A |
| Ryr2 | 021313 | 222386 | N/A |
| Ryr2 | 021313 | 220597 | 152051 |
| Ryr2 | 021313 | 221018 | N/A |
| Ryr2 | 021313 | 221341 | N/A |
| Ryr2 | 021313 | 170156 | 127991 |
| Ryr3 | 057378 | 091818 | 089426 |
| Ryr3 | 057378 | 208135 | 146719 |
| Ryr3 | 057378 | 128192 | N/A |
| Ryr3 | 057378 | 207603 | N/A |
| Ryr3 | 057378 | 156757 | N/A |
| Ryr3 | 057378 | 146187 | N/A |
| Ryr3 | 057378 | 208574 | N/A |
| Ryr3 | 057378 | 134358 | 147196 |
| Ryr3 | 057378 | 142537 | N/A |
| Ryr3 | 057378 | 080673 | 079503 |
| Ryr3 | 057378 | 208290 | 147250 |
| Ryr3 | 057378 | 208151 | 146449 |
| S100a4 | 001020 | 001046 | 001046 |
| S100a4 | 001020 | 142476 | 143522 |
| S100b | 033208 | 036387 | 047968 |
| S1pr1 | 045092 | 055676 | 050897 |
| Sall1 | 031665 | 034090 | 034090 |
| Samd12 | 058656 | 078673 | 077741 |
| Samd12 | 058656 | 154119 | N/A |
| Samd12 | 058656 | 132059 | 123446 |
| Samd12 | 058656 | 132362 | N/A |
| Sapcd2 | 026955 | 114293 | 109932 |
| Sapcd2 | 026955 | 100323 | 097898 |
| Sapcd2 | 026955 | 155310 | N/A |
| Sapcd2 | 026955 | 129214 | N/A |
| Sapcd2 | 026955 | 137171 | N/A |
| Sapcd2 | 026955 | 132539 | N/A |
| Sapcd2 | 026955 | 028329 | 028329 |
| Scamp5 | 040722 | 046587 | 035898 |
| Scamp5 | 040722 | 215208 | N/A |
| Scamp5 | 040722 | 214256 | 150867 |
| Scamp5 | 040722 | 215734 | 151197 |
| Scamp5 | 040722 | 213771 | 149622 |
| Scamp5 | 040722 | 215059 | 150248 |
| Scel | 022123 | 227322 | 154402 |
| Scel | 022123 | 095576 | 093233 |
| Scg3 | 032181 | 034699 | 034699 |
| Scg3 | 032181 | 213324 | 149561 |
| Scg3 | 032181 | 215603 | 152480 |
| Scg3 | 032181 | 213637 | N/A |
| Scg3 | 032181 | 214244 | 151074 |
| Scg3 | 032181 | 214176 | N/A |
| Scg3 | 032181 | 215722 | N/A |
| Scn1a | 064329 | 200839 | 144214 |
| Scn1a | 064329 | 112366 | 107985 |
| Scn1a | 064329 | 077489 | 076697 |
| Scn1a | 064329 | 094951 | 092558 |
| Scn1a | 064329 | 156865 | 144633 |
| Scn1a | 064329 | 138910 | 116881 |
| Scn1a | 064329 | 129508 | N/A |
| Scn1a | 064329 | 112371 | 107990 |
| Scn2a | 075318 | 144254 | 117955 |

TABLE 3-continued

| | ENSEMBL IDs for rats | | |
|---|---|---|---|
| Symbol | MUSG | MUST | MUSP |
| Scn2a | 075318 | 028377 | 028377 |
| Scn2a | 075318 | 201378 | N/A |
| Scn2a | 075318 | 202653 | N/A |
| Scn2a | 075318 | 200829 | 143882 |
| Scn2a | 075318 | 138368 | N/A |
| Scn2a | 075318 | 202508 | 143958 |
| Scn2a | 075318 | 202162 | 143888 |
| Scn2a | 075318 | 100067 | 097645 |
| Scn2b | 070304 | 093855 | 091377 |
| Scn2b | 070304 | 170998 | 126826 |
| Scn4b | 046480 | 060125 | 062507 |
| Scn9a | 075316 | 100064 | 097642 |
| Scn9a | 075316 | 112354 | 107973 |
| Scn9a | 075316 | 151234 | N/A |
| Scn9a | 075316 | 141603 | N/A |
| Scn9a | 075316 | 164384 | 126528 |
| Scn9a | 075316 | 100063 | 097641 |
| Scn9a | 075316 | 169900 | 131711 |
| Scnn1g | 000216 | 000221 | 000221 |
| Scube1 | 016763 | 144773 | N/A |
| Scube1 | 016763 | 043634 | 044835 |
| Scube1 | 016763 | 076060 | 075434 |
| Scube1 | 016763 | 016907 | 016907 |
| Scube1 | 016763 | 171496 | 130131 |
| Sdc3 | 025743 | 070478 | 065877 |
| Sdc3 | 025743 | 146093 | N/A |
| Sdc3 | 025743 | 152591 | 118685 |
| Sdc3 | 025743 | 141297 | 123608 |
| Sdc3 | 025743 | 140623 | N/A |
| Sdc4 | 017009 | 017153 | 017153 |
| Sdc4 | 017009 | 142909 | N/A |
| Sec14l5 | 091712 | 165810 | 128063 |
| Sec24d | 039234 | 047923 | 035823 |
| Sec24d | 039234 | 198210 | N/A |
| Sec24d | 039234 | 200333 | 143588 |
| Sec24d | 039234 | 197291 | N/A |
| Sec24d | 039234 | 196167 | N/A |
| Sec24d | 039234 | 196631 | N/A |
| Sec24d | 039234 | 200309 | N/A |
| Sec24d | 039234 | 196482 | N/A |
| Sel1l3 | 029189 | 031090 | 031090 |
| Sel1l3 | 029189 | 196435 | N/A |
| Sel1l3 | 029189 | 196516 | N/A |
| Sel1l3 | 029189 | 196550 | N/A |
| Sel1l3 | 029189 | 199919 | N/A |
| Sema3c | 028780 | 030568 | 030568 |
| Sema3c | 028780 | 170181 | 126614 |
| Sema3c | 028780 | 170348 | N/A |
| Sema3c | 028780 | 169603 | 132330 |
| Sema3c | 028780 | 115271 | N/A |
| Sema3d | 040254 | 030868 | 030868 |
| Sema3d | 040254 | 196618 | N/A |
| Sema3d | 040254 | 197927 | 142453 |
| Sema3d | 040254 | 196093 | N/A |
| Sema3d | 040254 | 195923 | N/A |
| Sema4d | 021451 | 110040 | 105667 |
| Sema4d | 021451 | 021900 | 021900 |
| Sema4d | 021451 | 110039 | 105666 |
| Sema4d | 021451 | 125511 | N/A |
| Sema4d | 021451 | 138228 | N/A |
| Sema4d | 021451 | 139865 | N/A |
| Sema4d | 021451 | 150662 | N/A |
| Sema4d | 021451 | 139018 | N/A |
| Sema4d | 021451 | 146238 | N/A |
| Sema4d | 021451 | 146922 | N/A |
| Sema4d | 021451 | 143396 | N/A |
| Sema4d | 021451 | 139858 | N/A |
| Sema4d | 021451 | 155896 | N/A |
| Sema5a | 022231 | 226876 | N/A |
| Sema5a | 022231 | 067458 | 069024 |
| Sema5a | 022231 | 228442 | N/A |
| Sema5a | 022231 | 228103 | N/A |
| Sema5a | 022231 | 228555 | N/A |
| Sema5a | 022231 | 228015 | N/A |
| Sema5a | 022231 | 227802 | N/A |
| Sema5a | 022231 | 227976 | N/A |

TABLE 3-continued

| | ENSEMBL IDs for rats | | |
| --- | --- | --- | --- |
| Symbol | MUSG | MUST | MUSP |
| Sema5a | 022231 | 227429 | N/A |
| Sema6a | 019647 | 019791 | 019791 |
| Sema6a | 019647 | 076043 | 075420 |
| Sema6a | 019647 | 135790 | 120011 |
| Sema6a | 019647 | 141224 | N/A |
| Sema6a | 019647 | 151382 | N/A |
| Sema6a | 019647 | 156422 | 121442 |
| Sema6a | 019647 | 126684 | 118655 |
| Sema6a | 019647 | 144223 | N/A |
| Sema6a | 019647 | 123228 | 120249 |
| Sema6a | 019647 | 115449 | 111109 |
| Sema6d | 027200 | 103241 | 099531 |
| Sema6d | 027200 | 137172 | N/A |
| Sema6d | 027200 | 151199 | N/A |
| Sema6d | 027200 | 103240 | 099530 |
| Sema6d | 027200 | 132088 | N/A |
| Sema6d | 027200 | 051419 | 061123 |
| Sema6d | 027200 | 103238 | 099528 |
| Sema6d | 027200 | 103239 | 099529 |
| Sema6d | 027200 | 076335 | 075674 |
| Sema6d | 027200 | 078621 | 077691 |
| Sema6d | 027200 | 077847 | 077014 |
| Sept4 | 020486 | 122945 | 115682 |
| Sept4 | 020486 | 107962 | 103596 |
| Sept4 | 020486 | 140398 | N/A |
| Sept4 | 020486 | 122067 | 112960 |
| Sept4 | 020486 | 132723 | N/A |
| Sept4 | 020486 | 123081 | N/A |
| Sept4 | 020486 | 133638 | N/A |
| Sept4 | 020486 | 135175 | N/A |
| Sept4 | 020486 | 107961 | 103595 |
| Sept4 | 020486 | 018544 | 018544 |
| Sept4 | 020486 | 063156 | 060127 |
| Sept4 | 020486 | 107960 | 103594 |
| Sept4 | 020486 | 136229 | N/A |
| Sept4 | 020486 | 134923 | N/A |
| Sept4 | 020486 | 133202 | 115790 |
| Sept4 | 020486 | 148216 | N/A |
| Sept4 | 020486 | 127414 | N/A |
| Sept4 | 020486 | 143950 | N/A |
| Sept7 | 001833 | 165594 | 127641 |
| Sept7 | 001833 | 215692 | N/A |
| Sept7 | 001833 | 215721 | N/A |
| Sept7 | 001833 | 213980 | N/A |
| Sept7 | 001833 | 217598 | N/A |
| Sept7 | 001833 | 214911 | N/A |
| Sept7 | 001833 | 214520 | N/A |
| Sept7 | 001833 | 213435 | N/A |
| Sept7 | 001833 | 214360 | N/A |
| Sept7 | 001833 | 115272 | 110927 |
| Serinc2 | 023232 | 122374 | 112535 |
| Serinc2 | 023232 | 105996 | 101618 |
| Serinc2 | 023232 | 120126 | 113044 |
| Serinc2 | 023232 | 146478 | 115198 |
| Serinc2 | 023232 | 154846 | 116586 |
| Serpinb1a | 044734 | 076352 | 075690 |
| Serpinb1a | 044734 | 223016 | N/A |
| Serpinb1a | 044734 | 091668 | 089257 |
| Serpinb1a | 044734 | 221967 | N/A |
| Serpine2 | 026249 | 027467 | 027467 |
| Serpine2 | 026249 | 189793 | 140065 |
| Serpine2 | 026249 | 190724 | 140255 |
| Serpine2 | 026249 | 153862 | N/A |
| Serpine2 | 026249 | 191529 | N/A |
| Serpine2 | 026249 | 191026 | N/A |
| Serpinh1 | 070436 | 169437 | 126390 |
| Serpinh1 | 070436 | 094154 | 091706 |
| Serpinh1 | 070436 | 208119 | 146969 |
| Serpinh1 | 070436 | 207849 | 147064 |
| Serpinh1 | 070436 | 208749 | 146515 |
| Serpinh1 | 070436 | 207989 | 146444 |
| Serpinh1 | 070436 | 208292 | 146373 |
| Serpini1 | 027834 | 161776 | 123845 |
| Serpini1 | 027834 | 029423 | 029423 |
| Serpini1 | 027834 | 195285 | N/A |
| Serpini1 | 027834 | 161695 | N/A |

TABLE 3-continued

| | ENSEMBL IDs for rats | | |
| --- | --- | --- | --- |
| Symbol | MUSG | MUST | MUSP |
| Serpini2 | 034139 | 039047 | 046943 |
| Sertm1 | 056306 | 162201 | 124102 |
| Sertm1 | 056306 | 070342 | 064870 |
| Sestd1 | 042272 | 102660 | 099721 |
| Sestd1 | 042272 | 102659 | 099720 |
| Sestd1 | 042272 | 145366 | N/A |
| Sestd1 | 042272 | 139021 | N/A |
| Setbp1 | 024548 | 025430 | 025430 |
| Sez6l2 | 030683 | 106335 | 101942 |
| Sez6l2 | 030683 | 146017 | 115905 |
| Sez6l2 | 030683 | 106333 | 101940 |
| Sez6l2 | 030683 | 106332 | 101939 |
| Sez6l2 | 030683 | 125669 | 145667 |
| Sez6l2 | 030683 | 134471 | N/A |
| Sez6l2 | 030683 | 155138 | 146086 |
| Sgcd | 020354 | 154578 | N/A |
| Sgcd | 020354 | 077221 | 076459 |
| Sgcd | 020354 | 109220 | 104843 |
| Sgcd | 020354 | 128558 | N/A |
| Sgms2 | 050931 | 090246 | 087713 |
| Sgms2 | 050931 | 126569 | 114192 |
| Sgms2 | 050931 | 197057 | 143170 |
| Sgms2 | 050931 | 200431 | N/A |
| Sh2d1a | 005696 | 129855 | N/A |
| Sh2d1a | 005696 | 189753 | 141070 |
| Sh2d1a | 005696 | 005839 | 005839 |
| Sh2d1a | 005696 | 115070 | 110722 |
| Sh2d1a | 005696 | 153948 | 138624 |
| Sh2d1a | 005696 | 128393 | N/A |
| Sh2d1a | 005696 | 101619 | N/A |
| Sh2d4b | 037833 | 070328 | 064708 |
| Sh2d4b | 037833 | 096000 | 093699 |
| Sh2d4b | 037833 | 225854 | N/A |
| Sh3bgrl2 | 032261 | 188241 | 140951 |
| Sh3bgrl2 | 032261 | 113215 | 108841 |
| Sh3bgrl2 | 032261 | 188617 | N/A |
| Sh3bgrl2 | 032261 | 188030 | 140348 |
| Sh3bgrl2 | 032261 | 185664 | N/A |
| Sh3bp4 | 036206 | 066279 | 067581 |
| Sh3bp4 | 036206 | 123745 | N/A |
| Sh3d19 | 028082 | 182969 | N/A |
| Sh3d19 | 028082 | 182723 | N/A |
| Sh3d19 | 028082 | 183119 | N/A |
| Sh3d19 | 028082 | 182399 | N/A |
| Sh3d19 | 028082 | 182666 | 138320 |
| Sh3d19 | 028082 | 183202 | N/A |
| Sh3d19 | 028082 | 107664 | 103291 |
| Sh3rf1 | 031642 | 034060 | 034060 |
| Sh3rf1 | 031642 | 209611 | 148118 |
| Sh3rf1 | 031642 | 210210 | N/A |
| Sh3rf3 | 037990 | 135526 | 114368 |
| Sh3rf3 | 037990 | 153031 | 120938 |
| Sh3rf3 | 037990 | 133151 | N/A |
| Sh3rf3 | 037990 | 148267 | N/A |
| Sh3rf3 | 037990 | 152924 | N/A |
| Sh3tc2 | 045629 | 051720 | 055094 |
| Shank1 | 038738 | 107938 | 103571 |
| Shank1 | 038738 | 107935 | 103568 |
| Shank1 | 038738 | 107934 | 103567 |
| Shank1 | 038738 | 134470 | N/A |
| Shank1 | 038738 | 154776 | N/A |
| Shank1 | 038738 | 127164 | N/A |
| Shank3 | 022623 | 109309 | 104932 |
| Shank3 | 022623 | 135214 | N/A |
| Shank3 | 022623 | 066545 | 064477 |
| Shank3 | 022623 | 154240 | N/A |
| Shank3 | 022623 | 123799 | N/A |
| Shank3 | 022623 | 167173 | 132229 |
| Shank3 | 022623 | 039074 | 048062 |
| Shc3 | 021448 | 021898 | 021898 |
| Shc3 | 021448 | 223543 | 152080 |
| Shc3 | 021448 | 221850 | N/A |
| Shc4 | 035109 | 042246 | 043146 |
| Shc4 | 035109 | 110480 | 106106 |
| Shc4 | 035109 | 110477 | 106103 |
| Shc4 | 035109 | 157002 | N/A |

TABLE 3-continued

| ENSEMBL IDs for rats | | | |
| --- | --- | --- | --- |
| Symbol | MUSG | MUST | MUSP |
| Shisa6 | 053930 | 134562 | N/A |
| Shisa6 | 053930 | 123454 | 120862 |
| Shisa6 | 053930 | 066679 | 071025 |
| Shisa7 | 053550 | 117452 | 112405 |
| Shisa7 | 053550 | 119433 | 112423 |
| Shisa7 | 053550 | 157068 | N/A |
| Shisa7 | 053550 | 132806 | N/A |
| Shisa7 | 053550 | 066041 | 064886 |
| Shroom3 | 029381 | 113055 | 108678 |
| Shroom3 | 029381 | 168878 | 130419 |
| Shroom3 | 029381 | 202767 | N/A |
| Shroom3 | 029381 | 113054 | 108677 |
| Shroom3 | 029381 | 172849 | N/A |
| Shroom3 | 029381 | 225438 | 153516 |
| Shroom3 | 029381 | 113051 | 108674 |
| Shroom3 | 029381 | 172706 | 133690 |
| Shroom3 | 029381 | 201800 | N/A |
| Shroom3 | 029381 | 200869 | N/A |
| Shroom3 | 029381 | 172752 | N/A |
| Shroom4 | 068270 | 103005 | 100070 |
| Shroom4 | 068270 | 143641 | 131806 |
| Shroom4 | 068270 | 089520 | 086949 |
| Shtn1 | 041362 | 047511 | 041378 |
| Shtn1 | 041362 | 163821 | 126227 |
| Siah3 | 091722 | 164848 | 130827 |
| Sidt1 | 022696 | 127567 | 116201 |
| Sidt1 | 022696 | 136381 | 115372 |
| Sidt1 | 022696 | 047446 | 038433 |
| Sidt1 | 022696 | 127124 | N/A |
| Sidt1 | 022696 | 147032 | 114424 |
| Sidt1 | 022696 | 124651 | N/A |
| Sipa1l1 | 042700 | 220550 | N/A |
| Sipa1l1 | 042700 | 166429 | 131030 |
| Sipa1l1 | 042700 | 220963 | 152681 |
| Sipa1l1 | 042700 | 222312 | N/A |
| Sipa1l1 | 042700 | 222849 | N/A |
| Sipa1l1 | 042700 | 222298 | 152356 |
| Sipa1l1 | 042700 | 222714 | 152212 |
| Sipa1l1 | 042700 | 220766 | N/A |
| Sipa1l1 | 042700 | 221169 | 152485 |
| Sipa1l1 | 042700 | 221327 | N/A |
| Sipa1l1 | 042700 | 053969 | 061014 |
| Sipa1l3 | 030583 | 183330 | 138345 |
| Sipa1l3 | 030583 | 182223 | N/A |
| Sipa1l3 | 030583 | 183096 | 138171 |
| Sipa1l3 | 030583 | 182009 | N/A |
| Sipa1l3 | 030583 | 182780 | 138311 |
| Sipa1l3 | 030583 | 182484 | 138714 |
| Sipa1l3 | 030583 | 182829 | N/A |
| Sipa1l3 | 030583 | 183164 | N/A |
| Sipa1l3 | 030583 | 182911 | N/A |
| Sipa1l3 | 030583 | 183275 | 138381 |
| Sipa1l3 | 030583 | 182529 | N/A |
| Sipa1l3 | 030583 | 182011 | N/A |
| Sipa1l3 | 030583 | 181975 | 138592 |
| Sipa1l3 | 030583 | 182702 | N/A |
| Sipa1l3 | 030583 | 182236 | N/A |
| Sipa1l3 | 030583 | 183081 | N/A |
| Sipa1l3 | 030583 | 183085 | N/A |
| Sipa1l3 | 030583 | 085809 | 082965 |
| Sirpa | 037902 | 127751 | N/A |
| Sirpa | 037902 | 136153 | N/A |
| Sirpa | 037902 | 153491 | 120324 |
| Sirpa | 037902 | 161620 | 124048 |
| Sirpa | 037902 | 136554 | N/A |
| Sirpa | 037902 | 103203 | 099492 |
| Sirpa | 037902 | 103202 | 099491 |
| Sirpa | 037902 | 049262 | 049022 |
| Sirpa | 037902 | 160952 | N/A |
| Sirpa | 037902 | 163034 | 124888 |
| Sirpa | 037902 | 160276 | 125004 |
| Sirpa | 037902 | 162764 | N/A |
| Sirpa | 037902 | 099113 | 096713 |
| Sirpa | 037902 | 179001 | 137611 |
| Skap2 | 059182 | 204778 | 145462 |
| Skap2 | 059182 | 205174 | N/A |

TABLE 3-continued

| ENSEMBL IDs for rats | | | |
| --- | --- | --- | --- |
| Symbol | MUSG | MUST | MUSP |
| Skap2 | 059182 | 078214 | 077342 |
| Skap2 | 059182 | 203948 | 145275 |
| Skap2 | 059182 | 205112 | N/A |
| Skap2 | 059182 | 204178 | N/A |
| Skap2 | 059182 | 203313 | N/A |
| Skor1 | 022215 | 119116 | 113924 |
| Skor1 | 022215 | 116613 | 112312 |
| Skor1 | 022215 | 055281 | 055037 |
| Skor2 | 091519 | 166956 | 132338 |
| Slc12a2 | 021597 | 115366 | 111023 |
| Slc12a8 | 035506 | 121925 | 112439 |
| Slc12a8 | 035506 | 119173 | 113633 |
| Slc12a8 | 035506 | 122311 | 113901 |
| Slc12a8 | 035506 | 122127 | 113164 |
| Slc12a8 | 035506 | 117131 | 112925 |
| Slc12a8 | 035506 | 119291 | N/A |
| Slc12a8 | 035506 | 059056 | 062337 |
| Slc14a1 | 059336 | 091813 | 089421 |
| Slc14a1 | 059336 | 160292 | 125114 |
| Slc14a1 | 059336 | 160639 | 125367 |
| Slc14a2 | 021552 | 025131 | 025434 |
| Slc14a2 | 021552 | 163367 | 126416 |
| Slc16a10 | 019838 | 092566 | 090227 |
| Slc16a10 | 019838 | 213827 | 151126 |
| Slc16a10 | 019838 | 213188 | 150416 |
| Slc16a10 | 019838 | 217252 | N/A |
| Slc17a7 | 070570 | 085371 | 082489 |
| Slc17a7 | 070570 | 209631 | 147661 |
| Slc17a7 | 070570 | 210198 | N/A |
| Slc17a7 | 070570 | 210510 | N/A |
| Slc17a7 | 070570 | 211652 | N/A |
| Slc19a1 | 001136 | 136150 | 121237 |
| Slc19a1 | 001136 | 133059 | 120266 |
| Slc19a1 | 001136 | 114231 | 116784 |
| Slc19a1 | 001136 | 105410 | 101050 |
| Slc19a1 | 001136 | 136925 | 119382 |
| Slc19a1 | 001136 | 130703 | 115658 |
| Slc19a1 | 001136 | 132984 | 116657 |
| Slc19a1 | 001136 | 127249 | N/A |
| Slc19a1 | 001136 | 131031 | 114884 |
| Slc1a1 | 021935 | 161340 | N/A |
| Slc1a1 | 021935 | 025875 | 025875 |
| Slc1a1 | 021935 | 161119 | N/A |
| Slc1a1 | 021935 | 160702 | N/A |
| Slc1a1 | 021935 | 162189 | N/A |
| Slc1a4 | 020112 | 004634 | 004634 |
| Slc1a4 | 020112 | 109594 | 105223 |
| Slc1a6 | 005357 | 005490 | 005490 |
| Slc1a6 | 005357 | 217717 | 151544 |
| Slc20a1 | 027397 | 028880 | 028880 |
| Slc20a1 | 027397 | 140907 | N/A |
| Slc20a1 | 027397 | 144744 | N/A |
| Slc20a1 | 027397 | 141285 | N/A |
| Slc20a1 | 027397 | 148988 | 121074 |
| Slc20a1 | 027397 | 110315 | 105944 |
| Slc20a1 | 027397 | 125714 | N/A |
| Slc20a1 | 027397 | 144025 | N/A |
| Slc22a15 | 033117 | 106928 | 102541 |
| Slc22a15 | 033117 | 190824 | 139518 |
| Slc22a15 | 033117 | 182130 | N/A |
| Slc22a15 | 033117 | 183293 | N/A |
| Slc22a15 | 033117 | 183255 | 138357 |
| Slc22a15 | 033117 | 183098 | N/A |
| Slc22a15 | 033147 | 182040 | N/A |
| Slc22a23 | 038267 | 148390 | 122283 |
| Slc22a23 | 038267 | 040336 | 042742 |
| Slc22a23 | 038267 | 128392 | N/A |
| Slc22a23 | 038267 | 145038 | 122376 |
| Slc22a23 | 038267 | 143353 | N/A |
| Slc22a4 | 020334 | 020586 | 020586 |
| Slc22a4 | 020334 | 146351 | N/A |
| Slc22a4 | 020334 | 154369 | N/A |
| Slc24a3 | 063873 | 153249 | N/A |
| Slc24a3 | 063873 | 131123 | N/A |
| Slc24a3 | 063873 | 110007 | 105634 |
| Slc24a3 | 063873 | 137908 | N/A |

TABLE 3-continued

| ENSEMBL IDs for rats | | | |
|---|---|---|---|
| Symbol | MUSG | MUST | MUSP |
| Slc24a3 | 063873 | 081121 | 079897 |
| Slc24a4 | 041771 | 159329 | 124513 |
| Slc24a4 | 041771 | 079020 | 078030 |
| Slc24a4 | 041771 | 161325 | 125012 |
| Slc25a18 | 004902 | 112682 | 108302 |
| Slc25a33 | 028982 | 105686 | 101311 |
| Slc26a3 | 001225 | 167432 | 130676 |
| Slc26a3 | 001225 | 171616 | 128722 |
| Slc26a3 | 001225 | 110854 | 106478 |
| Slc26a3 | 001225 | 001254 | 001254 |
| Slc26a3 | 001225 | 168209 | N/A |
| Slc26a3 | 001225 | 165816 | N/A |
| Slc26a3 | 001225 | 109275 | N/A |
| Slc27a6 | 024600 | 025500 | 025500 |
| Slc2a10 | 027661 | 029196 | 029196 |
| Slc2a10 | 027661 | 148463 | N/A |
| Slc2a4 | 018566 | 178809 | N/A |
| Slc2a4 | 018566 | 018710 | 018710 |
| Slc2a4 | 018566 | 141837 | 136806 |
| Slc2a4 | 018566 | 152487 | 136504 |
| Slc2a4 | 018566 | 178363 | 136455 |
| Slc2a4 | 018566 | 179298 | 136726 |
| Slc2a4 | 018566 | 142500 | 137463 |
| Slc2a4 | 018566 | 135437 | 137092 |
| Slc30a3 | 029151 | 031037 | 031037 |
| Slc30a3 | 029151 | 202740 | 144566 |
| Slc30a3 | 029151 | 201783 | 144353 |
| Slc30a3 | 029151 | 202731 | 144574 |
| Slc30a3 | 029151 | 200906 | 144098 |
| Slc30a3 | 029151 | 201396 | 144295 |
| Slc31a2 | 066152 | 107468 | 103092 |
| Slc31a2 | 066152 | 084530 | 081578 |
| Slc31a2 | 066152 | 107467 | 103091 |
| Slc32a1 | 037771 | 045738 | 036299 |
| Slc35d1 | 028521 | 150285 | 122124 |
| Slc35d1 | 028521 | 036195 | 037617 |
| Slc35d1 | 028521 | 183432 | 138926 |
| Slc35d1 | 028521 | 094947 | N/A |
| Slc35d1 | 028521 | 154845 | N/A |
| Slc35f1 | 038602 | 105473 | 101113 |
| Slc38a1 | 023169 | 088452 | 085799 |
| Slc38a1 | 023169 | 088454 | 085801 |
| Slc38a1 | 023169 | 100262 | 097833 |
| Slc39a12 | 036949 | 114731 | 110379 |
| Slc39a12 | 036949 | 082290 | 080911 |
| Slc39a12 | 036949 | 133258 | 122795 |
| Slc41a1 | 013275 | 132585 | N/A |
| Slc41a1 | 013275 | 086559 | 083747 |
| Slc41a1 | 013275 | 146360 | N/A |
| Slc43a2 | 038178 | 042561 | 046074 |
| Slc43a2 | 038178 | 108433 | 104071 |
| Slc43a2 | 038178 | 151891 | N/A |
| Slc43a2 | 038178 | 145901 | N/A |
| Slc43a2 | 038178 | 134112 | N/A |
| Slc43a2 | 038178 | 155981 | N/A |
| Slc43a2 | 038178 | 127226 | 117264 |
| Slc43a2 | 038178 | 143035 | 123101 |
| Slc43a2 | 038178 | 149727 | 116255 |
| Slc43a2 | 038178 | 152775 | N/A |
| Slc43a2 | 038178 | 169547 | 126838 |
| Slc44a5 | 028360 | 089948 | 087394 |
| Slc44a5 | 028360 | 128362 | N/A |
| Slc44a5 | 028360 | 144677 | N/A |
| Slc45a1 | 039838 | 037827 | 036774 |
| Slc45a1 | 039838 | 117997 | 112737 |
| Slc45a1 | 039838 | 147706 | N/A |
| Slc4a4 | 060961 | 148750 | 119325 |
| Slc4a4 | 060961 | 135283 | N/A |
| Slc4a4 | 060961 | 113218 | 108844 |
| Slc4a4 | 060961 | 156238 | 121744 |
| Slc4a4 | 060961 | 144713 | 122975 |
| Slc4a4 | 060961 | 130041 | 118413 |
| Slc4a4 | 060961 | 113216 | 108842 |
| Slc4a4 | 060961 | 134303 | 119976 |
| Slc4a7 | 021733 | 057015 | 058313 |
| Slc4a7 | 021733 | 225496 | N/A |

TABLE 3-continued

| ENSEMBL IDs for rats | | | |
|---|---|---|---|
| Symbol | MUSG | MUST | MUSP |
| Slc4a7 | 021733 | 225232 | 153280 |
| Slc4a7 | 021733 | 224197 | N/A |
| Slc4a7 | 021733 | 223981 | 153084 |
| Slc4a7 | 021733 | 223607 | 153180 |
| Slc4a7 | 021733 | 225238 | 152984 |
| Slc4a7 | 021733 | 223761 | 153045 |
| Slc4a7 | 021733 | 225175 | 153166 |
| Slc4a7 | 021733 | 224222 | 153116 |
| Slc4a7 | 021733 | 225630 | 153597 |
| Slc4a7 | 021733 | 225979 | 153690 |
| Slc4a7 | 021733 | 226079 | 153323 |
| Slc4a7 | 021733 | 224952 | 153345 |
| Slc4a7 | 021733 | 223695 | 153648 |
| Slc4a7 | 021733 | 224333 | 153470 |
| Slc4a7 | 021733 | 223740 | 152933 |
| Slc4a7 | 021733 | 224672 | 152950 |
| Slc4a7 | 021733 | 224049 | 153093 |
| Slc4a7 | 021733 | 224752 | 153185 |
| Slc4a7 | 021733 | 225078 | N/A |
| Slc4a7 | 021733 | 223771 | 153532 |
| Slc4a7 | 021733 | 225508 | N/A |
| Slc4a7 | 021733 | 224750 | N/A |
| Slc4a7 | 021733 | 225613 | N/A |
| Slc5a11 | 030769 | 131933 | 121459 |
| Slc5a11 | 030769 | 140721 | N/A |
| Slc5a11 | 030769 | 033035 | 033035 |
| Slc5a11 | 030769 | 131461 | 123027 |
| Slc5a11 | 030769 | 127655 | 117956 |
| Slc5a11 | 030769 | 131209 | 120678 |
| Slc5a11 | 030769 | 206180 | N/A |
| Slc5a11 | 030769 | 167299 | 127977 |
| Slc5a7 | 023945 | 095712 | 093379 |
| Slc6a7 | 052026 | 025520 | 025520 |
| Slc7a1 | 041313 | 048116 | 046714 |
| Slc7a1 | 041313 | 138257 | 117781 |
| Slc7a1 | 041313 | 201860 | N/A |
| Slc7a1 | 041313 | 202457 | 144000 |
| Slc7a1 | 041313 | 138596 | 122914 |
| Slc7a1 | 041313 | 201348 | N/A |
| Slc7a10 | 030495 | 135452 | 127577 |
| Slc7a10 | 030495 | 001854 | 001854 |
| Slc7a10 | 030495 | 131048 | 118331 |
| Slc7a10 | 030495 | 167441 | 129954 |
| Slc7a10 | 030495 | 146959 | 127311 |
| Slc7a11 | 027737 | 194462 | 141988 |
| Slc7a11 | 027737 | 029297 | 029297 |
| Slc7a11 | 027737 | 192564 | N/A |
| Slc7a11 | 027737 | 142932 | N/A |
| Slc7a11 | 027737 | 193838 | N/A |
| Slc7a14 | 069072 | 091259 | 088803 |
| Slc7a14 | 069072 | 108245 | 103880 |
| Slc7a3 | 031297 | 138162 | N/A |
| Slc7a3 | 031297 | 101362 | 098914 |
| Slc7a3 | 031297 | 113710 | 109339 |
| Slc7a3 | 031297 | 126282 | N/A |
| Slc7a3 | 031297 | 144410 | N/A |
| Slc7a3 | 031297 | 151922 | N/A |
| Slc7a3 | 031297 | 073927 | 073582 |
| Slc8a1 | 054640 | 163680 | 126373 |
| Slc8a1 | 054640 | 086538 | 083725 |
| Slc8a1 | 054640 | 163123 | 132809 |
| Slc8a2 | 030376 | 211649 | 147497 |
| Slc8a2 | 030376 | 168693 | 128926 |
| Slc8a3 | 079055 | 085238 | 082334 |
| Slc8a3 | 079055 | 064594 | 063258 |
| Slc8a3 | 079055 | 182208 | 138735 |
| Slc8a3 | 079055 | 182366 | 138803 |
| Slc8a3 | 079055 | 183102 | N/A |
| Slc8b1 | 032754 | 068326 | 064714 |
| Slc8b1 | 032754 | 111890 | 107521 |
| Slc8b1 | 032754 | 076051 | 075428 |
| Slc8b1 | 032754 | 147496 | 120947 |
| Slc8b1 | 032754 | 140329 | 117260 |
| Slc8b1 | 032754 | 111889 | 107520 |
| Slc8b1 | 032754 | 123326 | N/A |
| Slc9a3 | 036123 | 221410 | N/A |

TABLE 3-continued

| ENSEMBL IDs for rats | | | |
|---|---|---|---|
| Symbol | MUSG | MUST | MUSP |
| Slc9a3 | 036123 | 225423 | 153255 |
| Slc9a3 | 036123 | 221703 | 152682 |
| Slc9a3 | 036123 | 036208 | 038142 |
| Slc9a9 | 031129 | 033463 | 033463 |
| Slc9a9 | 031129 | 162870 | N/A |
| Slc9a9 | 031129 | 162329 | N/A |
| Slco4a1 | 038963 | 038259 | 046502 |
| Slco4a1 | 038963 | 139902 | N/A |
| Slco4a1 | 038963 | 038225 | 045023 |
| Slco4a1 | 038963 | 138446 | N/A |
| Slco4a1 | 038963 | 128367 | N/A |
| Slco4c1 | 040693 | 071985 | 071875 |
| Slit3 | 056427 | 069837 | 066857 |
| Slit3 | 056427 | 156571 | N/A |
| Slit3 | 056427 | 153098 | N/A |
| Slit3 | 056427 | 124438 | N/A |
| Slitrk1 | 075478 | 100322 | 097897 |
| Slitrk6 | 045871 | 078386 | 077492 |
| Smad3 | 032402 | 034973 | 034973 |
| Smad3 | 032402 | 154323 | 116790 |
| Smad3 | 032402 | 137065 | N/A |
| Smad3 | 032402 | 133108 | 122217 |
| Smad3 | 032402 | 137713 | 121671 |
| Smad7 | 025880 | 026999 | 026999 |
| Smad7 | 025880 | 174843 | 133544 |
| Smad7 | 025880 | 174411 | 133696 |
| Smad7 | 025880 | 172718 | N/A |
| Smad7 | 025880 | 168918 | 129322 |
| Smpx | 041476 | 038007 | 048522 |
| Smpx | 041476 | 136141 | 119573 |
| Smpx | 041476 | 112520 | 108139 |
| Smpx | 041476 | 147283 | 120412 |
| Smpx | 041476 | 112521 | 108140 |
| Smpx | 041476 | 132805 | N/A |
| Smpx | 041476 | 126418 | N/A |
| Smpx | 041476 | 190091 | 140268 |
| Sned1 | 047793 | 062202 | 050832 |
| Sned1 | 047793 | 172289 | N/A |
| Sned1 | 047793 | 165843 | N/A |
| Sned1 | 047793 | 163688 | 132455 |
| Sned1 | 047793 | 168122 | N/A |
| Sned1 | 047793 | 165883 | N/A |
| Sntb1 | 060429 | 039769 | 041294 |
| Sntb1 | 060429 | 110200 | 105829 |
| Sntb1 | 060429 | 140574 | N/A |
| Snx33 | 032733 | 050916 | 060225 |
| Soat1 | 026600 | 187987 | N/A |
| Soat1 | 026600 | 191379 | N/A |
| Soat1 | 026600 | 187507 | 139431 |
| Soat1 | 026600 | 187073 | N/A |
| Soat1 | 026600 | 188027 | 141074 |
| Soat1 | 026600 | 186420 | N/A |
| Soat1 | 026600 | 189661 | 140721 |
| Soat1 | 026600 | 051396 | 058344 |
| Sobp | 038248 | 040275 | 040072 |
| Sobp | 038248 | 189987 | N/A |
| Socs2 | 020027 | 139210 | 121305 |
| Socs2 | 020027 | 130784 | N/A |
| Socs2 | 020027 | 128854 | N/A |
| Socs2 | 020027 | 155148 | N/A |
| Socs2 | 020027 | 020215 | 020215 |
| Socs2 | 020027 | 134918 | N/A |
| Socs2 | 020027 | 119917 | 113378 |
| Socs2 | 020027 | 135822 | 118720 |
| Socs2 | 020027 | 150432 | 117785 |
| Socs2 | 020027 | 129942 | 117576 |
| Socs2 | 020027 | 128363 | N/A |
| Socs2 | 020027 | 145847 | N/A |
| Socs2 | 020027 | 170690 | 129331 |
| Socs2 | 020027 | 172070 | 131875 |
| Sod3 | 072941 | 101208 | 098768 |
| Sorbs2 | 031626 | 209534 | N/A |
| Sorbs2 | 031626 | 124544 | 147462 |
| Sorbs2 | 031626 | 138049 | 123503 |
| Sorbs2 | 031626 | 132139 | 123250 |
| Sorbs2 | 031626 | 141039 | 117544 |

TABLE 3-continued

| ENSEMBL IDs for rats | | | |
|---|---|---|---|
| Symbol | MUSG | MUST | MUSP |
| Sorbs2 | 031626 | 171337 | 128000 |
| Sorbs2 | 031626 | 067107 | 067641 |
| Sorbs2 | 031626 | 145458 | 116536 |
| Sorbs2 | 031626 | 134321 | 115842 |
| Sorbs2 | 031626 | 135336 | 114286 |
| Sorbs2 | 031626 | 127395 | N/A |
| Sorbs2 | 031626 | 130850 | 123195 |
| Sorbs2 | 031626 | 153798 | 118353 |
| Sorbs2 | 031626 | 210946 | 147573 |
| Sorbs2 | 031626 | 134675 | 118160 |
| Sorbs2 | 031626 | 139869 | 121235 |
| Sorbs2 | 031626 | 133864 | N/A |
| Sorbs2 | 031626 | 211095 | 148072 |
| Sorbs2 | 031626 | 126067 | 118562 |
| Sorbs2 | 031626 | 136119 | N/A |
| Sorbs2 | 031626 | 143820 | 119539 |
| Sorbs2 | 031626 | 149752 | 121073 |
| Sorbs2 | 031626 | 130011 | 121619 |
| Sorbs2 | 031626 | 150102 | 114951 |
| Sorbs2 | 031626 | 139103 | 119380 |
| Sorbs2 | 031626 | 211442 | N/A |
| Sorbs2 | 031626 | 125295 | 116768 |
| Sorbs2 | 031626 | 132767 | N/A |
| Sorbs2 | 031626 | 140088 | 114158 |
| Sorbs2 | 031626 | 155858 | 122820 |
| Sorbs2 | 031626 | 132730 | N/A |
| Sorbs2 | 031626 | 146627 | 120487 |
| Sorbs2 | 031626 | 211721 | N/A |
| Sorbs2 | 031626 | 136344 | N/A |
| Sorbs2 | 031626 | 156549 | N/A |
| Sorbs2 | 031626 | 067065 | 070720 |
| Sorbs3 | 022091 | 227653 | 154195 |
| Sorbs3 | 022091 | 022682 | 022682 |
| Sorbs3 | 022091 | 227259 | 153715 |
| Sorbs3 | 022091 | 227929 | 154773 |
| Sorcs3 | 063434 | 078880 | 077919 |
| Sox10 | 033006 | 040019 | 039466 |
| Sox13 | 070643 | 144386 | 122980 |
| Sox13 | 070643 | 153799 | 119729 |
| Sox13 | 070643 | 145922 | N/A |
| Sox13 | 070643 | 126530 | N/A |
| Sox13 | 070643 | 094551 | 092130 |
| Sox2 | 074637 | 099151 | 096755 |
| Sox6 | 051910 | 206034 | 145919 |
| Sox6 | 051910 | 169129 | 126404 |
| Sox6 | 051910 | 206369 | 145931 |
| Sox6 | 051910 | 205405 | 145732 |
| Sox6 | 051910 | 205980 | N/A |
| Sox6 | 051910 | 206775 | N/A |
| Sox6 | 051910 | 206573 | N/A |
| Sox6 | 051910 | 205479 | 145561 |
| Sox6 | 051910 | 206427 | N/A |
| Sox6 | 051910 | 206123 | 145576 |
| Sox6 | 051910 | 205818 | N/A |
| Sox6 | 051910 | 206912 | N/A |
| Sox6 | 051910 | 072804 | 072583 |
| Sox6 | 051910 | 166877 | 129512 |
| Sox6 | 051910 | 106612 | 102223 |
| Sox6 | 051910 | 166207 | 129027 |
| Sox8 | 024176 | 025003 | 025003 |
| Sox8 | 024176 | 174560 | 133742 |
| Sox9 | 024176 | 173447 | 133403 |
| Sox9 | 000567 | 000579 | 000579 |
| Sp5 | 075304 | 100043 | 097620 |
| Spag5 | 002055 | 045026 | 045286 |
| Spag5 | 002055 | 133579 | N/A |
| Spag5 | 002055 | 146068 | N/A |
| Spag5 | 002055 | 141026 | N/A |
| Spag5 | 002055 | 150016 | N/A |
| Spag5 | 002055 | 149711 | N/A |
| Spag5 | 002055 | 128359 | N/A |
| Spag5 | 002055 | 125477 | N/A |
| Sparc | 018593 | 108858 | 104486 |
| Sparc | 018593 | 018737 | 018737 |
| Sparc | 018593 | 123775 | N/A |
| Sparc | 018593 | 213866 | 149604 |

TABLE 3-continued

ENSEMBL IDs for rats

| Symbol | MUSG | MUST | MUSP |
|---|---|---|---|
| Sparc | 018593 | 216313 | 149918 |
| Sparc | 018593 | 214685 | 151000 |
| Sparc | 018593 | 130642 | N/A |
| Sparc | 018593 | 141530 | 119475 |
| Sparc | 018593 | 125787 | N/A |
| Sparcl1 | 029309 | 031249 | 031249 |
| Sparcl1 | 029309 | 199947 | 143177 |
| Specc1 | 042331 | 201866 | N/A |
| Specc1 | 042331 | 202178 | 144161 |
| Specc1 | 042331 | 136971 | N/A |
| Specc1 | 042331 | 202389 | 144055 |
| Specc1 | 042331 | 202869 | N/A |
| Specc1 | 042331 | 201624 | 144659 |
| Specc1 | 042331 | 049836 | 063102 |
| Specc1 | 042331 | 202905 | 144311 |
| Specc1 | 042331 | 201364 | 143853 |
| Specc1 | 042331 | 092415 | 090071 |
| Specc1 | 042331 | 201015 | 144174 |
| Specc1 | 042331 | 200742 | N/A |
| Specc1 | 042331 | 202744 | 144483 |
| Specc1 | 042331 | 201723 | 144542 |
| Specc1 | 042331 | 202179 | 144300 |
| Specc1 | 042331 | 108709 | 104349 |
| Specc1 | 042331 | 201671 | 144030 |
| Speg | 026207 | 087122 | 084361 |
| Speg | 026207 | 148515 | 116953 |
| Speg | 026207 | 113590 | 109220 |
| Speg | 026207 | 187214 | N/A |
| Speg | 026207 | 125306 | 119969 |
| Speg | 026207 | 146705 | N/A |
| Speg | 026207 | 125118 | N/A |
| Speg | 026207 | 132228 | 121825 |
| Speg | 026207 | 132222 | N/A |
| Speg | 026207 | 137868 | 141009 |
| Speg | 026207 | 113589 | 109219 |
| Speg | 026207 | 113588 | 109218 |
| Speg | 026207 | 113587 | 109217 |
| Speg | 026207 | 122266 | 113646 |
| Speg | 026207 | 143679 | N/A |
| Sphkap | 026163 | 160953 | 124872 |
| Sphkap | 026163 | 159078 | 124384 |
| Sphkap | 026163 | 053075 | N/A |
| Sphkap | 026163 | 160237 | N/A |
| Sphkap | 026163 | 160567 | N/A |
| Spock3 | 054162 | 117377 | 113797 |
| Spock3 | 054162 | 118003 | 113683 |
| Spock3 | 054162 | 138398 | N/A |
| Spock3 | 054162 | 119068 | 112930 |
| Spock3 | 054162 | 141513 | N/A |
| Spock3 | 054162 | 093480 | 091192 |
| Spon1 | 038156 | 046687 | 041157 |
| Spon1 | 038156 | 084696 | 081746 |
| Spp1 | 029304 | 086833 | 084043 |
| Spp1 | 029304 | 031243 | 031243 |
| Spp1 | 029304 | 112748 | 108368 |
| Spp1 | 029304 | 112746 | 108366 |
| Spp1 | 029304 | 145084 | 117338 |
| Spp1 | 029304 | 132457 | 123163 |
| Spp1 | 029304 | 112747 | 108367 |
| Spsb4 | 046997 | 055433 | 057849 |
| Spsb4 | 046997 | 162307 | N/A |
| Spsb4 | 046997 | 159298 | N/A |
| Spsb4 | 046997 | 064445 | N/A |
| Sptb | 021061 | 021458 | 021458 |
| Sptb | 021061 | 170532 | N/A |
| Sptb | 021061 | 166101 | 129782 |
| Sptbn2 | 067889 | 008991 | 008991 |
| Src | 027646 | 109533 | 105159 |
| Src | 027646 | 145715 | N/A |
| Src | 027646 | 029175 | 029175 |
| Src | 027646 | 133900 | N/A |
| Src | 027646 | 129770 | N/A |
| Src | 027646 | 109531 | 105157 |
| Src | 027646 | 109529 | 105155 |
| Src | 027646 | 092576 | 090237 |
| Srgap1 | 020121 | 020322 | 020322 |

TABLE 3-continued

ENSEMBL IDs for rats

| Symbol | MUSG | MUST | MUSP |
|---|---|---|---|
| Srgap1 | 020121 | 161996 | N/A |
| Srgap1 | 020121 | 161156 | 125109 |
| Srgap1 | 020121 | 162710 | N/A |
| Srgap1 | 020121 | 081688 | 080389 |
| Ssh1 | 042121 | 159592 | 124312 |
| Ssh1 | 042121 | 112298 | 107917 |
| Ssh1 | 042121 | 077689 | 076873 |
| Ssh1 | 042121 | 159510 | 125025 |
| Ssh1 | 042121 | 162396 | 125388 |
| Ssh1 | 042121 | 162322 | N/A |
| St18 | 033740 | 140079 | 118322 |
| St18 | 033740 | 131494 | 117789 |
| St18 | 033740 | 043578 | 042056 |
| St18 | 033740 | 139756 | 142063 |
| St18 | 033740 | 131467 | 120134 |
| St18 | 033740 | 150761 | 120298 |
| St18 | 033740 | 151281 | 122055 |
| St18 | 033740 | 139838 | 118129 |
| St18 | 033740 | 132207 | 142317 |
| St18 | 033740 | 142304 | N/A |
| St18 | 033740 | 151015 | N/A |
| St18 | 033740 | 130338 | 141266 |
| St18 | 033740 | 163727 | 131417 |
| St3gal5 | 056091 | 069994 | 070414 |
| St3gal5 | 056091 | 114112 | 109747 |
| St3gal5 | 056091 | 187007 | 146063 |
| St3gal5 | 056091 | 188366 | 145599 |
| St5 | 031024 | 084738 | 081789 |
| St5 | 031024 | 077909 | 077067 |
| St5 | 031024 | 207664 | N/A |
| St5 | 031024 | 208557 | N/A |
| St5 | 031024 | 207745 | 146934 |
| St5 | 031024 | 208981 | N/A |
| St5 | 031024 | 208583 | 146747 |
| St5 | 031024 | 207394 | 146549 |
| St5 | 031024 | 208734 | 146829 |
| St5 | 031024 | 079282 | 078264 |
| St5 | 031024 | 168005 | 130119 |
| St6galnac3 | 052544 | 200397 | 143747 |
| St6galnac3 | 052544 | 199707 | 143030 |
| St6galnac3 | 052544 | 064460 | 068598 |
| St6galnac3 | 052544 | 200576 | N/A |
| St6galnac3 | 052544 | 198775 | N/A |
| Stac | 032502 | 161995 | 125182 |
| Stac | 032502 | 035083 | 035083 |
| Stac | 032502 | 162345 | N/A |
| Stac2 | 017400 | 017544 | 017544 |
| Stac2 | 017400 | 131519 | 118164 |
| Stag3 | 036928 | 160729 | 124170 |
| Stag3 | 036928 | 161113 | N/A |
| Stag3 | 036928 | 159483 | N/A |
| Stag3 | 036928 | 048028 | 040945 |
| Stag3 | 036928 | 162245 | 125523 |
| Stag3 | 036928 | 161691 | 125290 |
| Stag3 | 036928 | 161615 | N/A |
| Stag3 | 036928 | 160849 | 125376 |
| Stag3 | 036928 | 159189 | 124959 |
| Stambpl1 | 024776 | 054956 | 059927 |
| Stambpl1 | 024776 | 125232 | N/A |
| Stambpl1 | 024776 | 119603 | 112938 |
| Stambpl1 | 024776 | 129535 | 115333 |
| Stambpl1 | 024776 | 130756 | N/A |
| Stard13 | 016128 | 110483 | 106109 |
| Stard13 | 016128 | 062015 | 053232 |
| Stard13 | 016128 | 202111 | 144056 |
| Stard13 | 016128 | 201680 | N/A |
| Stard13 | 016128 | 202385 | N/A |
| Stard13 | 016128 | 129088 | 116705 |
| Stard13 | 016128 | 141117 | N/A |
| Stard13 | 016128 | 146814 | N/A |
| Stard13 | 016128 | 126770 | 122468 |
| Stard13 | 016128 | 202866 | N/A |
| Stard8 | 031216 | 036606 | 044491 |
| Stard8 | 031216 | 149999 | 114897 |
| Stard8 | 031216 | 145820 | N/A |
| Stard8 | 031216 | 127361 | N/A |

TABLE 3-continued

| ENSEMBL IDs for rats | | | |
|---|---|---|---|
| Symbol | MUSG | MUST | MUSP |
| Stat2 | 040033 | 218863 | N/A |
| Stat2 | 040033 | 085708 | 082855 |
| Stat2 | 040033 | 217852 | N/A |
| Stat2 | 040033 | 220142 | N/A |
| Stat2 | 040033 | 217727 | N/A |
| Stat2 | 040033 | 218862 | N/A |
| Stat2 | 040033 | 220277 | N/A |
| Stat2 | 040033 | 105238 | 100872 |
| Stc2 | 020303 | 020546 | 020546 |
| Stc2 | 020303 | 152094 | N/A |
| Stc2 | 020303 | 134199 | N/A |
| Stc2 | 020303 | 139991 | N/A |
| Stc2 | 020303 | 149467 | N/A |
| Stk17b | 026094 | 027263 | 027263 |
| Stk17b | 026094 | 187066 | N/A |
| Stk17b | 026094 | 185920 | 139880 |
| Stk3 | 022329 | 018476 | 018476 |
| Stk3 | 022329 | 226555 | 154154 |
| Stk3 | 022329 | 067033 | 061225 |
| Stk3 | 022329 | 226730 | N/A |
| Stk3 | 022329 | 128425 | N/A |
| Stk3 | 022329 | 138841 | 116310 |
| Stk32a | 039954 | 045477 | 038471 |
| Stmn4 | 022044 | 152093 | 117000 |
| Stmn4 | 022044 | 074523 | 074113 |
| Stmn4 | 022044 | 136192 | N/A |
| Stmn4 | 022044 | 123435 | N/A |
| Stmn4 | 022044 | 118426 | 113629 |
| Stmn4 | 022044 | 121955 | 113788 |
| Stmn4 | 022044 | 120229 | 113759 |
| Stmn4 | 022044 | 134440 | 123092 |
| Stmn4 | 022044 | 147477 | N/A |
| Ston1 | 033855 | 137138 | 118522 |
| Ston1 | 033855 | 153613 | N/A |
| Ston1 | 033855 | 064035 | 067027 |
| Ston1 | 033855 | 150023 | 122928 |
| Ston1 | 033855 | 132384 | N/A |
| Ston1 | 033855 | 112216 | N/A |
| Ston1 | 033855 | 163588 | 131703 |
| Ston2 | 020961 | 052969 | 053908 |
| Ston2 | 020961 | 164713 | 131098 |
| Ston2 | 020961 | 111609 | N/A |
| Ston2 | 020961 | 170077 | 126429 |
| Ston2 | 020961 | 170984 | N/A |
| Ston2 | 020961 | 166967 | 128561 |
| Ston2 | 020961 | 166008 | N/A |
| Stox2 | 038143 | 079195 | 078190 |
| Stox2 | 038143 | 211882 | 148776 |
| Stox2 | 038143 | 110367 | 105996 |
| Stox2 | 038143 | 211737 | 147477 |
| Stox2 | 038143 | 210030 | 147281 |
| Stox2 | 038143 | 209337 | 148231 |
| Stox2 | 038143 | 210153 | 147670 |
| Stox2 | 038143 | 209941 | N/A |
| Stox2 | 038143 | 181417 | N/A |
| Strip2 | 039629 | 046028 | 036477 |
| Strip2 | 039629 | 130969 | N/A |
| Strip2 | 039629 | 115224 | 110879 |
| Strip2 | 039629 | 137068 | N/A |
| Strip2 | 039629 | 151738 | 119506 |
| Strn | 024077 | 145910 | 120830 |
| Strn | 024077 | 024881 | 024881 |
| Strn | 024077 | 145480 | 117663 |
| Stx17 | 061455 | 107721 | 103349 |
| Stx17 | 061455 | 153502 | 117512 |
| Stx17 | 061455 | 107720 | 103348 |
| Stx17 | 061455 | 064765 | 068087 |
| Stxbp3 | 027882 | 102621 | 099681 |
| Stxbp3 | 027882 | 124782 | N/A |
| Stxbp3 | 027882 | 124903 | N/A |
| Stxbp3 | 027882 | 150010 | N/A |
| Stxbp3 | 027882 | 196679 | 142785 |
| Stxbp3 | 027882 | 200035 | N/A |
| Stxbp3 | 027882 | 138552 | 142860 |
| Stxbp3 | 027882 | 106596 | 102206 |
| Sulf2 | 006800 | 109249 | 104872 |

TABLE 3-continued

| ENSEMBL IDs for rats | | | |
|---|---|---|---|
| Symbol | MUSG | MUST | MUSP |
| Sulf2 | 006800 | 146497 | 154557 |
| Sulf2 | 006800 | 088086 | 085405 |
| Sulf2 | 006800 | 125503 | N/A |
| Sulf2 | 006800 | 143996 | N/A |
| Sulf2 | 006800 | 139266 | 154315 |
| Sulf2 | 006800 | 133395 | 154724 |
| Susd5 | 086596 | 135338 | 128826 |
| Svep1 | 028369 | 042850 | 045856 |
| Svep1 | 028369 | 128783 | N/A |
| Svep1 | 028369 | 146329 | N/A |
| Svep1 | 028369 | 149152 | N/A |
| Svil | 024236 | 126977 | 115078 |
| Svil | 024236 | 131210 | N/A |
| Svil | 024236 | 138258 | N/A |
| Svil | 024236 | 143254 | 119287 |
| Svil | 024236 | 153016 | 121497 |
| Svil | 024236 | 140448 | 119803 |
| Svil | 024236 | 148564 | N/A |
| Svil | 024236 | 210707 | 147843 |
| Svil | 024236 | 127297 | 115223 |
| Svil | 024236 | 131609 | 122242 |
| Svil | 024236 | 125512 | 121972 |
| Svil | 024236 | 139761 | N/A |
| Svil | 024236 | 146723 | 115591 |
| Svil | 024236 | 129543 | N/A |
| Svil | 024236 | 025079 | 025079 |
| Swap70 | 031015 | 033325 | 033325 |
| Swap70 | 031015 | 209261 | N/A |
| Swap70 | 031015 | 210743 | N/A |
| Swap70 | 031015 | 210513 | N/A |
| Sycp1 | 027855 | 029448 | 029448 |
| Sycp1 | 027855 | 198651 | N/A |
| Sycp1 | 027855 | 196988 | 143651 |
| Sycp1 | 027855 | 199930 | 143493 |
| Syn3 | 059602 | 120638 | 113720 |
| Syn3 | 059602 | 145864 | N/A |
| Syn3 | 059602 | 123783 | N/A |
| Syn3 | 059602 | 139197 | N/A |
| Syn3 | 059602 | 121789 | 113408 |
| Syn3 | 059602 | 143319 | N/A |
| Syndig1 | 074736 | 109935 | 105561 |
| Syndig1 | 074736 | 144179 | 116877 |
| Syndig1 | 074736 | 109934 | 105560 |
| Syndig1 | 074736 | 137280 | 122838 |
| Syndig1 | 074736 | 149705 | 122327 |
| Syndig1 | 074736 | 140870 | 114499 |
| Syndig1l | 071234 | 095550 | 093206 |
| Syndig1l | 071234 | 222422 | 152374 |
| Syndig1l | 071234 | 221905 | 152304 |
| Syndig1l | 071234 | 221793 | N/A |
| Synj2 | 023805 | 146009 | 122381 |
| Synj2 | 023805 | 134767 | 138449 |
| Synj2 | 023805 | 080283 | 079164 |
| Synj2 | 023805 | 142409 | 120006 |
| Synj2 | 023805 | 061091 | 060382 |
| Synj2 | 023805 | 115790 | 111456 |
| Synj2 | 023805 | 115789 | 111455 |
| Synj2 | 023805 | 115788 | 111454 |
| Synj2 | 023805 | 115787 | 111453 |
| Synj2 | 023805 | 115786 | 111452 |
| Synj2 | 023805 | 115784 | 111450 |
| Synj2 | 023805 | 115785 | 111451 |
| Synj2 | 023805 | 130661 | N/A |
| Synj2 | 023805 | 154114 | 122316 |
| Synj2 | 023805 | 126881 | 115371 |
| Synj2 | 023805 | 115791 | 111457 |
| Synpr | 056296 | 070323 | 064986 |
| Synpr | 056296 | 223580 | N/A |
| Synpr | 056296 | 225636 | N/A |
| Synpr | 056296 | 226094 | N/A |
| Synpr | 056296 | 223583 | 153361 |
| Synpr | 056296 | 153954 | 116342 |
| Synpr | 056296 | 145700 | N/A |
| Synpr | 056296 | 147677 | N/A |
| Synpr | 056296 | 112656 | 108275 |
| Syt10 | 063260 | 029441 | 029441 |

TABLE 3-continued

ENSEMBL IDs for rats

| Symbol | MUSG | MUST | MUSP |
|---|---|---|---|
| Syt12 | 049303 | 059295 | 055237 |
| Syt12 | 049303 | 128114 | N/A |
| Syt12 | 049303 | 166191 | 130418 |
| Syt12 | 049303 | 133222 | N/A |
| Syt14 | 016200 | 215093 | 151129 |
| Syt14 | 016200 | 195354 | 142190 |
| Syt14 | 016200 | 195530 | 141563 |
| Syt14 | 016200 | 016344 | 016344 |
| Syt14 | 016200 | 191907 | N/A |
| Syt17 | 058420 | 081574 | 080284 |
| Syt17 | 058420 | 203465 | 147122 |
| Syt17 | 058420 | 203796 | 145087 |
| Syt17 | 058420 | 203485 | 144987 |
| Syt17 | 058420 | 207034 | 146460 |
| Syt17 | 058420 | 207650 | N/A |
| Syt4 | 024261 | 025110 | 025110 |
| Tanc1 | 035168 | 112568 | 108187 |
| Tanc1 | 035168 | 142573 | N/A |
| Tanc1 | 035168 | 128030 | N/A |
| Tanc1 | 035168 | 139863 | 123345 |
| Tanc1 | 035168 | 127013 | N/A |
| Tanc1 | 035168 | 056900 | N/A |
| Tanc1 | 035168 | 126271 | N/A |
| Tanc1 | 035168 | 136248 | N/A |
| Tanc1 | 035168 | 162857 | N/A |
| Tanc1 | 035168 | 147650 | N/A |
| Tanc1 | 035168 | 037526 | 036003 |
| Taok3 | 061288 | 111978 | 107609 |
| Taok3 | 061288 | 125738 | 117841 |
| Taok3 | 061288 | 128720 | N/A |
| Taok3 | 061288 | 092889 | 090565 |
| Taok3 | 061288 | 126813 | N/A |
| Taok3 | 061288 | 145640 | 116920 |
| Taok3 | 061288 | 153709 | N/A |
| Taok3 | 061288 | 127814 | 119998 |
| Taok3 | 061288 | 111975 | 107606 |
| Taok3 | 061288 | 179276 | 136750 |
| Tbc1d1 | 029174 | 199270 | 143451 |
| Tbc1d1 | 029174 | 043893 | 044577 |
| Tbc1d1 | 029174 | 121370 | 112493 |
| Tbc1d1 | 029174 | 129389 | N/A |
| Tbc1d1 | 029174 | 119756 | 113643 |
| Tbc1d1 | 029174 | 147348 | 119710 |
| Tbc1d1 | 029174 | 140960 | N/A |
| Tbc1d1 | 029174 | 101195 | 098756 |
| Tbc1d4 | 033083 | 161991 | 125509 |
| Tbc1d4 | 033083 | 161304 | N/A |
| Tbc1d4 | 033083 | 159951 | 124511 |
| Tbc1d4 | 033083 | 162617 | 124909 |
| Tbc1d4 | 033083 | 160297 | N/A |
| Tbc1d4 | 033083 | 159484 | N/A |
| Tbc1d4 | 033083 | 159668 | N/A |
| Tbc1d4 | 033083 | 159664 | 124734 |
| Tbc1d4 | 033083 | 100340 | 097913 |
| Tbc1d4 | 033083 | 160473 | N/A |
| Tbc1d5 | 023923 | 024717 | 024717 |
| Tbc1d5 | 023923 | 224977 | N/A |
| Tbc1d5 | 023923 | 224528 | 153172 |
| Tbc1d5 | 023923 | 225252 | N/A |
| Tbc1d5 | 023923 | 223979 | N/A |
| Tbc1d5 | 023923 | 223758 | N/A |
| Tbc1d5 | 023923 | 224547 | N/A |
| Tbc1d5 | 023923 | 224123 | N/A |
| Tbc1d5 | 023923 | 225473 | N/A |
| Tbcel | 037287 | 125995 | 114721 |
| Tbcel | 037287 | 066148 | 067882 |
| Tbcel | 037287 | 066179 | 065125 |
| Tbcel | 037287 | 142775 | N/A |
| Tbcel | 037287 | 138506 | 116616 |
| Tbcel | 037287 | 128959 | 121164 |
| Tbcel | 037287 | 134374 | 114275 |
| Tbcel | 037287 | 213428 | N/A |
| Tbr1 | 035033 | 048934 | 046787 |
| Tbr1 | 035033 | 102737 | 099798 |
| Tbr1 | 035033 | 131538 | N/A |
| Tbr1 | 035033 | 136867 | N/A |

TABLE 3-continued

ENSEMBL IDs for rats

| Symbol | MUSG | MUST | MUSP |
|---|---|---|---|
| Tbxas1 | 029925 | 162521 | 125406 |
| Tbxas1 | 029925 | 003017 | 003017 |
| Tbxas1 | 029925 | 159226 | N/A |
| Tbxas1 | 029925 | 161781 | N/A |
| Tbxas1 | 029925 | 160963 | 124640 |
| Tbxas1 | 029925 | 162656 | N/A |
| Tbxas1 | 029925 | 161360 | N/A |
| Tceal7 | 079428 | 126811 | 122260 |
| Tceal7 | 079428 | 113116 | 108741 |
| Tcergl1 | 091002 | 162222 | N/A |
| Tcergl1 | 091002 | 161213 | N/A |
| Tcergl1 | 091002 | 160436 | 124476 |
| Tcf7l1 | 055799 | 069536 | 069403 |
| Tcf7l1 | 055799 | 114053 | 109687 |
| Tcf7l1 | 055799 | 141743 | N/A |
| Tcf7l1 | 055799 | 149446 | 115060 |
| Tcf7l1 | 055799 | 182651 | N/A |
| Tcp11l2 | 020034 | 020223 | 020223 |
| Tcp11l2 | 020034 | 162874 | N/A |
| Tcp11l2 | 020034 | 160057 | N/A |
| Tcte1 | 023949 | 113547 | 109175 |
| Tctex1d1 | 028523 | 220547 | 152803 |
| Tctex1d1 | 028523 | 223169 | 152761 |
| Tctex1d1 | 028523 | 030248 | 030248 |
| Tctex1d1 | 028523 | 125417 | 117319 |
| Tctex1d1 | 028523 | 169211 | 128228 |
| Tctex1d1 | 028523 | 140654 | 116692 |
| Tctex1d1 | 028523 | 139883 | N/A |
| Tctex1d1 | 028523 | 116317 | 112019 |
| Tdp1 | 021177 | 151019 | N/A |
| Tdp1 | 021177 | 125639 | N/A |
| Tdp1 | 021177 | 153627 | 118656 |
| Tdp1 | 021177 | 221396 | N/A |
| Tdp1 | 021177 | 137653 | 123269 |
| Tdp1 | 021177 | 126424 | N/A |
| Tdp1 | 021177 | 128739 | N/A |
| Tdp1 | 021177 | 220685 | N/A |
| Tdp1 | 021177 | 021594 | 021594 |
| Tead1 | 055320 | 084705 | 081755 |
| Tead1 | 055320 | 059768 | 060671 |
| Tead1 | 055320 | 106638 | 102249 |
| Tead1 | 055320 | 172065 | N/A |
| Tead1 | 055320 | 171373 | 131765 |
| Tead1 | 055320 | 164363 | 127574 |
| Tead1 | 055320 | 163593 | N/A |
| Tead1 | 055320 | 170352 | 129798 |
| Tead1 | 055320 | 168981 | 133025 |
| Tead1 | 055320 | 171197 | 128439 |
| Tead1 | 055320 | 165036 | 131221 |
| Tead1 | 055320 | 167060 | 130564 |
| Tead1 | 055320 | 168328 | N/A |
| Tead1 | 055320 | 210510 | N/A |
| Tead1 | 055320 | 069256 | 130459 |
| Tead4 | 030353 | 130454 | 118083 |
| Tead4 | 030353 | 006311 | 006311 |
| Tead4 | 030353 | 112157 | 107784 |
| Tead4 | 030353 | 133118 | 120941 |
| Tead4 | 030353 | 143004 | 118606 |
| Tec | 029217 | 071944 | 071836 |
| Tec | 029217 | 113594 | 109224 |
| Tec | 029217 | 126481 | 123606 |
| Tec | 029217 | 155342 | 118980 |
| Tec | 029217 | 073843 | 073509 |
| Tec | 029217 | 138842 | 120155 |
| Tec | 029217 | 149533 | 123258 |
| Tec | 029217 | 150193 | N/A |
| Tec | 029217 | 202547 | 144458 |
| Tek | 006386 | 073939 | 073595 |
| Tek | 006386 | 102798 | 099862 |
| Tek | 006386 | 071168 | 071162 |
| Tek | 006386 | 131958 | N/A |
| Tes | 029552 | 115467 | 111127 |
| Tes | 029552 | 200690 | N/A |
| Tes | 029552 | 154266 | 118791 |
| Tes | 029552 | 121170 | N/A |
| Tes | 029552 | 076654 | 075950 |

TABLE 3-continued

| ENSEMBL IDs for rats | | | |
|---|---|---|---|
| Symbol | MUSG | MUST | MUSP |
| Tesc | 029359 | 031304 | 031304 |
| Tesc | 029359 | 124648 | 138436 |
| Tesc | 029359 | 135540 | N/A |
| Tesc | 029359 | 151792 | N/A |
| Tesc | 029359 | 148777 | N/A |
| Tesc | 029359 | 145526 | N/A |
| Tex36 | 030976 | 033275 | 033275 |
| Tex52 | 079304 | 130785 | 145112 |
| Tex52 | 079304 | 100926 | 098486 |
| Tex9 | 090626 | 184312 | 138844 |
| Tex9 | 090626 | 085358 | 082467 |
| Tex9 | 090626 | 184125 | 139026 |
| Tex9 | 090626 | 183399 | N/A |
| Tex9 | 090626 | 184831 | 138999 |
| Tex9 | 090626 | 183574 | 139386 |
| Tex9 | 090626 | 183856 | 139247 |
| Tex9 | 090626 | 184557 | 139212 |
| Tex9 | 090626 | 184066 | N/A |
| Tex9 | 090626 | 184734 | N/A |
| Tex9 | 090626 | 183428 | 139326 |
| Tex9 | 090626 | 183551 | N/A |
| Tex9 | 090626 | 183501 | 138882 |
| Tex9 | 090626 | 185151 | 138929 |
| Tex9 | 090626 | 185106 | N/A |
| Tex9 | 090626 | 184624 | N/A |
| Tfap2a | 021359 | 021787 | 021787 |
| Tfap2a | 021359 | 224319 | N/A |
| Tfap2a | 021359 | 223869 | 153149 |
| Tfap2a | 021359 | 225180 | 153271 |
| Tfap2a | 021359 | 224999 | 153522 |
| Tfap2a | 021359 | 224665 | 153667 |
| Tfap2a | 021359 | 223908 | N/A |
| Tfap2a | 021359 | 224700 | N/A |
| Tfap2a | 021359 | 110193 | 105822 |
| Tfap2b | 025927 | 027059 | 027059 |
| Tfap2b | 025927 | 187754 | 140213 |
| Tfap2b | 025927 | 064976 | 064488 |
| Tfap2b | 025927 | 191068 | N/A |
| Tfap2b | 025927 | 186972 | N/A |
| Tg | 053469 | 065916 | 070239 |
| Tg | 053469 | 163495 | 129868 |
| Tg | 053469 | 167512 | N/A |
| Tg | 053469 | 171045 | 126454 |
| Tg | 053469 | 166906 | N/A |
| Tg | 053469 | 167344 | N/A |
| Tg | 053469 | 172153 | 128410 |
| Tg | 053469 | 166403 | N/A |
| Tgfb2 | 039239 | 045288 | 043849 |
| Tgfb2 | 039239 | 195201 | 142149 |
| Tgfb2 | 039239 | 191766 | N/A |
| Tgfb2 | 039239 | 194960 | N/A |
| Tgfb2 | 039239 | 194593 | N/A |
| Tgfb2 | 039239 | 193640 | N/A |
| Tgfb3 | 021253 | 003687 | 003687 |
| Th | 000214 | 000219 | 000219 |
| Th | 000214 | 105929 | 101549 |
| Th | 000214 | 124951 | 122876 |
| Th | 000214 | 138482 | 123661 |
| Th | 000214 | 123057 | 122162 |
| Th | 000214 | 140344 | 115434 |
| Thbs2 | 023885 | 170872 | 128308 |
| Thsd7b | 042581 | 148051 | N/A |
| Thsd7b | 042581 | 073527 | 073220 |
| Thsd7b | 042581 | 040311 | 041716 |
| Thsd7b | 042581 | 140629 | N/A |
| Thsd7b | 042581 | 152305 | 117750 |
| Thsd7b | 042581 | 190870 | N/A |
| Thsd7b | 042581 | 151700 | N/A |
| Thsd7b | 042581 | 140834 | N/A |
| Thsd7b | 042581 | 143130 | N/A |
| Thyn1 | 035443 | 214910 | N/A |
| Thyn1 | 035443 | 213770 | 151200 |
| Thyn1 | 035443 | 213683 | 150823 |
| Thyn1 | 035443 | 039161 | 037614 |
| Thyn1 | 035443 | 214458 | N/A |
| Thyn1 | 035443 | 217143 | N/A |

TABLE 3-continued

| ENSEMBL IDs for rats | | | |
|---|---|---|---|
| Symbol | MUSG | MUST | MUSP |
| Thyn1 | 035443 | 215024 | N/A |
| Thyn1 | 035443 | 216361 | N/A |
| Timp3 | 020044 | 020234 | 020234 |
| Timp3 | 020044 | 151134 | N/A |
| Timp3 | 020044 | 136045 | N/A |
| Timp3 | 020044 | 132307 | 133236 |
| Tlcd1 | 019437 | 098545 | 096145 |
| Tlcd1 | 019437 | 147819 | 126593 |
| Tlcd1 | 019437 | 145507 | N/A |
| Tlcd1 | 019437 | 092880 | 090556 |
| Tlcd1 | 019437 | 127587 | 114202 |
| Tlcd1 | 019437 | 141578 | N/A |
| Tlcd1 | 019437 | 108338 | 103975 |
| Tlcd1 | 019437 | 140379 | N/A |
| Tle4 | 024642 | 052011 | 057527 |
| Tle4 | 024642 | 167776 | 126249 |
| Tll1 | 053626 | 066166 | 070560 |
| Tll1 | 053626 | 209451 | N/A |
| Tll1 | 053626 | 211755 | N/A |
| Tll1 | 053626 | 210256 | 147695 |
| Tlr3 | 031639 | 034056 | 034056 |
| Tlr3 | 031639 | 167106 | 126556 |
| Tlr3 | 031639 | 210013 | 147783 |
| Tlr3 | 031639 | 209772 | 147738 |
| Tlr3 | 031639 | 211370 | 148127 |
| Tlr3 | 031639 | 210996 | 148263 |
| Tlr3 | 031639 | 209651 | 147961 |
| Tlr3 | 031639 | 209269 | N/A |
| Tlr3 | 031639 | 210354 | N/A |
| Tmc1 | 024749 | 039500 | 040859 |
| Tmc7 | 042246 | 044195 | 046927 |
| Tmc7 | 042246 | 153635 | N/A |
| Tmc7 | 042246 | 145989 | N/A |
| Tmc7 | 042246 | 139693 | N/A |
| N/A | N/A | N/A | N/A |
| Tmem108 | 042757 | 049452 | 046021 |
| Tmem108 | 042757 | 189588 | 140027 |
| Tmem108 | 042757 | 189066 | 141160 |
| Tmem108 | 042757 | 191069 | N/A |
| Tmem108 | 042757 | 215136 | 149890 |
| Tmem108 | 042757 | 186455 | N/A |
| Tmem125 | 050854 | 060214 | 063157 |
| Tmem125 | 050854 | 128098 | 115304 |
| Tmem125 | 050854 | 150044 | 117871 |
| Tmem125 | 050854 | 156191 | 117286 |
| Tmem125 | 050854 | 154025 | N/A |
| Tmem132b | 070498 | 185104 | 139013 |
| Tmem132b | 070498 | 031446 | 031446 |
| Tmem132b | 070498 | 184422 | N/A |
| Tmem132c | 034324 | 119026 | 113090 |
| Tmem132c | 034324 | 134780 | N/A |
| Tmem132c | 034324 | 128068 | N/A |
| Tmem132c | 034324 | 132592 | N/A |
| Tmem132c | 034324 | 145748 | 121783 |
| Tmem132e | 020701 | 092852 | 090528 |
| Tmem132e | 020701 | 054245 | 052484 |
| Tmem132e | 020701 | 132477 | N/A |
| Tmem132e | 020701 | 202598 | N/A |
| Tmem150c | 050640 | 124145 | N/A |
| Tmem150c | 050640 | 165548 | N/A |
| Tmem150c | 050640 | 139520 | 114464 |
| Tmem150c | 050640 | 063192 | 057116 |
| Tmem150c | 050640 | 146731 | N/A |
| Tmem163 | 026347 | 027585 | 027585 |
| Tmem163 | 026347 | 185560 | 140828 |
| Tmem163 | 026347 | 160111 | N/A |
| Tmem163 | 026347 | 162406 | N/A |
| Tmem163 | 026347 | 160616 | 124307 |
| Tmem178 | 024245 | 025092 | 025092 |
| Tmem179 | 054013 | 066791 | 068004 |
| Tmem179 | 054013 | 222836 | 152792 |
| Tmem200a | 049420 | 217910 | N/A |
| Tmem200a | 049420 | 218232 | 151861 |
| Tmem200a | 049420 | 066049 | 064080 |
| Tmem200a | 049420 | 219651 | 151832 |
| Tmem200a | 049420 | 219338 | 151494 |

TABLE 3-continued

ENSEMBL IDs for rats

| Symbol | MUSG | MUST | MUSP |
|---|---|---|---|
| Tmem200a | 049420 | 219872 | 151559 |
| Tmem255a | 036502 | 089056 | 086457 |
| Tmem255a | 036502 | 089054 | 086455 |
| Tmem255a | 036502 | 155848 | N/A |
| Tmem255a | 036502 | 066498 | 064511 |
| Tmem255a | 036502 | 139358 | N/A |
| Tmem266 | 032313 | 085754 | 082906 |
| Tmem266 | 032313 | 034862 | 034862 |
| Tmem266 | 032313 | 130465 | N/A |
| Tmem63a | 026519 | 161847 | 124937 |
| Tmem63a | 026519 | 162283 | 125287 |
| Tmem63a | 026519 | 027800 | 027800 |
| Tmem63a | 026519 | 159436 | 125192 |
| Tmem63a | 026519 | 161523 | 124021 |
| Tmem63a | 026519 | 160508 | 124973 |
| Tmem63a | 026519 | 160536 | 124860 |
| Tmem63a | 026519 | 161942 | N/A |
| Tmem98 | 035413 | 040865 | 042825 |
| Tmod1 | 028328 | 107773 | 103402 |
| Tmod1 | 028328 | 156200 | 134075 |
| Tmod1 | 028328 | 128689 | N/A |
| Tmod1 | 028328 | 136553 | N/A |
| Tmod1 | 028328 | 155730 | N/A |
| Tmprss5 | 032268 | 165088 | 132181 |
| Tmprss5 | 032268 | 171217 | N/A |
| Tmprss5 | 032268 | 166272 | 130069 |
| Tmprss5 | 032268 | 070390 | 064527 |
| Tmprss5 | 032268 | 167095 | 131650 |
| Tmprss5 | 032268 | 170246 | 129482 |
| Tmprss5 | 032268 | 170426 | 128662 |
| Tmtc4 | 041594 | 037726 | 046368 |
| Tmtc4 | 041594 | 143189 | 116480 |
| Tmtc4 | 041594 | 126867 | 116379 |
| Tmtc4 | 041594 | 148661 | 121523 |
| Tmtc4 | 041594 | 126494 | N/A |
| Tmtc4 | 041594 | 228661 | N/A |
| Tmtc4 | 041594 | 125900 | N/A |
| Tmtc4 | 041594 | 135917 | N/A |
| Tmtc4 | 041594 | 227430 | N/A |
| Tmtc4 | 041594 | 128969 | 118814 |
| Tmtc4 | 041594 | 228552 | N/A |
| Tmtc4 | 041594 | 153496 | N/A |
| Tmtc4 | 041594 | 141478 | N/A |
| Tnc | 028364 | 030056 | 030056 |
| Tnc | 028364 | 107372 | 102995 |
| Tnc | 028364 | 107371 | 102994 |
| Tnc | 028364 | 107377 | 103000 |
| Tnfaip6 | 053475 | 065927 | 069231 |
| Tnfrsf13c | 068105 | 089161 | 086564 |
| Tnfrsf13c | 068105 | 109535 | 105161 |
| Tnfrsf19 | 060548 | 111236 | 106867 |
| Tnfrsf19 | 060548 | 111234 | 106865 |
| Tnfrsf19 | 060548 | 225501 | N/A |
| Tnfrsf19 | 060548 | 224371 | 153577 |
| Tnfrsf19 | 060548 | 225730 | 152920 |
| Tnk2 | 022791 | 145627 | 152338 |
| Tnk2 | 022791 | 124585 | 152549 |
| Tnk2 | 022791 | 115126 | 110779 |
| Tnk2 | 022791 | 115125 | 110778 |
| Tnk2 | 022791 | 115124 | 110777 |
| Tnk2 | 022791 | 115123 | 110776 |
| Tnk2 | 022791 | 164358 | N/A |
| Tnk2 | 022791 | 150383 | N/A |
| Tnk2 | 022791 | 156614 | N/A |
| Tnk2 | 022791 | 137044 | N/A |
| Tnk2 | 022791 | 115122 | 110775 |
| Tnk2 | 022791 | 115120 | 110773 |
| Tnk2 | 022791 | 131238 | 129382 |
| Tnk2 | 022791 | 115121 | 110774 |
| Tnk2 | 022791 | 168506 | N/A |
| Tnk2 | 022791 | 152361 | 125905 |
| Tnni1 | 026418 | 187830 | N/A |
| Tnni1 | 026418 | 132795 | 121122 |
| Tnni1 | 026418 | 152208 | 121966 |
| Tnni1 | 026418 | 137331 | N/A |
| Tnni1 | 026418 | 152075 | 121343 |

TABLE 3-continued

ENSEMBL IDs for rats

| Symbol | MUSG | MUST | MUSP |
|---|---|---|---|
| Tnni1 | 026418 | 154463 | 122925 |
| Tnni1 | 026418 | 139986 | 123049 |
| Tnni1 | 026418 | 148201 | 123509 |
| Tnni1 | 026418 | 129217 | 119848 |
| Tnr | 015829 | 192069 | 141553 |
| Tnr | 015829 | 195199 | N/A |
| Tnr | 015829 | 193325 | 141752 |
| Tnr | 015829 | 192457 | 141509 |
| Tnr | 015829 | 111669 | 107298 |
| Tns1 | 055322 | 187584 | 140254 |
| Tns1 | 055322 | 191104 | 140317 |
| Tns1 | 055322 | 187691 | 139844 |
| Tns1 | 055322 | 185702 | 140094 |
| Tns1 | 055322 | 185331 | 140771 |
| Tns1 | 055322 | 212888 | 148638 |
| Tns1 | 055322 | 189228 | 139721 |
| Tns1 | 055322 | 191527 | N/A |
| Tns1 | 055322 | 185264 | N/A |
| Tns1 | 055322 | 185529 | N/A |
| Tns1 | 055322 | 191367 | 140991 |
| Tns1 | 055322 | 188942 | N/A |
| Tns1 | 055322 | 191264 | N/A |
| Tns1 | 055322 | 186381 | N/A |
| Tns1 | 055322 | 189571 | N/A |
| Tns1 | 055322 | 190389 | 140448 |
| Tns1 | 055322 | 187281 | 139616 |
| Tns1 | 055322 | 188436 | N/A |
| Tns1 | 055322 | 191204 | 140878 |
| Tns1 | 055322 | 188208 | 140837 |
| Tns1 | 055322 | 190599 | N/A |
| Tns1 | 055322 | 169786 | 127715 |
| Tns3 | 020422 | 020695 | 020695 |
| Tns3 | 020422 | 131941 | N/A |
| Tns3 | 020422 | 134823 | N/A |
| Tns3 | 020422 | 129074 | N/A |
| Tox2 | 074607 | 109428 | 105055 |
| Tox2 | 074607 | 128999 | 122344 |
| Tox2 | 074607 | 099110 | 096710 |
| Tox2 | 074607 | 148599 | 118219 |
| Tox2 | 074607 | 165937 | 126243 |
| Tox3 | 043668 | 109621 | 105250 |
| Tox3 | 043668 | 176616 | 135697 |
| Tox3 | 043668 | 176034 | 134931 |
| Tpcn1 | 032741 | 046426 | 042188 |
| Tpcn1 | 032741 | 200708 | N/A |
| Tpcn1 | 032741 | 202072 | N/A |
| Tpcn1 | 032741 | 201601 | N/A |
| Tppp | 021573 | 140217 | N/A |
| Tppp | 021573 | 022057 | 022057 |
| Trabd2b | 070867 | 094894 | 092494 |
| Traf1 | 026875 | 172159 | 130759 |
| Traf1 | 026875 | 028234 | 028234 |
| Traf1 | 026875 | 113064 | 108687 |
| Traf1 | 026875 | 129131 | N/A |
| Traf1 | 026875 | 201690 | 144189 |
| Traf1 | 026875 | 201335 | N/A |
| Traf1 | 026875 | 141238 | N/A |
| Traf1 | 026875 | 156479 | N/A |
| Traf1 | 026875 | 135870 | N/A |
| Trhde | 050663 | 061632 | 057449 |
| Trhde | 050663 | 152702 | N/A |
| Trhde | 050663 | 152282 | N/A |
| Tril | 043496 | 127748 | 116056 |
| Trim30a | 030921 | 076922 | 076189 |
| Trim30a | 030921 | 125762 | N/A |
| Trim30a | 030921 | 142124 | N/A |
| Trim36 | 033949 | 167364 | 129771 |
| Trim36 | 033949 | 037011 | 037978 |
| Trim59 | 034317 | 107802 | 103432 |
| Trim59 | 034317 | 136512 | 120270 |
| Trim59 | 034317 | 142560 | N/A |
| Trim59 | 034317 | 153259 | N/A |
| Trim62 | 041000 | 147852 | 123646 |
| Trim62 | 041000 | 035667 | 039121 |
| Trim67 | 036913 | 167588 | 130343 |
| Trim67 | 036913 | 211867 | 148625 |

TABLE 3-continued

| ENSEMBL IDs for rats | | | |
|---|---|---|---|
| Symbol | MUSG | MUST | MUSP |
| Trim67 | 036913 | 041106 | 040601 |
| Trp53cor1 | 085912 | 133221 | N/A |
| Trpc3 | 027716 | 029271 | 029271 |
| Trpc3 | 027716 | 129322 | N/A |
| Trpc3 | 027716 | 123220 | N/A |
| Trpc3 | 027716 | 133542 | N/A |
| Trpc3 | 027716 | 146475 | N/A |
| Trpc5 | 041710 | 040184 | 049063 |
| Trpc5 | 041710 | 148240 | N/A |
| Trpc7 | 021541 | 022023 | 022023 |
| Trpc7 | 021541 | 109871 | 105497 |
| Trpc7 | 021541 | 151918 | 119809 |
| Trpc7 | 021541 | 174457 | 133305 |
| Trpc7 | 021541 | 173067 | 134481 |
| Trpc7 | 021541 | 173817 | 133411 |
| Trpc7 | 021541 | 173513 | 134662 |
| Trpc7 | 021541 | 173466 | 134285 |
| Trpm2 | 009292 | 105401 | 101040 |
| Trpm2 | 009292 | 105400 | N/A |
| Trpm2 | 009292 | 140471 | N/A |
| Trpm2 | 009292 | 153842 | N/A |
| Trpm2 | 009292 | 138238 | N/A |
| Trpm2 | 009292 | 126206 | N/A |
| Trpm2 | 009292 | 217806 | N/A |
| Trpm2 | 009292 | 219997 | 151231 |
| Trpm2 | 009292 | 105399 | 101038 |
| Trpm2 | 009292 | 154996 | N/A |
| Trpv3 | 043029 | 049676 | 053755 |
| Tsc22d3 | 031431 | 112995 | N/A |
| Tsc22d3 | 031431 | 055738 | 062589 |
| Tsc22d3 | 031431 | 133023 | N/A |
| Tsc22d3 | 031431 | 112996 | 108620 |
| Tsc22d3 | 031431 | 123898 | 123569 |
| Tsc22d3 | 031431 | 152048 | N/A |
| Tshb | 027857 | 196958 | N/A |
| Tshb | 027857 | 029450 | 029450 |
| Tshb | 027857 | 170856 | 127165 |
| Tshb | 027857 | 200041 | 142782 |
| Tshb | 027857 | 197322 | 142670 |
| Tshb | 027857 | 172026 | 128440 |
| Tshz2 | 047907 | 109159 | 104787 |
| Tshz2 | 047907 | 109157 | 104785 |
| Tshz2 | 047907 | 185239 | 140884 |
| Tshz2 | 047907 | 123300 | 118550 |
| Tshz2 | 047907 | 140699 | 120013 |
| Tspan11 | 030351 | 032501 | 032501 |
| Tspan11 | 030351 | 149801 | N/A |
| Tspan14 | 037824 | 224209 | 153208 |
| Tspan14 | 037824 | 224349 | N/A |
| Tspan14 | 037824 | 047652 | 035263 |
| Tspan15 | 037031 | 047883 | 047029 |
| Tspan15 | 037031 | 218394 | N/A |
| Tspan15 | 037031 | 219106 | N/A |
| Tspan15 | 037031 | 218824 | N/A |
| Tspan15 | 037031 | 220143 | N/A |
| Tspan18 | 027217 | 111265 | 106896 |
| Tspan18 | 027217 | 028646 | 028646 |
| Tspan18 | 027217 | 154951 | N/A |
| Tspan18 | 027217 | 181716 | N/A |
| Tspan18 | 027217 | 152141 | N/A |
| Tspan2 | 027858 | 029451 | 029451 |
| Tspan2 | 027858 | 196611 | 142964 |
| Tspan2 | 027858 | 119902 | 113803 |
| Tspan2 | 027858 | 197345 | 142543 |
| Tspan5 | 028152 | 029800 | 029800 |
| Tspan5 | 028152 | 142890 | 120969 |
| Tspan5 | 028152 | 127772 | 122500 |
| Tspan5 | 028152 | 153336 | 122120 |
| Tspan5 | 028152 | 142001 | 117857 |
| Tspan5 | 028152 | 135629 | 120961 |
| Tspan5 | 028152 | 146356 | 114663 |
| Tspan5 | 028152 | 119993 | 113230 |
| Tspan5 | 028152 | 121826 | 113359 |
| Tspan6 | 067377 | 087557 | 084838 |
| Tspan6 | 067377 | 176718 | 135005 |
| Tspan6 | 067377 | 176641 | 135626 |

TABLE 3-continued

| ENSEMBL IDs for rats | | | |
|---|---|---|---|
| Symbol | MUSG | MUST | MUSP |
| Tspan6 | 067377 | 177468 | N/A |
| Tspoap1 | 034156 | 039627 | 048063 |
| Tspoap1 | 034156 | 100644 | 098209 |
| Tspoap1 | 034156 | 148422 | N/A |
| Tspoap1 | 034156 | 144502 | 122665 |
| Tspoap1 | 034156 | 142329 | 118819 |
| Tspoap1 | 034156 | 153578 | N/A |
| Tspoap1 | 034156 | 148814 | N/A |
| Tspoap1 | 034156 | 135957 | N/A |
| Tspoap1 | 034156 | 133645 | 117356 |
| Tspoap1 | 034156 | 154758 | N/A |
| Tstd2 | 035495 | 107772 | 103401 |
| Tstd2 | 035495 | 107770 | 103399 |
| Tstd2 | 035495 | 160008 | N/A |
| Tstd2 | 035495 | 137399 | N/A |
| Tstd2 | 035495 | 147837 | 115473 |
| Tstd2 | 035495 | 144495 | 117990 |
| Tstd2 | 035495 | 129929 | 125707 |
| Tstd2 | 035495 | 156021 | 117865 |
| Ttc28 | 033209 | 156290 | 137609 |
| Ttc28 | 033209 | 143505 | N/A |
| Ttc28 | 033209 | 125470 | N/A |
| Ttc28 | 033209 | 128584 | N/A |
| Ttc28 | 033209 | 129017 | N/A |
| Ttc28 | 033209 | 040111 | 136116 |
| Ttll3 | 030276 | 204026 | 145049 |
| Ttll3 | 030276 | 204683 | N/A |
| Ttll3 | 030276 | 032414 | 032414 |
| Ttll3 | 030276 | 203524 | 145329 |
| Ttll3 | 030276 | 205017 | 145044 |
| Ttll3 | 030276 | 203925 | N/A |
| Ttll3 | 030276 | 204255 | N/A |
| Ttll3 | 030276 | 203880 | N/A |
| Ttll3 | 030276 | 038889 | 037870 |
| Ttpa | 073988 | 125799 | 117031 |
| Ttpa | 073988 | 121491 | 113966 |
| Ttpa | 073988 | 117632 | 113026 |
| Ttpa | 073988 | 098244 | 095845 |
| Tuba8 | 030137 | 032233 | 032233 |
| Tubb2b | 045136 | 075774 | 075178 |
| Tubb2b | 045136 | 220744 | N/A |
| Tubb4a | 062591 | 071135 | 071135 |
| Tulp3 | 001521 | 001562 | 001562 |
| Tulp3 | 001521 | 128708 | N/A |
| Tulp3 | 001521 | 138313 | N/A |
| Tulp3 | 001521 | 133134 | 145180 |
| Tulp3 | 001521 | 203625 | N/A |
| Tulp3 | 001521 | 157005 | 145361 |
| Tusc3 | 039530 | 209440 | 148134 |
| Tusc3 | 039530 | 211241 | 148022 |
| Tusc3 | 039530 | 209970 | N/A |
| Tusc3 | 039530 | 210890 | 147691 |
| Tusc3 | 039530 | 167992 | 126080 |
| Tusc3 | 039530 | 169034 | 129916 |
| Txnip | 038393 | 074519 | 102710 |
| Txnip | 038393 | 049093 | 041467 |
| Txnip | 038393 | 151832 | N/A |
| Txnip | 038393 | 196871 | N/A |
| Txnip | 038393 | 144639 | N/A |
| Txnip | 038393 | 128221 | N/A |
| Ubash3b | 032020 | 044155 | 043865 |
| Ubash3b | 032020 | 151485 | 116038 |
| Ubash3b | 032020 | 124819 | N/A |
| Ubash3b | 032020 | 136530 | 114176 |
| Ubash3b | 032020 | 129906 | 134923 |
| Ubash3b | 032020 | 132996 | N/A |
| Ube2b | 020390 | 020657 | 020657 |
| Ube2b | 020390 | 109086 | 104714 |
| Ube2b | 020390 | 124699 | N/A |
| Ube2b | 020390 | 147833 | N/A |
| Ube2ql1 | 052981 | 065118 | 070906 |
| Ucp2 | 033685 | 126534 | 120967 |
| Ucp2 | 033685 | 207890 | N/A |
| Ucp2 | 033685 | 126381 | N/A |
| Ucp2 | 033685 | 207748 | 146337 |
| Ucp2 | 033685 | 129324 | 115648 |

TABLE 3-continued

| | ENSEMBL IDs for rats | | |
|---|---|---|---|
| Symbol | MUSG | MUST | MUSP |
| Ucp2 | 033685 | 153287 | 115953 |
| Ucp2 | 033685 | 133044 | 115598 |
| Ucp2 | 033685 | 151221 | N/A |
| Ucp2 | 033685 | 133498 | N/A |
| Ucp2 | 033685 | 138673 | N/A |
| Ucp2 | 033685 | 149808 | N/A |
| Ugt8a | 032854 | 057944 | 050852 |
| Ugt8a | 032854 | 198610 | 143605 |
| Ugt8a | 032854 | 196481 | N/A |
| Unc13c | 062151 | 184666 | 139027 |
| Unc13c | 062151 | 075245 | 074726 |
| Unc80 | 055567 | 061620 | 053692 |
| Unc80 | 055567 | 114008 | 109641 |
| Unc80 | 055567 | 136727 | N/A |
| Unc80 | 055567 | 212557 | 148517 |
| Unc80 | 055567 | 187179 | N/A |
| Unc80 | 055567 | 152844 | 117070 |
| Uncx | 029546 | 172997 | 134067 |
| Uncx | 029546 | 174792 | 139081 |
| Upp1 | 020407 | 020677 | 020677 |
| Upp1 | 020407 | 101525 | 099063 |
| Upp1 | 020407 | 170444 | 125934 |
| Upp1 | 020407 | 130522 | 123285 |
| Upp1 | 020407 | 168121 | N/A |
| Upp1 | 020407 | 172452 | 129787 |
| Upp1 | 020407 | 166455 | 129276 |
| Upp1 | 020407 | 146696 | N/A |
| Upp1 | 020407 | 164791 | 127473 |
| Usp11 | 031066 | 033383 | 033383 |
| Usp11 | 031066 | 127294 | N/A |
| Usp11 | 031066 | 137101 | N/A |
| Usp11 | 031066 | 149960 | N/A |
| Uty | 068457 | 143286 | 115113 |
| Uty | 068457 | 154666 | 122818 |
| Uty | 068457 | 069309 | 070012 |
| Uty | 068457 | 139365 | 114752 |
| Uty | 068457 | 154004 | 114910 |
| Uty | 068457 | 185837 | N/A |
| Uty | 068457 | 143958 | 120069 |
| Uty | 068457 | 137048 | 119406 |
| Uty | 068457 | 133976 | N/A |
| Uty | 068457 | 157073 | N/A |
| Uty | 068457 | 150715 | 116372 |
| Uty | 068457 | 154527 | N/A |
| Slc18a3 | 100241 | 191501 | 139829 |
| Vamp1 | 030337 | 032487 | 032487 |
| Vamp1 | 030337 | 100942 | 098503 |
| Vamp1 | 030337 | 063588 | 063466 |
| Vamp1 | 030337 | 205223 | 144835 |
| Vamp1 | 030337 | 160523 | N/A |
| Vamp1 | 030337 | 159547 | N/A |
| Vat1l | 046844 | 142591 | N/A |
| Vat1l | 046844 | 049509 | 053431 |
| Vat1l | 046844 | 150963 | 116680 |
| Vat1l | 046844 | 124143 | N/A |
| Vav2 | 009621 | 185188 | 138964 |
| Vav2 | 009621 | 056176 | 062782 |
| Vav2 | 009621 | 149758 | N/A |
| Vav2 | 009621 | 148067 | N/A |
| Vav2 | 009621 | 146843 | N/A |
| Vav2 | 009621 | 135584 | N/A |
| Vav2 | 009621 | 132642 | N/A |
| Vax2 | 034777 | 037807 | 035976 |
| Vcan | 021614 | 159910 | 125446 |
| Vcan | 021614 | 159337 | 125432 |
| Vcan | 021614 | 160029 | N/A |
| Vcan | 021614 | 109546 | 105173 |
| Vcan | 021614 | 109543 | 105170 |
| Vcan | 021614 | 109544 | 105171 |
| Vcan | 021614 | 162715 | 125521 |
| Vcan | 021614 | 160740 | 125694 |
| Vcan | 021614 | 159285 | 125674 |
| Vgll4 | 030315 | 152710 | N/A |
| Vgll4 | 030315 | 032459 | 032459 |
| Vgll4 | 030315 | 123478 | N/A |
| Vgll4 | 030315 | 155620 | N/A |

TABLE 3-continued

| | ENSEMBL IDs for rats | | |
|---|---|---|---|
| Symbol | MUSG | MUST | MUSP |
| Vgll4 | 030315 | 147639 | 123139 |
| Vgll4 | 030315 | 139640 | 118618 |
| Vgll4 | 030315 | 204693 | N/A |
| Vim | 026728 | 141365 | 114742 |
| Vim | 026728 | 028062 | 028062 |
| Vim | 026728 | 193675 | 141494 |
| Vim | 026728 | 155605 | N/A |
| Vim | 026728 | 191615 | N/A |
| Vim | 026728 | 148248 | N/A |
| Vip | 019772 | 019906 | 019906 |
| Vip | 019772 | 217331 | N/A |
| Vipr2 | 011171 | 176078 | N/A |
| Vipr2 | 011171 | 011315 | 011315 |
| Vipr2 | 011171 | 100988 | N/A |
| Vipr2 | 011171 | 175785 | N/A |
| Vipr2 | 011171 | 177199 | N/A |
| Vipr2 | 011171 | 176433 | 135149 |
| Vit | 024076 | 024880 | 024880 |
| Vmp1 | 018171 | 018315 | 018315 |
| Vmp1 | 018171 | 123590 | N/A |
| Vmp1 | 018171 | 145846 | N/A |
| Vmp1 | 018171 | 150176 | N/A |
| Vmp1 | 018171 | 153971 | N/A |
| Vmp1 | 018171 | 127267 | N/A |
| Vmp1 | 018171 | 139040 | N/A |
| Vmp1 | 018171 | 143991 | 118302 |
| Vsig2 | 001943 | 002008 | 002008 |
| Vsig2 | 001943 | 215957 | 149703 |
| Vsig2 | 001943 | 215271 | 150115 |
| Vsig2 | 001943 | 213502 | N/A |
| Vsig2 | 001943 | 213699 | 149098 |
| Vsig2 | 001943 | 215710 | N/A |
| Vsnl1 | 054459 | 220506 | 152711 |
| Vsnl1 | 054459 | 072299 | 072145 |
| Vstm2b | 039257 | 044705 | 044002 |
| Vstm2b | 039257 | 206223 | 145703 |
| Vstm2b | 039257 | 186352 | 140241 |
| Vstm2b | 039257 | 205845 | 146231 |
| Vwc2 | 050830 | 109681 | 105303 |
| Vwc2 | 050830 | 129670 | 128761 |
| Vwc2 | 050830 | 154155 | N/A |
| Vwc2 | 050830 | 056344 | 049692 |
| Galnt17 | 034040 | 086023 | 083187 |
| Galnt17 | 034040 | 160609 | 125395 |
| Galnt17 | 034040 | 160807 | N/A |
| Galnt17 | 034040 | 161228 | N/A |
| Galnt17 | 034040 | 162966 | N/A |
| Wdr17 | 039375 | 144711 | 117710 |
| Wdr17 | 039375 | 127511 | 115550 |
| Wdr17 | 039375 | 175915 | 135805 |
| Wdr17 | 039375 | 128850 | N/A |
| Wdr17 | 039375 | 150488 | 122326 |
| Wdr17 | 039375 | 153074 | N/A |
| Wdr17 | 039375 | 144482 | 134950 |
| Wdr17 | 039375 | 126316 | N/A |
| Wdr17 | 039375 | 129132 | 134935 |
| Wdr17 | 039375 | 148806 | N/A |
| Wdr17 | 039375 | 176866 | 134978 |
| Wdr17 | 039375 | 148408 | 135523 |
| Wdr17 | 039375 | 176180 | N/A |
| Wdr49 | 104301 | 193989 | 144721 |
| Wdr49 | 104301 | 203169 | 144789 |
| Wdr49 | 104301 | 204982 | N/A |
| Wdr49 | 104301 | 204341 | 145379 |
| Wfdc1 | 023336 | 212901 | 148437 |
| Wfdc1 | 023336 | 024107 | 024107 |
| Wfs1 | 039474 | 043964 | 048053 |
| Wfs1 | 039474 | 166339 | 132404 |
| Wfs1 | 039474 | 167937 | 125779 |
| Wif1 | 020218 | 020439 | 020439 |
| Wif1 | 020218 | 175867 | 135486 |
| Wif1 | 020218 | 145691 | N/A |
| Wipi1 | 041895 | 103060 | 099349 |
| Wipi1 | 041895 | 047186 | 038635 |
| Wipi1 | 041895 | 106689 | 102300 |
| Wipi1 | 041895 | 153738 | N/A |

TABLE 3-continued

| ENSEMBL IDs for rats | | | |
|---|---|---|---|
| Symbol | MUSG | MUST | MUSP |
| Wls | 028173 | 068952 | 067898 |
| Wls | 028173 | 198878 | 143475 |
| Wls | 028173 | 200571 | N/A |
| Wls | 028173 | 197328 | N/A |
| Wls | 028173 | 200191 | 142774 |
| Wls | 028173 | 196276 | N/A |
| Wls | 028173 | 196782 | N/A |
| Wnt6 | 033227 | 006716 | 006716 |
| Wnt6 | 033227 | 189544 | N/A |
| Wnt7a | 030093 | 032180 | 032180 |
| Wnt7a | 030093 | 133092 | N/A |
| Wnt7a | 030093 | 132936 | N/A |
| Wscd1 | 020811 | 150531 | 123659 |
| Wscd1 | 020811 | 021168 | 021168 |
| Wscd1 | 020811 | 108511 | 104151 |
| Wscd1 | 020811 | 138339 | N/A |
| Wscd1 | 020810 | 108510 | 104150 |
| Wscd1 | 020811 | 132095 | N/A |
| Wwc1 | 018849 | 018993 | 018993 |
| Wwc1 | 018849 | 131001 | N/A |
| Wwc1 | 018849 | 127086 | N/A |
| Xist | 086503 | 153883 | N/A |
| Xist | 086503 | 127786 | N/A |
| Xist | 086503 | 185876 | N/A |
| Xrra1 | 035211 | 036155 | 035929 |
| Xrra1 | 035211 | 208354 | 146815 |
| Xrra1 | 035211 | 207855 | 147177 |
| Xrra1 | 035211 | 208270 | N/A |
| Xrra1 | 035211 | 208449 | N/A |
| Yes1 | 014932 | 202543 | 144001 |
| Yes1 | 014932 | 072311 | 072154 |
| Yes1 | 014932 | 200779 | N/A |
| Yes1 | 014932 | 168707 | 132161 |
| Yes1 | 014932 | 200999 | 144355 |
| Zbtb16 | 066687 | 093852 | 091374 |
| Zbtb16 | 066687 | 216150 | 150887 |
| Zcchc24 | 055538 | 069180 | 068677 |
| Zcchc24 | 055538 | 184642 | N/A |
| Zdhhc14 | 034265 | 089185 | 086589 |
| Zdhhc2 | 039470 | 049389 | 041727 |
| Zdhhc2 | 039470 | 131672 | N/A |
| Zdhhc2 | 039470 | 128166 | 123070 |
| Zdhhc2 | 039470 | 164934 | N/A |
| Zdhhc2 | 039470 | 168799 | N/A |
| Zdhhc2 | 039470 | 167766 | 129996 |
| Zeb2 | 026872 | 176438 | 134849 |
| Zeb2 | 026872 | 176732 | 135393 |
| Zeb2 | 026872 | 028229 | 028229 |
| Zeb2 | 026872 | 068415 | 069685 |
| Zeb2 | 026872 | 200844 | 144421 |
| Zeb2 | 026872 | 177302 | 134747 |
| Zeb2 | 026872 | 076836 | 076111 |
| Zeb2 | 026872 | 201804 | 144637 |
| Zeb2 | 026872 | 201623 | 144075 |
| Zeb2 | 026872 | 202432 | 144197 |
| Zeb2 | 026872 | 201211 | 144406 |
| Zeb2 | 026872 | 209076 | N/A |
| Zeb2 | 026872 | 201413 | N/A |
| Zeb2 | 026872 | 201969 | 144141 |
| Zeb2 | 026872 | 131635 | N/A |
| Zeb2 | 026872 | 202935 | 143841 |
| Zeb2 | 026872 | 202371 | N/A |
| Zeb2 | 026872 | 145529 | N/A |
| Zeb2 | 026872 | 202187 | 144552 |
| Zeb2 | 026872 | 127520 | 120130 |
| Zeb2 | 026872 | 201490 | 143976 |
| Zeb2 | 026872 | 153561 | 135491 |
| Zeb2 | 026872 | 152232 | N/A |
| Zeb2 | 026872 | 124942 | N/A |
| Zeb2 | 026872 | 201982 | N/A |
| Zeb2 | 026872 | 201298 | N/A |
| Zeb2 | 026872 | 202345 | N/A |
| Zeb2 | 026872 | 123037 | N/A |
| Zeb2 | 026872 | 126743 | N/A |
| Zfand6 | 030629 | 209117 | 146518 |
| Zfand6 | 030629 | 069537 | 069228 |

TABLE 3-continued

| ENSEMBL IDs for rats | | | |
|---|---|---|---|
| Symbol | MUSG | MUST | MUSP |
| Zfand6 | 030629 | 178385 | 135968 |
| Zfand6 | 030629 | 209140 | N/A |
| Zfand6 | 030629 | 209165 | 146878 |
| Zfand6 | 030629 | 207865 | 146682 |
| Zfand6 | 030629 | 208782 | 147192 |
| Zfand6 | 030629 | 208519 | N/A |
| Zfand6 | 030629 | 208831 | N/A |
| Zfand6 | 030629 | 207975 | 146559 |
| Zfhx4 | 025255 | 175866 | 135827 |
| Zfhx4 | 025255 | 175641 | N/A |
| Zfhx4 | 025255 | 176175 | 139253 |
| Zfhx4 | 025255 | 176383 | 135289 |
| Zfhx4 | 025255 | 026284 | 026284 |
| Zfp36l1 | 021127 | 021552 | 021552 |
| Zfp36l1 | 021127 | 219642 | 151682 |
| Zfp36l1 | 021127 | 218835 | 151269 |
| Zfp36l1 | 021127 | 165114 | 127522 |
| Zfp385c | 014198 | 103119 | 099408 |
| Zfp385c | 014198 | 148560 | N/A |
| Zfp385c | 014198 | 151589 | 119259 |
| Zfp385c | 014198 | 153494 | 115268 |
| Zfp395 | 034522 | 224623 | 153350 |
| Zfp395 | 034522 | 225865 | N/A |
| Zfp395 | 034522 | 066994 | 064422 |
| Zfp395 | 034522 | 224687 | 153406 |
| Zfp395 | 034522 | 225512 | N/A |
| Zfp423 | 045333 | 165770 | 129724 |
| Zfp423 | 045333 | 109655 | 105282 |
| Zfp423 | 045333 | 052250 | 052379 |
| Zfp423 | 045333 | 174764 | 134575 |
| Zfp423 | 045333 | 174249 | 134103 |
| Zfp423 | 045333 | 173725 | N/A |
| Zfp423 | 045333 | 173092 | N/A |
| Zfp462 | 060206 | 133895 | 122775 |
| Zfp462 | 060206 | 098070 | 095677 |
| Zfp462 | 060206 | 030131 | 030131 |
| Zfp462 | 060206 | 079605 | 078555 |
| Zfp521 | 024420 | 025288 | 025288 |
| Zfp608 | 052713 | 064763 | 068192 |
| Zfp804b | 092094 | 200317 | 143568 |
| Zfp804b | 092094 | 164784 | 130571 |
| Zfp831 | 050600 | 059452 | 060255 |
| Zic1 | 032368 | 034927 | 034927 |
| Zic1 | 032368 | 065360 | 068858 |
| Zic1 | 032368 | 173121 | N/A |
| Zic2 | 061524 | 075888 | 075283 |
| Zic2 | 061524 | 137059 | N/A |
| Zic3 | 067860 | 137687 | 116383 |
| Zic3 | 067860 | 088627 | 085999 |
| Zic3 | 067860 | 088631 | 086003 |
| Zic3 | 067860 | 088629 | 086001 |
| Zic4 | 036972 | 173342 | 133974 |
| Zic4 | 036972 | 172978 | N/A |
| Zic4 | 036972 | 173054 | 134364 |
| Zic4 | 036972 | 174611 | N/A |
| Zic4 | 036972 | 172646 | 134053 |
| Zic4 | 036972 | 170572 | N/A |
| Zic4 | 036972 | 174212 | 133808 |
| Zic4 | 036972 | 173933 | 133958 |
| Zic4 | 036972 | 174802 | N/A |
| Zic4 | 036972 | 172858 | N/A |
| Zic4 | 036972 | 066384 | 069568 |
| Zic4 | 036972 | 085242 | N/A |
| Zic5 | 041703 | 039118 | 035754 |
| Zic5 | 041703 | 143084 | N/A |
| Zkscan1 | 029729 | 019660 | 019660 |
| Zkscan1 | 029729 | 110963 | 106588 |
| Zkscan1 | 029729 | 110962 | 106587 |
| Zkscan1 | 029729 | 066617 | 068480 |
| Zmat4 | 037492 | 131410 | 115719 |
| Zmat4 | 037492 | 042352 | 049430 |

TABLE 3-continued

| ENSEMBL IDs for rats | | | |
|---|---|---|---|
| Symbol | MUSG | MUST | MUSP |
| Zmat4 | 037492 | 123412 | 121626 |
| Zmat4 | 037492 | 208021 | N/A |
| Zmat4 | 037492 | 207301 | 146734 |
| Zmat4 | 037492 | 135747 | 121337 |
| Zmat4 | 037492 | 146774 | N/A |

For human samples, Table 4 provides the unique ENSEMBL identifiers corresponding to the human genes (ENSG), transcripts (ENST), and proteins (if available) (ENSP) analyzed in the experiments herein. The unique identifiers for each ENSEMBL entry has been modified to remove the first five leading zeros (0) of the identifier after the ENSG, ENST, and ENSP label.

| Symbol | ENSG | ENST | SEQ ID | ENSP | SEQ ID |
|---|---|---|---|---|---|
| A2M | 175899 | 543436 | 1 | N/A | |
| A2M | 175899 | 495442 | 2 | N/A | |
| A2M | 175899 | 495709 | 3 | N/A | |
| A2M | 175899 | 318602 | 4 | 323929 | 23816 |
| A2M | 175899 | 545828 | 5 | N/A | |
| A2M | 175899 | 542567 | 6 | N/A | |
| A2M | 175899 | 462568 | 7 | N/A | |
| A2M | 175899 | 546069 | 8 | 438599 | 23817 |
| A2M | 175899 | 472360 | 9 | N/A | |
| A2M | 175899 | 539638 | 10 | 445717 | 23818 |
| A2M | 175899 | 404455 | 11 | 385710 | 23819 |
| A2M | 175899 | 467091 | 12 | N/A | |
| A2M | 175899 | 497324 | 13 | N/A | |
| AASS | 008311 | 460376 | 14 | N/A | |
| AASS | 008311 | 393376 | 15 | 377040 | 23820 |
| AASS | 008311 | 473553 | 16 | N/A | |
| AASS | 008311 | 417368 | 17 | 403768 | 23821 |
| AASS | 008311 | 431170 | 18 | 414001 | 23822 |
| AASS | 008311 | 358954 | 19 | 351834 | 23823 |
| AASS | 008311 | 426162 | 20 | 394180 | 23824 |
| AATK | 181409 | 326724 | 21 | 324196 | 23825 |
| AATK | 181409 | 570932 | 22 | 460986 | 23826 |
| AATK | 181409 | 374792 | 23 | 363924 | 23827 |
| AATK | 181409 | 417379 | 24 | 398796 | 23828 |
| AATK | 181409 | 573469 | 25 | N/A | |
| AATK | 181409 | 573441 | 26 | N/A | |
| AATK | 181409 | 572339 | 27 | N/A | |
| AATK | 181409 | 576053 | 28 | N/A | |
| AATK | 181409 | 575363 | 29 | 460202 | 23829 |
| AATK | 181409 | 572798 | 30 | N/A | |
| ABAT | 183044 | 268251 | 31 | 268251 | 23830 |
| ABAT | 183044 | 564714 | 32 | 456392 | 23831 |
| ABAT | 183044 | 563992 | 33 | N/A | |
| ABAT | 183044 | 568847 | 34 | 455184 | 23832 |
| ABAT | 183044 | 561870 | 35 | 456267 | 23833 |
| ABAT | 183044 | 569695 | 36 | N/A | |
| ABAT | 183044 | 566590 | 37 | 455198 | 23834 |
| ABAT | 183044 | 563215 | 38 | N/A | |
| ABAT | 183044 | 565016 | 39 | 454415 | 23835 |
| ABAT | 183044 | 567812 | 40 | 456330 | 23836 |
| ABAT | 183044 | 425191 | 41 | 411916 | 23837 |
| ABAT | 183044 | 569156 | 42 | 454963 | 23838 |
| ABAT | 183044 | 562115 | 43 | 455502 | 23839 |
| ABAT | 183044 | 565671 | 44 | N/A | |
| ABAT | 183044 | 564453 | 45 | N/A | |
| ABAT | 183044 | 396600 | 46 | 379845 | 23840 |
| ABCA1 | 165029 | 374733 | 47 | 363865 | 23841 |
| ABCA1 | 165029 | 423487 | 48 | 416623 | 23842 |
| ABCA1 | 165029 | 494467 | 49 | N/A | |
| ABCA1 | 165029 | 374736 | 50 | 363868 | 23843 |
| ABCA17P | 238098 | 512848 | 51 | N/A | |
| ABCA17P | 238098 | 640929 | 52 | N/A | |
| ABCA17P | 238098 | 469908 | 53 | N/A | |
| ABCA17P | 238098 | 482286 | 54 | N/A | |
| ABCA17P | 238098 | 505660 | 55 | N/A | |

-continued

| Symbol | ENSG | ENST | SEQ ID | ENSP | SEQ ID |
|---|---|---|---|---|---|
| ABCA17P | 238098 | 466730 | 56 | N/A | |
| ABCA17P | 238098 | 494925 | 57 | N/A | |
| ABCA8 | 141338 | 269080 | 58 | 269080 | 23844 |
| ABCA8 | 141338 | 586539 | 59 | 467271 | 23845 |
| ABCA8 | 141338 | 588458 | 60 | N/A | |
| ABCA8 | 141338 | 586292 | 61 | N/A | |
| ABCA8 | 141338 | 591459 | 62 | N/A | |
| ABCA8 | 141338 | 589980 | 63 | N/A | |
| ABCA8 | 141338 | 541225 | 64 | N/A | |
| ABCA8 | 141338 | 589533 | 65 | 467186 | 23846 |
| ABCA8 | 141338 | 590359 | 66 | N/A | |
| ABCA8 | 141338 | 587206 | 67 | N/A | |
| ABCA8 | 141338 | 428549 | 68 | N/A | |
| ABCA8 | 141338 | 585850 | 69 | N/A | |
| ABCA8 | 141338 | 585531 | 70 | 466126 | 23847 |
| ABCA8 | 141338 | 430352 | 71 | 402814 | 23848 |
| ABCA8 | 141338 | 615593 | 72 | 481467 | 23849 |
| ABCC10 | 124574 | 372515 | 73 | 361593 | 23850 |
| ABCC10 | 124574 | 502549 | 74 | N/A | |
| ABCC10 | 124574 | 372530 | 75 | 361608 | 23851 |
| ABCC10 | 124574 | 443426 | 76 | N/A | |
| ABCC10 | 124574 | 244533 | 77 | 244533 | 23852 |
| ABCC10 | 124574 | 463024 | 78 | N/A | |
| ABCC10 | 124574 | 469856 | 79 | N/A | |
| ABCC10 | 124574 | 372512 | 80 | N/A | |
| ABCC10 | 124574 | 437104 | 81 | N/A | |
| ABCC10 | 124574 | 505344 | 82 | 422699 | 23853 |
| ABCC8 | 006071 | 531642 | 83 | 435378 | 23854 |
| ABCC8 | 006071 | 526037 | 84 | N/A | |
| ABCC8 | 006071 | 389817 | 85 | 374467 | 23855 |
| ABCC8 | 006071 | 526168 | 86 | 437233 | 23856 |
| ABCC8 | 006071 | 525022 | 87 | N/A | |
| ABCC8 | 006071 | 532220 | 88 | N/A | |
| ABCC8 | 006071 | 528374 | 89 | 433638 | 23857 |
| ABCC8 | 006071 | 527905 | 90 | 431653 | 23858 |
| ABCC8 | 006071 | 531891 | 91 | 434893 | 23859 |
| ABCC8 | 006071 | 531137 | 92 | N/A | |
| ABCC8 | 006071 | 524561 | 93 | N/A | |
| ABCC8 | 006071 | 526921 | 94 | N/A | |
| ABCC8 | 006071 | 529967 | 95 | N/A | |
| ABCC8 | 006071 | 530147 | 96 | N/A | |
| ABCC8 | 006071 | 531911 | 97 | N/A | |
| ABCC8 | 006071 | 532728 | 98 | N/A | |
| ABCC8 | 006071 | 528202 | 99 | N/A | |
| ABCC8 | 006071 | 635881 | 100 | N/A | |
| ABCC8 | 006071 | 526002 | 101 | N/A | |
| ABCC8 | 006071 | 302539 | 102 | 303960 | 23860 |
| ABCC8 | 006071 | 612903 | 103 | 483031 | 23861 |
| ABCG2 | 118777 | 515655 | 104 | 426917 | 23862 |
| ABCG2 | 118777 | 237612 | 105 | 237612 | 23863 |
| ABCG2 | 118777 | 505480 | 106 | 426916 | 23864 |
| ABCG2 | 118777 | 503830 | 107 | 426934 | 23865 |
| ABHD2 | 140526 | 569411 | 108 | 457882 | 23866 |
| ABHD2 | 140526 | 352732 | 109 | 268129 | 23867 |
| ABHD2 | 140526 | 564876 | 110 | N/A | |
| ABHD2 | 140526 | 569550 | 111 | 454645 | 23868 |
| ABHD2 | 140526 | 565066 | 112 | 454531 | 23869 |
| ABHD2 | 140526 | 565973 | 113 | 455639 | 23870 |
| ABHD2 | 140526 | 565825 | 114 | N/A | |
| ABHD2 | 140526 | 562254 | 115 | N/A | |
| ABHD2 | 140526 | 562073 | 116 | N/A | |
| ABHD2 | 140526 | 568308 | 117 | N/A | |
| ABHD3 | 158201 | 289119 | 118 | 289119 | 23871 |
| ABHD3 | 158201 | 580981 | 119 | 462935 | 23872 |
| ABHD3 | 158201 | 578270 | 120 | 462578 | 23873 |
| ABHD3 | 158201 | 577564 | 121 | N/A | |
| ABHD3 | 158201 | 580477 | 122 | 463996 | 23874 |
| ABHD3 | 158201 | 577891 | 123 | 463365 | 23875 |
| ABHD3 | 158201 | 579875 | 124 | N/A | |
| ABHD3 | 158201 | 584464 | 125 | 463848 | 23876 |
| ABHD3 | 158201 | 577928 | 126 | N/A | |
| ABHD3 | 158201 | 579982 | 127 | N/A | |
| ABHD5 | 011198 | 456453 | 128 | 391582 | 23877 |
| ABHD5 | 011198 | 458276 | 129 | 390849 | 23878 |
| ABHD5 | 011198 | 486764 | 130 | N/A | |
| ABHD5 | 011198 | 013894 | 131 | 013894 | 23879 |

-continued

| Symbol | ENSG | ENST | SEQ ID | ENSP | SEQ ID |
|--------|------|------|--------|------|--------|
| ABHD5 | 011198 | 454293 | 132 | 412014 | 23880 |
| ABHD5 | 011198 | 413300 | 133 | 392159 | 23881 |
| ABHD5 | 011198 | 463153 | 134 | N/A | |
| ABI3 | 108798 | 225941 | 135 | 225941 | 23882 |
| ABI3 | 108798 | 419580 | 136 | 406651 | 23883 |
| ABI3 | 108798 | 573347 | 137 | 460776 | 23884 |
| ABI3 | 108798 | 571035 | 138 | 459171 | 23885 |
| ABI3BP | 154175 | 471714 | 139 | 420524 | 23886 |
| ABI3BP | 154175 | 470336 | 140 | N/A | |
| ABI3BP | 154175 | 284322 | 141 | 284322 | 23887 |
| ABI3BP | 154175 | 495591 | 142 | 418817 | 23888 |
| ABI3BP | 154175 | 487012 | 143 | N/A | |
| ABI3BP | 154175 | 497021 | 144 | N/A | |
| ABI3BP | 154175 | 486770 | 145 | 419029 | 23889 |
| ABI3BP | 154175 | 469764 | 146 | N/A | |
| ABI3BP | 154175 | 497395 | 147 | 420704 | 23890 |
| ABI3BP | 154175 | 471901 | 148 | 418024 | 23891 |
| ABI3BP | 154175 | 527943 | 149 | 431537 | 23892 |
| ABI3BP | 154175 | 482765 | 150 | 418800 | 23893 |
| ABI3BP | 154175 | 478235 | 151 | 417745 | 23894 |
| ABI3BP | 154175 | 466947 | 152 | 418063 | 23895 |
| ABI3BP | 154175 | 533795 | 153 | 433981 | 23896 |
| ABI3BP | 154175 | 528305 | 154 | 432069 | 23897 |
| ABI3BP | 154175 | 495063 | 155 | 433993 | 23898 |
| ABI3BP | 154175 | 528490 | 156 | 436070 | 23899 |
| ABI3BP | 154175 | 487249 | 157 | N/A | |
| ABI3BP | 154175 | 534413 | 158 | 437308 | 23900 |
| ABI3BP | 154175 | 534256 | 159 | 434425 | 23901 |
| ABI3BP | 154175 | 533855 | 160 | 437031 | 23902 |
| ABI3BP | 154175 | 459682 | 161 | 417325 | 23903 |
| ABI3BP | 154175 | 483129 | 162 | 418479 | 23904 |
| ABI3BP | 154175 | 475896 | 163 | N/A | |
| ABI3BP | 154175 | 527258 | 164 | 435319 | 23905 |
| ABI3BP | 154175 | 530539 | 165 | 436918 | 23906 |
| ABI3BP | 154175 | 530236 | 166 | 434256 | 23907 |
| ABI3BP | 154175 | 532144 | 167 | N/A | |
| ABLIM1 | 099204 | 392952 | 168 | 376679 | 23908 |
| ABLIM1 | 099204 | 392955 | 169 | 376682 | 23909 |
| ABLIM1 | 099204 | 369253 | 170 | 358257 | 23910 |
| ABLIM1 | 099204 | 369256 | 171 | 358260 | 23911 |
| ABLIM1 | 099204 | 277895 | 172 | 277895 | 23912 |
| ABLIM1 | 099204 | 485570 | 173 | N/A | |
| ABLIM1 | 099204 | 440467 | 174 | 414154 | 23913 |
| ABLIM1 | 099204 | 428430 | 175 | 400934 | 23914 |
| ABLIM1 | 099204 | 466400 | 176 | N/A | |
| ABLIM1 | 099204 | 481974 | 177 | N/A | |
| ABLIM1 | 099204 | 477638 | 178 | N/A | |
| ABLIM1 | 099204 | 533213 | 179 | 433629 | 23915 |
| ABLIM1 | 099204 | 369252 | 180 | 358256 | 23916 |
| ABLIM1 | 099204 | 369266 | 181 | 358270 | 23917 |
| ABLIM2 | 163995 | 512594 | 182 | N/A | |
| ABLIM2 | 163995 | 361737 | 183 | 354887 | 23918 |
| ABLIM2 | 163995 | 509819 | 184 | N/A | |
| ABLIM2 | 163995 | 514025 | 185 | 423661 | 23919 |
| ABLIM2 | 163995 | 447017 | 186 | 393511 | 23920 |
| ABLIM2 | 163995 | 341937 | 187 | 342813 | 23921 |
| ABLIM2 | 163995 | 361581 | 188 | 355003 | 23922 |
| ABLIM2 | 163995 | 407564 | 189 | 384658 | 23923 |
| ABLIM2 | 163995 | 505872 | 190 | 421283 | 23924 |
| ABLIM2 | 163995 | 428004 | 191 | 389410 | 23925 |
| ABLIM2 | 163995 | 504172 | 192 | N/A | |
| ABLIM2 | 163995 | 510277 | 193 | 421718 | 23926 |
| ABLIM2 | 163995 | 515079 | 194 | N/A | |
| ABLIM2 | 163995 | 502800 | 195 | N/A | |
| ABLIM2 | 163995 | 545242 | 196 | 441255 | 23927 |
| ABLIM3 | 173210 | 326685 | 197 | 315841 | 23928 |
| ABLIM3 | 173210 | 309868 | 198 | 310309 | 23929 |
| ABLIM3 | 173210 | 506113 | 199 | 425394 | 23930 |
| ABLIM3 | 173210 | 515171 | 200 | 421002 | 23931 |
| ABLIM3 | 173210 | 504238 | 201 | 421183 | 23932 |
| ABLIM3 | 173210 | 508983 | 202 | 420855 | 23933 |
| ABLIM3 | 173210 | 515796 | 203 | N/A | |
| ABLIM3 | 173210 | 514212 | 204 | N/A | |
| ABLIM3 | 173210 | 519549 | 205 | N/A | |
| ABLIM3 | 173210 | 517451 | 206 | 430150 | 23934 |
| ABLIM3 | 173210 | 502855 | 207 | N/A | |

-continued

| Symbol | ENSG | ENST | SEQ ID | ENSP | SEQ ID |
|--------|------|------|--------|------|--------|
| ABLIM3 | 173210 | 356541 | 208 | 348938 | 23935 |
| ABRA | 174429 | 311955 | 209 | 311436 | 23936 |
| ABTB2 | 166016 | 435224 | 210 | 410157 | 23937 |
| ABTB2 | 166016 | 530814 | 211 | N/A | |
| ACAD8 | 151498 | 281182 | 212 | 281182 | 23938 |
| ACAD8 | 151498 | 526026 | 213 | 431532 | 23939 |
| ACAD8 | 151498 | 524426 | 214 | 431310 | 23940 |
| ACAD8 | 151498 | 534433 | 215 | N/A | |
| ACAD8 | 151498 | 374752 | 216 | 363884 | 23941 |
| ACAD8 | 151498 | 525961 | 217 | N/A | |
| ACAD8 | 151498 | 530533 | 218 | N/A | |
| ACAD8 | 151498 | 534240 | 219 | N/A | |
| ACAD8 | 151498 | 533387 | 220 | N/A | |
| ACAD8 | 151498 | 527082 | 221 | N/A | |
| ACAD8 | 151498 | 524547 | 222 | N/A | |
| ACAD8 | 151498 | 531338 | 223 | N/A | |
| ACAD8 | 151498 | 528325 | 224 | N/A | |
| ACAD8 | 151498 | 527665 | 225 | N/A | |
| ACAD8 | 151498 | 527713 | 226 | N/A | |
| ACAD8 | 151498 | 524739 | 227 | N/A | |
| ACAD8 | 151498 | 524502 | 228 | N/A | |
| ACAP3 | 131584 | 354700 | 229 | 346733 | 23942 |
| ACAP3 | 131584 | 492936 | 230 | N/A | |
| ACAP3 | 131584 | 467278 | 231 | N/A | |
| ACAP3 | 131584 | 470659 | 232 | N/A | |
| ACAP3 | 131584 | 379037 | 233 | N/A | |
| ACAP3 | 131584 | 476572 | 234 | N/A | |
| ACAP3 | 131584 | 493992 | 235 | N/A | |
| ACAP3 | 131584 | 472541 | 236 | N/A | |
| ACAP3 | 131584 | 354980 | 237 | 347075 | 23943 |
| ACAP3 | 131584 | 478065 | 238 | N/A | |
| ACAP3 | 131584 | 479108 | 239 | N/A | |
| ACAP3 | 131584 | 438966 | 240 | N/A | |
| ACAP3 | 131584 | 353662 | 241 | 321139 | 23944 |
| ACE | 159640 | 583336 | 242 | N/A | |
| ACE | 159640 | 584529 | 243 | N/A | |
| ACE | 159640 | 582678 | 244 | 462995 | 23945 |
| ACE | 159640 | 579462 | 245 | N/A | |
| ACE | 159640 | 290866 | 246 | 290866 | 23946 |
| ACE | 159640 | 582627 | 247 | 462280 | 23947 |
| ACE | 159640 | 580318 | 248 | N/A | |
| ACE | 159640 | 579726 | 249 | 463673 | 23948 |
| ACE | 159640 | 290863 | 250 | 290863 | 23949 |
| ACE | 159640 | 582005 | 251 | 462002 | 23950 |
| ACE | 159640 | 578839 | 252 | 462110 | 23951 |
| ACE | 159640 | 413513 | 253 | 392247 | 23952 |
| ACE | 159640 | 579314 | 254 | 462599 | 23953 |
| ACE | 159640 | 579204 | 255 | 464629 | 23954 |
| ACE | 159640 | 584865 | 256 | N/A | |
| ACE | 159640 | 582761 | 257 | 462909 | 23955 |
| ACE | 159640 | 577418 | 258 | N/A | |
| ACE | 159640 | 583645 | 259 | N/A | |
| ACE | 159640 | 578679 | 260 | N/A | |
| ACE | 159640 | 579409 | 261 | 464428 | 23956 |
| ACE | 159640 | 582244 | 262 | N/A | |
| ACE | 159640 | 428043 | 263 | 397593 | 23957 |
| ACER3 | 078124 | 534206 | 264 | 435733 | 23958 |
| ACER3 | 078124 | 532485 | 265 | 434480 | 23959 |
| ACER3 | 078124 | 530182 | 266 | N/A | |
| ACER3 | 078124 | 525194 | 267 | 432109 | 23960 |
| ACER3 | 078124 | 525861 | 268 | 432379 | 23961 |
| ACER3 | 078124 | 531461 | 269 | 433368 | 23962 |
| ACER3 | 078124 | 530334 | 270 | 435048 | 23963 |
| ACER3 | 078124 | 526597 | 271 | 431149 | 23964 |
| ACER3 | 078124 | 533873 | 272 | 436252 | 23965 |
| ACER3 | 078124 | 531352 | 273 | 431504 | 23966 |
| ACER3 | 078124 | 278544 | 274 | 278544 | 23967 |
| ACER3 | 078124 | 527508 | 275 | N/A | |
| ACER3 | 078124 | 525325 | 276 | N/A | |
| ACER3 | 078124 | 530921 | 277 | N/A | |
| ACHE | 087085 | 419336 | 278 | 403474 | 23968 |
| ACHE | 087085 | 241069 | 279 | 241069 | 23969 |
| ACHE | 087085 | 428317 | 280 | 414858 | 23970 |
| ACHE | 087085 | 412389 | 281 | 394976 | 23971 |
| ACHE | 087085 | 426415 | 282 | 397143 | 23972 |
| ACHE | 087085 | 454485 | 283 | 390004 | 23973 |

-continued

| Symbol | ENSG | ENST | SEQ ID | ENSP | SEQ ID |
|---|---|---|---|---|---|
| ACHE | 087085 | 440755 | 284 | 410380 | 23974 |
| ACHE | 087085 | 430554 | 285 | 399725 | 23975 |
| ACHE | 087085 | 442452 | 286 | 415901 | 23976 |
| ACHE | 087085 | 411582 | 287 | 404865 | 23977 |
| ACHE | 087085 | 441605 | 288 | 396360 | 23978 |
| ACHE | 087085 | 445236 | 289 | 400933 | 23979 |
| ACHE | 087085 | 619863 | 290 | N/A | |
| ACHE | 087085 | 302913 | 291 | 303211 | 23980 |
| ACO2 | 100412 | 216254 | 292 | 216254 | 23981 |
| ACO2 | 100412 | 396512 | 293 | 379769 | 23982 |
| ACO2 | 100412 | 471094 | 294 | N/A | |
| ACO2 | 100412 | 482208 | 295 | N/A | |
| ACO2 | 100412 | 478010 | 296 | N/A | |
| ACO2 | 100412 | 481310 | 297 | N/A | |
| ACO2 | 100412 | 466237 | 298 | N/A | |
| ACOT11 | 162390 | 481208 | 299 | N/A | |
| ACOT11 | 162390 | 498228 | 300 | N/A | |
| ACOT11 | 162390 | 343744 | 301 | 340260 | 23983 |
| ACOT11 | 162390 | 371316 | 302 | 360366 | 23984 |
| ACOT11 | 162390 | 479837 | 303 | N/A | |
| ACOT7 | 097021 | 608083 | 304 | 476610 | 23985 |
| ACOT7 | 097021 | 377842 | 305 | 367073 | 23986 |
| ACOT7 | 097021 | 377845 | 306 | 367076 | 23987 |
| ACOT7 | 097021 | 377855 | 307 | 367086 | 23988 |
| ACOT7 | 097021 | 377860 | 308 | 367091 | 23989 |
| ACOT7 | 097021 | 418124 | 309 | 402532 | 23990 |
| ACOT7 | 097021 | 361521 | 310 | 354615 | 23991 |
| ACOT7 | 097021 | 473466 | 311 | 465719 | 23992 |
| ACOT7 | 097021 | 481175 | 312 | N/A | |
| ACOT7 | 097021 | 545482 | 313 | 439218 | 23993 |
| ACSBG1 | 103740 | 258873 | 314 | 258873 | 23994 |
| ACSBG1 | 103740 | 560124 | 315 | 453605 | 23995 |
| ACSBG1 | 103740 | 560817 | 316 | 453451 | 23996 |
| ACSBG1 | 103740 | 560183 | 317 | N/A | |
| ACSBG1 | 103740 | 558301 | 318 | N/A | |
| ACSBG1 | 103740 | 559707 | 319 | 453447 | 23997 |
| ACSBG1 | 103740 | 558728 | 320 | N/A | |
| ACSBG1 | 103740 | 557935 | 321 | 453585 | 23998 |
| ACSBG1 | 103740 | 559114 | 322 | 454188 | 23999 |
| ACSBG1 | 103740 | 559241 | 323 | 453547 | 24000 |
| ACSBG1 | 103740 | 558130 | 324 | 453800 | 24001 |
| ACSBG1 | 103740 | 558828 | 325 | N/A | |
| ACSBG1 | 103740 | 558793 | 326 | N/A | |
| ACSBG1 | 103740 | 559713 | 327 | N/A | |
| ACSM5 | 183549 | 575584 | 328 | 460112 | 24002 |
| ACSM5 | 183549 | 331849 | 329 | 327916 | 24003 |
| ACSM5 | 183549 | 575070 | 330 | 478073 | 24004 |
| ACSM5 | 183549 | 570305 | 331 | N/A | |
| ACSM5 | 183549 | 574748 | 332 | N/A | |
| ACSM5 | 183549 | 573920 | 333 | 461752 | 24005 |
| ACSM5 | 183549 | 577024 | 334 | N/A | |
| ACSS1 | 154930 | 484396 | 335 | N/A | |
| ACSS1 | 154930 | 323482 | 336 | 316924 | 24006 |
| ACSS1 | 154930 | 376726 | 337 | 365916 | 24007 |
| ACSS1 | 154930 | 432802 | 338 | 388793 | 24008 |
| ACSS1 | 154930 | 537502 | 339 | 439304 | 24009 |
| ACSS3 | 111058 | 616449 | 340 | N/A | |
| ACSS3 | 111058 | 549175 | 341 | 447748 | 24010 |
| ACSS3 | 111058 | 548058 | 342 | 449535 | 24011 |
| ACSS3 | 111058 | 261206 | 343 | 261206 | 24012 |
| ACSS3 | 111058 | 548387 | 344 | N/A | |
| ACSS3 | 111058 | 548324 | 345 | N/A | |
| ACSS3 | 111058 | 551745 | 346 | N/A | |
| ACSS3 | 111058 | 546664 | 347 | 449507 | 24013 |
| ACTB | 075624 | 464611 | 348 | N/A | |
| ACTB | 075624 | 331789 | 349 | 349960 | 24014 |
| ACTB | 075624 | 425660 | 350 | 409264 | 24015 |
| ACTB | 075624 | 462494 | 351 | N/A | |
| ACTB | 075624 | 493945 | 352 | N/A | |
| ACTB | 075624 | 484841 | 353 | N/A | |
| ACTB | 075624 | 473257 | 354 | N/A | |
| ACTB | 075624 | 477812 | 355 | N/A | |
| ACTB | 075624 | 432588 | 356 | 407473 | 24016 |
| ACTB | 075624 | 480301 | 357 | N/A | |
| ACTB | 075624 | 443528 | 358 | 393951 | 24017 |
| ACTB | 075624 | 417101 | 359 | 399487 | 24018 |

-continued

| Symbol | ENSG | ENST | SEQ ID | ENSP | SEQ ID |
|---|---|---|---|---|---|
| ACTB | 075624 | 414620 | 360 | 401032 | 24019 |
| ACIBL2 | 169067 | 423391 | 361 | 416706 | 24020 |
| ACTC1 | 159251 | 290378 | 362 | 290378 | 24021 |
| ACTC1 | 159251 | 557860 | 363 | N/A | |
| ACTC1 | 159251 | 560563 | 364 | N/A | |
| ACTL6B | 077080 | 160382 | 365 | 160382 | 24022 |
| ACTL6B | 077080 | 487125 | 366 | N/A | |
| ACTL6B | 077080 | 485601 | 367 | N/A | |
| ACTL6B | 077080 | 487225 | 368 | N/A | |
| ACTL6B | 077080 | 489904 | 369 | N/A | |
| ACTL6B | 077080 | 461605 | 370 | 420151 | 24023 |
| ACTN2 | 077522 | 366578 | 371 | 355537 | 24024 |
| ACTN2 | 077522 | 492634 | 372 | N/A | |
| ACTN2 | 077522 | 494762 | 373 | N/A | |
| ACTN2 | 077522 | 492101 | 374 | N/A | |
| ACTN2 | 077522 | 461367 | 375 | N/A | |
| ACTN2 | 077522 | 546208 | 376 | 438384 | 24025 |
| ACTN2 | 077522 | 542672 | 377 | 443495 | 24026 |
| ACTR3B | 133627 | 377776 | 378 | 367007 | 24027 |
| ACTR3B | 133627 | 256001 | 379 | 256001 | 24028 |
| ACTR3B | 133627 | 397282 | 380 | 380452 | 24029 |
| ACTR3B | 133627 | 488782 | 381 | N/A | |
| ACTR3B | 133627 | 479402 | 382 | N/A | |
| ADAM11 | 073670 | 200557 | 383 | 200557 | 24030 |
| ADAM11 | 073670 | 355638 | 384 | 347856 | 24031 |
| ADAM11 | 073670 | 535346 | 385 | 443773 | 24032 |
| ADAM11 | 073670 | 587773 | 386 | 465537 | 24033 |
| ADAM11 | 073670 | 588363 | 387 | N/A | |
| ADAM12 | 148848 | 368679 | 388 | 357668 | 24034 |
| ADAM12 | 148848 | 368676 | 389 | 357665 | 24035 |
| ADAM12 | 148848 | 467145 | 390 | N/A | |
| ADAM12 | 148848 | 482291 | 391 | N/A | |
| ADAM12 | 148848 | 485388 | 392 | N/A | |
| ADAM12 | 148848 | 448723 | 393 | 391268 | 24036 |
| ADAM12 | 148848 | 494661 | 394 | N/A | |
| ADAM19 | 135074 | 517951 | 395 | 428376 | 24037 |
| ADAM19 | 135074 | 517374 | 396 | 431027 | 24038 |
| ADAM19 | 135074 | 257527 | 397 | 257527 | 24039 |
| ADAM19 | 135074 | 517905 | 398 | 428654 | 24040 |
| ADAM19 | 135074 | 519752 | 399 | N/A | |
| ADAMTS10 | 142303 | 595838 | 400 | 470501 | 24041 |
| ADAMTS10 | 142303 | 593913 | 401 | 469901 | 24042 |
| ADAMTS10 | 142303 | 597188 | 402 | 471851 | 24043 |
| ADAMTS10 | 142303 | 596851 | 403 | 469559 | 24044 |
| ADAMTS10 | 142303 | 596911 | 404 | N/A | |
| ADAMTS10 | 142303 | 593826 | 405 | 469516 | 24045 |
| ADAMTS10 | 142303 | 596236 | 406 | N/A | |
| ADAMTS10 | 142303 | 603221 | 407 | N/A | |
| ADAMTS10 | 142303 | 601163 | 408 | N/A | |
| ADAMTS10 | 142303 | 601872 | 409 | N/A | |
| ADAMTS10 | 142303 | 596709 | 410 | N/A | |
| ADAMTS10 | 142303 | 596466 | 411 | N/A | |
| ADAMTS10 | 142303 | 593534 | 412 | N/A | |
| ADAMTS10 | 142303 | 270328 | 413 | 270328 | 24046 |
| ADAMTS15 | 166106 | 299164 | 414 | 299164 | 24047 |
| ADAMTS16 | 145536 | 511368 | 415 | 421631 | 24048 |
| ADAMTS16 | 145536 | 274181 | 416 | 274181 | 24049 |
| ADAMTS16 | 145536 | 433402 | 417 | N/A | |
| ADAMTS16 | 145536 | 513709 | 418 | N/A | |
| ADAMTS17 | 140470 | 268070 | 419 | 268070 | 24050 |
| ADAMTS17 | 140470 | 557896 | 420 | N/A | |
| ADAMTS17 | 140470 | 568565 | 421 | 456161 | 24051 |
| ADAMTS17 | 140470 | 378898 | 422 | N/A | |
| ADAMTS17 | 140470 | 559976 | 423 | N/A | |
| ADAMTS17 | 140470 | 560486 | 424 | N/A | |
| ADAMTS17 | 140470 | 558960 | 425 | 453604 | 24052 |
| ADAMTS17 | 140470 | 561355 | 426 | 458005 | 24053 |
| ADAMTS17 | 140470 | 558930 | 427 | N/A | |
| ADAMTS18 | 140873 | 562332 | 428 | 454368 | 24054 |
| ADAMTS18 | 140873 | 282849 | 429 | 282849 | 24055 |
| ADAMTS18 | 140873 | 568393 | 430 | N/A | |
| ADAMTS18 | 140873 | 449265 | 431 | 392540 | 24056 |
| ADAMTS18 | 140873 | 562345 | 432 | 457395 | 24057 |
| ADAMTS18 | 140873 | 567914 | 433 | N/A | |
| ADAMTS18 | 140873 | 567121 | 434 | N/A | |
| ADAMTS18 | 140873 | 564369 | 435 | N/A | |

| Symbol | ENSG | ENST | SEQ ID | ENSP | SEQ ID |
|---|---|---|---|---|---|
| ADAMTS18 | 140873 | 569309 | 436 | N/A | |
| ADAMTS2 | 087116 | 251582 | 437 | 251582 | 24058 |
| ADAMTS2 | 087116 | 522937 | 438 | N/A | |
| ADAMTS2 | 087116 | 523450 | 439 | N/A | |
| ADAMTS2 | 087116 | 518335 | 440 | 489888 | 24059 |
| ADAMTS2 | 087116 | 274609 | 441 | 274609 | 24060 |
| ADAMTS2 | 283802 | 639986 | 442 | 492346 | 24061 |
| ADAMTS2 | 283802 | 639510 | 443 | N/A | |
| ADAMTS2 | 283802 | 639035 | 444 | N/A | |
| ADAMTS2 | 283802 | 638226 | 445 | 491140 | 24062 |
| ADAMTS2 | 283802 | 639107 | 446 | 492365 | 24063 |
| ADAMTS6 | 049192 | 381055 | 447 | 370443 | 24064 |
| ADAMTS6 | 049192 | 381052 | 448 | 424377 | 24065 |
| ADAMTS6 | 049192 | 314351 | 449 | N/A | |
| ADAMTS6 | 049192 | 417396 | 450 | N/A | |
| ADAMTS6 | 049192 | 470597 | 451 | N/A | |
| ADAMTS6 | 049192 | 464680 | 452 | N/A | |
| ADAMTS6 | 049192 | 504282 | 453 | N/A | |
| ADAMTS6 | 049192 | 502886 | 454 | N/A | |
| ADAMTS7 | 136378 | 388820 | 455 | 373472 | 24066 |
| ADAMTS7 | 136378 | 569934 | 456 | N/A | |
| ADAMTS7 | 136378 | 566303 | 457 | N/A | |
| ADAMTS7 | 136378 | 565793 | 458 | N/A | |
| ADAMTS7 | 136378 | 568712 | 459 | N/A | |
| ADAMTS9 | 163638 | 498707 | 460 | 418735 | 24067 |
| ADAMTS9 | 163638 | 477180 | 461 | N/A | |
| ADAMTS9 | 163638 | 295903 | 462 | 295903 | 24068 |
| ADAMTS9 | 163638 | 467257 | 463 | 478086 | 24069 |
| ADAMTS9 | 163638 | 481060 | 464 | 417521 | 24070 |
| ADAMTS9 | 163638 | 482490 | 465 | N/A | |
| ADAMTS9 | 163638 | 475557 | 466 | N/A | |
| ADAMTS9 | 163638 | 459780 | 467 | 419217 | 24071 |
| ADAMTS9 | 163638 | 467119 | 468 | N/A | |
| ADAMTS9 | 163638 | 494004 | 469 | N/A | |
| ADAMTSL3 | 156218 | 286744 | 470 | 286744 | 24072 |
| ADAMTSL3 | 156218 | 567476 | 471 | 456313 | 24073 |
| ADAMTSL3 | 156218 | 569510 | 472 | N/A | |
| ADAMTSL3 | 156218 | 561483 | 473 | N/A | |
| ADAMTSL3 | 156218 | 565653 | 474 | N/A | |
| ADAMTSL3 | 156218 | 567663 | 475 | N/A | |
| ADAMTSL3 | 156218 | 562296 | 476 | N/A | |
| ADAMTSL3 | 156218 | 567716 | 477 | N/A | |
| ADAMTSL4 | 143382 | 369041 | 478 | 358037 | 24074 |
| ADAMTSL4 | 143382 | 483335 | 479 | N/A | |
| ADAMTSL4 | 143382 | 369038 | 480 | 358034 | 24075 |
| ADAMTSL4 | 143382 | 489159 | 481 | N/A | |
| ADAMTSL4 | 143382 | 369039 | 482 | 358035 | 24076 |
| ADAMTSL4 | 143382 | 271643 | 483 | 271643 | 24077 |
| ADARB1 | 197381 | 462214 | 484 | N/A | |
| ADARB1 | 197381 | 460734 | 485 | N/A | |
| ADARB1 | 197381 | 389861 | 486 | N/A | |
| ADARB1 | 197381 | 492414 | 487 | 436367 | 24078 |
| ADARB1 | 197381 | 496664 | 488 | 435381 | 24079 |
| ADARB1 | 197381 | 389863 | 489 | 374513 | 24080 |
| ADARB1 | 197381 | 348831 | 490 | 015877 | 24081 |
| ADARB1 | 197381 | 449478 | 491 | 387480 | 24082 |
| ADARB1 | 197381 | 464215 | 492 | N/A | |
| ADARB1 | 197381 | 360697 | 493 | 353920 | 24083 |
| ADARB1 | 197381 | 481022 | 494 | N/A | |
| ADARB1 | 197381 | 631642 | 495 | N/A | |
| ADARB1 | 197381 | 437626 | 496 | 414600 | 24084 |
| ADARB1 | 197381 | 611195 | 497 | 478160 | 24085 |
| ADARB1 | 197381 | 629643 | 498 | 486475 | 24086 |
| ADARB2 | 185736 | 381312 | 499 | 370713 | 24087 |
| ADARB2 | 185736 | 381310 | 500 | 370711 | 24088 |
| ADARB2 | 185736 | 474762 | 501 | N/A | |
| ADARB2 | 185736 | 490172 | 502 | N/A | |
| ADARB2 | 185736 | 381305 | 503 | 370706 | 24089 |
| ADARB2 | 185736 | 477140 | 504 | N/A | |
| ADARB2 | 185736 | 469464 | 505 | N/A | |
| ADCY1 | 164742 | 432715 | 506 | 392721 | 24090 |
| ADCY1 | 164742 | 297323 | 507 | 297323 | 24091 |
| ADCY1 | 164742 | 468353 | 508 | N/A | |
| ADCY1 | 164742 | 621543 | 509 | 479770 | 24092 |
| ADCYAP1R1 | 078549 | 304166 | 510 | 306620 | 24093 |
| ADCYAP1R1 | 078549 | 409363 | 511 | 387335 | 24094 |

| Symbol | ENSG | ENST | SEQ ID | ENSP | SEQ ID |
|---|---|---|---|---|---|
| ADCYAP1R1 | 078549 | 431811 | 512 | 400893 | 24095 |
| ADCYAP1R1 | 078549 | 396211 | 513 | 379514 | 24096 |
| ADCYAP1R1 | 078549 | 409489 | 514 | 386395 | 24097 |
| ADCYAP1R1 | 078549 | 436116 | 515 | 416622 | 24098 |
| ADCYAP1R1 | 078549 | 614107 | 516 | 483721 | 24099 |
| ADD2 | 075340 | 403045 | 517 | 384303 | 24100 |
| ADD2 | 075340 | 264436 | 518 | 264436 | 24101 |
| ADD2 | 075340 | 407644 | 519 | 384677 | 24102 |
| ADD2 | 075340 | 355733 | 520 | 347972 | 24103 |
| ADD2 | 075340 | 481675 | 521 | N/A | |
| ADD2 | 075340 | 522886 | 522 | 430243 | 24104 |
| ADD2 | 075340 | 456320 | 523 | 414546 | 24105 |
| ADD2 | 075340 | 413157 | 524 | 388072 | 24106 |
| ADD2 | 075340 | 430656 | 525 | 398112 | 24107 |
| ADD2 | 075340 | 415348 | 526 | 412357 | 24108 |
| ADD2 | 075340 | 425976 | 527 | 412681 | 24109 |
| ADD2 | 075340 | 447731 | 528 | 403722 | 24110 |
| ADD2 | 075340 | 473232 | 529 | N/A | |
| ADD2 | 075340 | 496178 | 530 | N/A | |
| ADGRA1 | 197177 | 607359 | 531 | 475778 | 24111 |
| ADGRA1 | 197177 | 392607 | 532 | 376384 | 24112 |
| ADGRA1 | 197177 | 392606 | 533 | 376383 | 24113 |
| ADGRA3 | 152990 | 511051 | 534 | 424927 | 24114 |
| ADGRA3 | 152990 | 334304 | 535 | 334952 | 24115 |
| ADGRA3 | 152990 | 499527 | 536 | N/A | |
| ADGRA3 | 152990 | 282943 | 537 | N/A | |
| ADGRA3 | 152990 | 504617 | 538 | N/A | |
| ADGRA3 | 152990 | 506155 | 539 | N/A | |
| ADGRA3 | 152990 | 508133 | 540 | 422606 | 24116 |
| ADGRA3 | 152990 | 502482 | 541 | 421006 | 24117 |
| ADGRA3 | 152990 | 514129 | 542 | 425223 | 24118 |
| ADGRA3 | 152990 | 506133 | 543 | N/A | |
| ADGRA3 | 152990 | 513385 | 544 | N/A | |
| ADGRA3 | 152990 | 514749 | 545 | N/A | |
| ADGRA3 | 152990 | 506346 | 546 | N/A | |
| ADGRG1 | 205336 | 565587 | 547 | 456781 | 24119 |
| ADGRG1 | 205336 | 568791 | 548 | 454321 | 24120 |
| ADGRG1 | 205336 | 570044 | 549 | 456166 | 24121 |
| ADGRG1 | 205336 | 567553 | 550 | 455812 | 24122 |
| ADGRG1 | 205336 | 565314 | 551 | 456469 | 24123 |
| ADGRG1 | 205336 | 564912 | 552 | N/A | |
| ADGRG1 | 205336 | 562673 | 553 | N/A | |
| ADGRG1 | 205336 | 564907 | 554 | 455245 | 24124 |
| ADGRG1 | 205336 | 568908 | 555 | 457456 | 24125 |
| ADGRG1 | 205336 | 568909 | 556 | 455215 | 24126 |
| ADGRG1 | 205336 | 566778 | 557 | 456796 | 24127 |
| ADGRG1 | 205336 | 562101 | 558 | N/A | |
| ADGRG1 | 205336 | 561872 | 559 | N/A | |
| ADGRG1 | 205336 | 561988 | 560 | 456238 | 24128 |
| ADGRG1 | 205336 | 567835 | 561 | 456794 | 24129 |
| ADGRG1 | 205336 | 569372 | 562 | 457979 | 24130 |
| ADGRG1 | 205336 | 563548 | 563 | 454263 | 24131 |
| ADGRG1 | 205336 | 562003 | 564 | 454607 | 24132 |
| ADGRG1 | 205336 | 561833 | 565 | 458063 | 24133 |
| ADGRG1 | 205336 | 569531 | 566 | 457307 | 24134 |
| ADGRG1 | 205336 | 565013 | 567 | 454364 | 24135 |
| ADGRG1 | 205336 | 561696 | 568 | 455600 | 24136 |
| ADGRG1 | 205336 | 562414 | 569 | 456494 | 24137 |
| ADGRG1 | 205336 | 561969 | 570 | 456002 | 24138 |
| ADGRG1 | 205336 | 568487 | 571 | N/A | |
| ADGRG1 | 205336 | 562631 | 572 | 455351 | 24139 |
| ADGRG1 | 205336 | 563445 | 573 | 457073 | 24140 |
| ADGRG1 | 205336 | 562608 | 574 | N/A | |
| ADGRG1 | 205336 | 565338 | 575 | 457122 | 24141 |
| ADGRG1 | 205336 | 567702 | 576 | 456787 | 24142 |
| ADGRG1 | 205336 | 567154 | 577 | 456632 | 24143 |
| ADGRG1 | 205336 | 388813 | 578 | 373465 | 24144 |
| ADGRG1 | 205336 | 563007 | 579 | 454574 | 24145 |
| ADGRG1 | 205336 | 562558 | 580 | 456620 | 24146 |
| ADGRG1 | 205336 | 566271 | 581 | 454855 | 24147 |
| ADGRG1 | 205336 | 568645 | 582 | 454879 | 24148 |
| ADGRG1 | 205336 | 563374 | 583 | 455209 | 24149 |
| ADGRG1 | 205336 | 568234 | 584 | 458014 | 24150 |
| ADGRG1 | 205336 | 565770 | 585 | 456603 | 24151 |
| ADGRG1 | 205336 | 564338 | 586 | 457657 | 24152 |
| ADGRG1 | 205336 | 566164 | 587 | 455074 | 24153 |

-continued

-continued

| Symbol | ENSG | ENST | SEQ ID | ENSP | SEQ ID | Symbol | ENSG | ENST | SEQ ID | ENSP | SEQ ID |
|---|---|---|---|---|---|---|---|---|---|---|---|
| ADGRG1 | 205336 | 567397 | 588 | 455226 | 24154 | ADGRV1 | 164199 | 638975 | 664 | 492630 | 24207 |
| ADGRG1 | 205336 | 568979 | 589 | 455553 | 24155 | ADGRV1 | 164199 | 640407 | 665 | 491425 | 24208 |
| ADGRG1 | 205336 | 569992 | 590 | N/A | | ADGRV1 | 164199 | 638585 | 666 | N/A | |
| ADGRG1 | 205336 | 566123 | 591 | 457143 | 24156 | ADGRV1 | 164199 | 507314 | 667 | 491299 | 24209 |
| ADGRG1 | 205336 | 562682 | 592 | 456819 | 24157 | ADGRV1 | 164199 | 513828 | 668 | N/A | |
| ADGRG1 | 205336 | 561782 | 593 | 455176 | 24158 | ADGRV1 | 164199 | 640061 | 669 | N/A | |
| ADGRG1 | 205336 | 564783 | 594 | 454490 | 24159 | ADGRV1 | 164199 | 638990 | 670 | 492781 | 24210 |
| ADGRG1 | 205336 | 564729 | 595 | 455965 | 24160 | ADGRV1 | 164199 | 505845 | 671 | N/A | |
| ADGRG1 | 205336 | 565976 | 596 | 454933 | 24161 | ADGRV1 | 164199 | 640815 | 672 | 491767 | 24211 |
| ADGRG1 | 205336 | 566888 | 597 | N/A | | ADGRV1 | 164199 | 639821 | 673 | 492216 | 24212 |
| ADGRG1 | 205336 | 562804 | 598 | N/A | | ADGRV1 | 164199 | 639707 | 674 | 492328 | 24213 |
| ADGRG1 | 205336 | 566508 | 599 | 454779 | 24162 | ADGRV1 | 164199 | 640369 | 675 | 491401 | 24214 |
| ADGRG1 | 205336 | 565539 | 600 | 457612 | 24163 | ADGRV1 | 164199 | 640256 | 676 | N/A | |
| ADGRG1 | 205336 | 567915 | 601 | 457063 | 24164 | ADGRV1 | 164199 | 639530 | 677 | N/A | |
| ADGRG1 | 205336 | 569132 | 602 | N/A | | ADGRV1 | 164199 | 639212 | 678 | N/A | |
| ADGRG1 | 205336 | 564103 | 603 | 457994 | 24165 | ADM | 148926 | 278175 | 679 | 278175 | 24215 |
| ADGRG1 | 205336 | 562467 | 604 | 456256 | 24166 | ADM | 148926 | 534464 | 680 | 431438 | 24216 |
| ADGRG1 | 205336 | 568700 | 605 | N/A | | ADM | 148926 | 530439 | 681 | 436837 | 24217 |
| ADGRG1 | 205336 | 540164 | 606 | 444911 | 24167 | ADM | 148926 | 524948 | 682 | 433062 | 24218 |
| ADGRG1 | 205336 | 568531 | 607 | 456682 | 24168 | ADM | 148926 | 528655 | 683 | 436607 | 24219 |
| ADGRG1 | 205336 | 564360 | 608 | 457223 | 24169 | ADM | 148926 | 526492 | 684 | 434354 | 24220 |
| ADGRG1 | 205336 | 568074 | 609 | 458087 | 24170 | ADM | 148926 | 525063 | 685 | 435124 | 24221 |
| ADGRG1 | 205336 | 563414 | 610 | 456147 | 24171 | ADM | 148926 | 528544 | 686 | 434749 | 24222 |
| ADGRG1 | 205336 | 568618 | 611 | 454233 | 24172 | ADORA1 | 163485 | 309502 | 687 | 308549 | 24223 |
| ADGRG1 | 205336 | 569494 | 612 | 456362 | 24173 | ADORA1 | 163485 | 367236 | 688 | 356205 | 24224 |
| ADGRG1 | 205336 | 566169 | 613 | 456263 | 24174 | ADORA1 | 163485 | 367235 | 689 | 356204 | 24225 |
| ADGRG1 | 205336 | 568157 | 614 | 454289 | 24175 | ADORA1 | 163485 | 464019 | 690 | N/A | |
| ADGRG1 | 205336 | 569154 | 615 | 456544 | 24176 | ADORA1 | 163485 | 472535 | 691 | N/A | |
| ADGRG1 | 205336 | 569101 | 616 | 457953 | 24177 | ADORA1 | 163485 | 467253 | 692 | N/A | |
| ADGRG1 | 205336 | 563862 | 617 | 457806 | 24178 | ADORA1 | 163485 | 337894 | 693 | 338435 | 24226 |
| ADGRG1 | 205336 | 564722 | 618 | 456599 | 24179 | ADORA1 | 163485 | 640524 | 694 | 491900 | 24227 |
| ADGRG1 | 205336 | 569158 | 619 | 457635 | 24180 | ADORA1 | 163485 | 618295 | 695 | 483953 | 24228 |
| ADGRG1 | 205336 | 566187 | 620 | 457178 | 24181 | ADORA2B | 170425 | 304222 | 696 | 304501 | 24229 |
| ADGRG1 | 205336 | 565505 | 621 | N/A | | ADORA2B | 170425 | 582124 | 697 | N/A | |
| ADGRG1 | 205336 | 565391 | 622 | 456731 | 24182 | ADRA1A | 120907 | 380586 | 698 | 369960 | 24230 |
| ADGRG1 | 205336 | 456916 | 623 | 398034 | 24183 | ADRA1A | 120907 | 519096 | 699 | 431073 | 24231 |
| ADGRL3 | 150471 | 512091 | 624 | 423388 | 24184 | ADRA1A | 120907 | 380582 | 700 | 369956 | 24232 |
| ADGRL3 | 150471 | 509779 | 625 | N/A | | ADRA1A | 120907 | 521711 | 701 | 430414 | 24233 |
| ADGRL3 | 150471 | 514591 | 626 | 422533 | 24185 | ADRA1A | 120907 | 519229 | 702 | 430793 | 24234 |
| ADGRL3 | 150471 | 509896 | 627 | 423787 | 24186 | ADRA1A | 120907 | 354550 | 703 | 346557 | 24235 |
| ADGRL3 | 150471 | 511324 | 628 | 425033 | 24187 | ADRA1A | 120907 | 276393 | 704 | 276393 | 24236 |
| ADGRL3 | 150471 | 506700 | 629 | 424120 | 24188 | ADRA1A | 120907 | 380573 | 705 | 369947 | 24237 |
| ADGRL3 | 150471 | 507164 | 630 | 421476 | 24189 | ADRA1A | 120907 | 518621 | 706 | N/A | |
| ADGRL3 | 150471 | 508693 | 631 | 424030 | 24190 | ADRA1A | 120907 | 380572 | 707 | 369946 | 24238 |
| ADGRL3 | 150471 | 507625 | 632 | 421372 | 24191 | ADRA1A | 120907 | 518810 | 708 | N/A | |
| ADGRL3 | 150471 | 514157 | 633 | 425201 | 24192 | ADRA1B | 170214 | 641205 | 709 | 493019 | 24239 |
| ADGRL3 | 150471 | 504896 | 634 | 423434 | 24193 | ADRA1B | 170214 | 641475 | 710 | N/A | |
| ADGRL3 | 150471 | 508946 | 635 | 421627 | 24194 | ADRA1B | 170214 | 306675 | 711 | 306662 | 24240 |
| ADGRL3 | 150471 | 506720 | 636 | 420931 | 24195 | ADRA1D | 171873 | 379453 | 712 | 368766 | 24241 |
| ADGRL3 | 150471 | 506746 | 637 | 425884 | 24196 | ADRA1D | 171873 | 621688 | 713 | N/A | |
| ADGRL3 | 150471 | 514996 | 638 | 424258 | 24197 | ADRA2B | 274286 | 620793 | 714 | 480573 | 24242 |
| ADGRL3 | 150471 | 509089 | 639 | N/A | | ADRB2 | 169252 | 305984 | 715 | 305372 | 24243 |
| ADGRL3 | 150471 | 502815 | 640 | 424402 | 24198 | KIAA1024 | 169330 | 305428 | 716 | 307461 | 24244 |
| ADGRL3 | 150471 | 508078 | 641 | N/A | | KIAA1024 | 169330 | 559272 | 717 | 454088 | 24245 |
| ADGRV1 | 164199 | 508842 | 642 | 425936 | 24199 | AFAP1 | 196526 | 360265 | 718 | 353402 | 24246 |
| ADGRV1 | 164199 | 638316 | 643 | N/A | | AFAP1 | 196526 | 505447 | 719 | N/A | |
| ADGRV1 | 164199 | 405460 | 644 | 384582 | 24200 | AFAP1 | 196526 | 513842 | 720 | N/A | |
| ADGRV1 | 164199 | 640109 | 645 | N/A | | AFAP1 | 196526 | 382543 | 721 | 371983 | 24247 |
| ADGRV1 | 164199 | 640281 | 646 | N/A | | AFAP1 | 196526 | 508415 | 722 | N/A | |
| ADGRV1 | 164199 | 638638 | 647 | N/A | | AFAP1 | 196526 | 614385 | 723 | 483962 | 24248 |
| ADGRV1 | 164199 | 640083 | 648 | N/A | | AFAP1 | 196526 | 513856 | 724 | N/A | |
| ADGRV1 | 164199 | 504142 | 649 | N/A | | AFAP1 | 196526 | 612691 | 725 | N/A | |
| ADGRV1 | 164199 | 640403 | 650 | 492531 | 24201 | AFAP1 | 196526 | 358461 | 726 | 351245 | 24249 |
| ADGRV1 | 164199 | 639676 | 651 | N/A | | AFAP1 | 196526 | 420658 | 727 | 410689 | 24250 |
| ADGRV1 | 164199 | 639473 | 652 | N/A | | AFAP1L1 | 157510 | 455574 | 728 | N/A | |
| ADGRV1 | 164199 | 450321 | 653 | 492054 | 24202 | AFAP1L1 | 157510 | 296721 | 729 | 296721 | 24251 |
| ADGRV1 | 164199 | 639431 | 654 | 491057 | 24203 | AFAP1L1 | 157510 | 522492 | 730 | N/A | |
| ADGRV1 | 164199 | 640779 | 655 | 492527 | 24204 | AFAP1L1 | 157510 | 515000 | 731 | 424427 | 24252 |
| ADGRV1 | 164199 | 640012 | 656 | 492538 | 24205 | AFAP1L1 | 157510 | 508444 | 732 | N/A | |
| ADGRV1 | 164199 | 640374 | 657 | N/A | | AFAP1L1 | 157510 | 513665 | 733 | N/A | |
| ADGRV1 | 164199 | 509621 | 658 | N/A | | AFAP1L2 | 169129 | 304129 | 734 | 303042 | 24253 |
| ADGRV1 | 164199 | 640464 | 659 | N/A | | AFAP1L2 | 169129 | 369271 | 735 | 358276 | 24254 |
| ADGRV1 | 164199 | 425867 | 660 | 392618 | 24206 | AFAP1L2 | 169129 | 491814 | 736 | N/A | |
| ADGRV1 | 164199 | 639884 | 661 | N/A | | AFAP1L2 | 169129 | 486300 | 737 | N/A | |
| ADGRV1 | 164199 | 640729 | 662 | N/A | | AFAP1L2 | 169129 | 419268 | 738 | 396781 | 24255 |
| ADGRV1 | 164199 | 638510 | 663 | N/A | | AFAP1L2 | 169129 | 483496 | 739 | N/A | |

| Symbol | ENSG | ENST | SEQ ID | ENSP | SEQ ID |
|---|---|---|---|---|---|
| AFF2 | 155966 | 370460 | 740 | 359489 | 24256 |
| AFF2 | 155966 | 342251 | 741 | 345459 | 24257 |
| AFF2 | 155966 | 370458 | 742 | 359487 | 24258 |
| AFF2 | 155966 | 370457 | 743 | 359486 | 24259 |
| AFF2 | 155966 | 286437 | 744 | 286437 | 24260 |
| AFP | 081051 | 513720 | 745 | N/A | |
| AFP | 081051 | 515675 | 746 | N/A | |
| AFP | 081051 | 395792 | 747 | 379138 | 24261 |
| AFP | 081051 | 226359 | 748 | 226359 | 24262 |
| AFP | 081051 | 508838 | 749 | N/A | |
| AFP | 081051 | 514279 | 750 | N/A | |
| AFP | 081051 | 506820 | 751 | N/A | |
| AGAP1 | 157985 | 409457 | 752 | 387174 | 24263 |
| AGAP1 | 157985 | 336665 | 753 | 338378 | 24264 |
| AGAP1 | 157985 | 304032 | 754 | 307634 | 24265 |
| AGAP1 | 157985 | 635100 | 755 | 489496 | 24266 |
| AGAP1 | 157985 | 402604 | 756 | 385492 | 24267 |
| AGAP1 | 157985 | 409538 | 757 | 386897 | 24268 |
| AGAP1 | 157985 | 448025 | 758 | 403482 | 24269 |
| AGAP1 | 157985 | 418654 | 759 | 393838 | 24270 |
| AGAP1 | 157985 | 466575 | 760 | N/A | |
| AGAP1 | 157985 | 482882 | 761 | N/A | |
| AGAP1 | 157985 | 453371 | 762 | N/A | |
| AGAP1 | 157985 | 619456 | 763 | 483085 | 24271 |
| AGAP1 | 157985 | 428334 | 764 | 411824 | 24272 |
| AGAP1 | 157985 | 614409 | 765 | 484463 | 24273 |
| AGBL2 | 165923 | 528609 | 766 | 431912 | 24274 |
| AGBL2 | 165923 | 525123 | 767 | 435582 | 24275 |
| AGBL2 | 165923 | 528244 | 768 | 436630 | 24276 |
| AGBL2 | 165923 | 529712 | 769 | N/A | |
| AGBL2 | 165923 | 532595 | 770 | 436063 | 24277 |
| AGBL2 | 165923 | 526331 | 771 | N/A | |
| AGBL2 | 165923 | 530577 | 772 | 432264 | 24278 |
| AGBL2 | 165923 | 532835 | 773 | N/A | |
| AGBL2 | 165923 | 528632 | 774 | 432090 | 24279 |
| AGBL2 | 165923 | 529154 | 775 | 436518 | 24280 |
| AGBL2 | 165923 | 531835 | 776 | N/A | |
| AGBL2 | 165923 | 530969 | 777 | 431835 | 24281 |
| AGBL2 | 165923 | 425363 | 778 | N/A | |
| AGBL2 | 165923 | 357610 | 779 | 350228 | 24282 |
| AGPAT3 | 160216 | 291572 | 780 | 291572 | 24283 |
| AGPAT3 | 160216 | 474735 | 781 | N/A | |
| AGPAT3 | 160216 | 448287 | 782 | 389318 | 24284 |
| AGPAT3 | 160216 | 398061 | 783 | 381138 | 24285 |
| AGPAT3 | 160216 | 327505 | 784 | 332989 | 24286 |
| AGPAT3 | 160216 | 445582 | 785 | 412079 | 24287 |
| AGPAT3 | 160216 | 398063 | 786 | 381140 | 24288 |
| AGPAT3 | 160216 | 398058 | 787 | 381135 | 24289 |
| AGPAT3 | 160216 | 457068 | 788 | 413906 | 24290 |
| AGPAT3 | 160216 | 448845 | 789 | 394102 | 24291 |
| AGPAT3 | 160216 | 498670 | 790 | N/A | |
| AGPAT3 | 160216 | 422850 | 791 | 414440 | 24292 |
| AGPAT3 | 160216 | 497909 | 792 | N/A | |
| AGPAT3 | 160216 | 479117 | 793 | N/A | |
| AGPAT3 | 160216 | 481319 | 794 | N/A | |
| AGPAT3 | 160216 | 467358 | 795 | N/A | |
| AGPAT3 | 160216 | 484865 | 796 | N/A | |
| AGPAT3 | 160216 | 546158 | 797 | 443510 | 24293 |
| AGPAT4 | 026652 | 320285 | 798 | 314036 | 24294 |
| AGPAT4 | 026652 | 437165 | 799 | 400211 | 24295 |
| AGPAT4 | 026652 | 436279 | 800 | 413901 | 24296 |
| AGPAT4 | 026652 | 366905 | 801 | 355872 | 24297 |
| AGPAT4 | 026652 | 366911 | 802 | 355878 | 24298 |
| AGRN | 188157 | 379370 | 803 | 368678 | 24299 |
| AGRN | 188157 | 477585 | 804 | 492725 | 24300 |
| AGRN | 188157 | 469403 | 805 | N/A | |
| AGRN | 188157 | 479707 | 806 | N/A | |
| AGRN | 188157 | 466223 | 807 | N/A | |
| AGRN | 188157 | 478677 | 808 | N/A | |
| AGRN | 188157 | 492947 | 809 | N/A | |
| AGRN | 188157 | 419249 | 810 | 400771 | 24301 |
| AGRN | 188157 | 461111 | 811 | N/A | |
| AGRN | 188157 | 620552 | 812 | 484607 | 24302 |
| AGT | 135744 | 366667 | 813 | 355627 | 24303 |
| AHNAK | 124942 | 530124 | 814 | 433789 | 24304 |
| AHNAK | 124942 | 257247 | 815 | 257247 | 24305 |

| Symbol | ENSG | ENST | SEQ ID | ENSP | SEQ ID |
|---|---|---|---|---|---|
| AHNAK | 124942 | 525875 | 816 | N/A | |
| AHNAK | 124942 | 533365 | 817 | 433635 | 24306 |
| AHNAK | 124942 | 378024 | 818 | 367263 | 24307 |
| AHNAK | 124942 | 530285 | 819 | 433286 | 24308 |
| AHNAK | 124942 | 528508 | 820 | 435357 | 24309 |
| AHNAK | 124942 | 531324 | 821 | 436845 | 24310 |
| AHRR | 063438 | 505113 | 822 | 424601 | 24311 |
| AHRR | 063438 | 316418 | 823 | 323816 | 24312 |
| AHRR | 063438 | 512529 | 824 | 424880 | 24313 |
| AHRR | 063438 | 514523 | 825 | 430914 | 24314 |
| AHRR | 063438 | 510400 | 826 | 428893 | 24315 |
| AHRR | 063438 | 515206 | 827 | 430842 | 24316 |
| AHRR | 063438 | 504625 | 828 | 429944 | 24317 |
| AHRR | 063438 | 506456 | 829 | 426932 | 24318 |
| AHRR | 063438 | 510910 | 830 | N/A | |
| AHRR | 063438 | 511487 | 831 | 426076 | 24319 |
| AHRR | 063438 | 507048 | 832 | N/A | |
| AHSA1 | 100591 | 555133 | 833 | 451569 | 24320 |
| AHSA1 | 100591 | 216479 | 834 | 216479 | 24321 |
| AHSA1 | 100591 | 535854 | 835 | 440108 | 24322 |
| AHSA1 | 100591 | 554156 | 836 | N/A | |
| AHSA1 | 100591 | 555517 | 837 | 451467 | 24323 |
| AHSA1 | 100591 | 556963 | 838 | N/A | |
| AHSA1 | 100591 | 556866 | 839 | N/A | |
| AHSA1 | 100591 | 553374 | 840 | 451475 | 24324 |
| AHSA1 | 100591 | 555457 | 841 | N/A | |
| AHSA1 | 100591 | 555729 | 842 | 452127 | 24325 |
| AHSA1 | 100591 | 555473 | 843 | N/A | |
| AHSA1 | 100591 | 556369 | 844 | 450890 | 24326 |
| AHSA1 | 100591 | 557476 | 845 | N/A | |
| MYORG | 164976 | 297625 | 846 | 297625 | 24327 |
| MYORG | 164976 | 379142 | 847 | 368437 | 24328 |
| AK4 | 162433 | 497030 | 848 | N/A | |
| AK4 | 162433 | 470888 | 849 | N/A | |
| AK4 | 162433 | 546702 | 850 | 448458 | 24329 |
| AK4 | 162433 | 327299 | 851 | 322175 | 24330 |
| AK4 | 162433 | 474968 | 852 | N/A | |
| AK4 | 162433 | 479060 | 853 | N/A | |
| AK4 | 162433 | 545314 | 854 | 445912 | 24331 |
| AK4 | 162433 | 395334 | 855 | 378743 | 24332 |
| AKAIN1 | 231824 | 580650 | 856 | 462259 | 24333 |
| AKAIN1 | 231824 | 434239 | 857 | 399075 | 24334 |
| AKAP13 | 170776 | 560571 | 858 | N/A | |
| AKAP13 | 170776 | 559362 | 859 | 453768 | 24335 |
| AKAP13 | 170776 | 560302 | 860 | 453634 | 24336 |
| AKAP13 | 170776 | 394518 | 861 | 378026 | 24337 |
| AKAP13 | 170776 | 361243 | 862 | 354718 | 24338 |
| AKAP13 | 170776 | 560256 | 863 | 453620 | 24339 |
| AKAP13 | 170776 | 558166 | 864 | 452622 | 24340 |
| AKAP13 | 170776 | 558811 | 865 | 452698 | 24341 |
| AKAP13 | 170776 | 560340 | 866 | 483091 | 24342 |
| AKAP13 | 170776 | 560676 | 867 | 481485 | 24343 |
| AKAP13 | 170776 | 560579 | 868 | 477780 | 24344 |
| AKAP13 | 170776 | 559486 | 869 | 453205 | 24345 |
| AKAP13 | 170776 | 612418 | 870 | 482058 | 24346 |
| AKAP13 | 170776 | 560957 | 871 | N/A | |
| AKAP13 | 170776 | 558092 | 872 | N/A | |
| AKAP13 | 170776 | 557852 | 873 | 480789 | 24347 |
| AKAP13 | 170776 | 560482 | 874 | N/A | |
| AKAP13 | 170776 | 559278 | 875 | N/A | |
| AKAP13 | 170776 | 558644 | 876 | N/A | |
| AKAP13 | 170776 | 559820 | 877 | N/A | |
| AKAP13 | 170776 | 558009 | 878 | N/A | |
| AKAP13 | 170776 | 559391 | 879 | N/A | |
| AKAP13 | 170776 | 560185 | 880 | N/A | |
| AKAP13 | 170776 | 394510 | 881 | 378018 | 24348 |
| AKNA | 106948 | 374088 | 882 | 363201 | 24349 |
| AKNA | 106948 | 492875 | 883 | N/A | |
| AKNA | 106948 | 223791 | 884 | 223791 | 24350 |
| AKNA | 106948 | 374075 | 885 | 363188 | 24351 |
| AKNA | 106948 | 491133 | 886 | N/A | |
| AKNA | 106948 | 490767 | 887 | N/A | |
| AKNA | 106948 | 312033 | 888 | 309222 | 24352 |
| AKNA | 106948 | 307564 | 889 | 303769 | 24353 |
| AKNA | 106948 | 374079 | 890 | 363192 | 24354 |
| AKR1C1 | 187134 | 477661 | 891 | N/A | |

| Symbol | ENSG | ENST | SEQ ID | ENSP | SEQ ID |
|---|---|---|---|---|---|
| AKR1C1 | 187134 | 380872 | 892 | 370254 | 24355 |
| AKR1C1 | 187134 | 442997 | 893 | 416415 | 24356 |
| AKR1C1 | 187134 | 380859 | 894 | 370240 | 24357 |
| AKR1C1 | 187134 | 476100 | 895 | N/A | |
| AKR1C2 | 151632 | 380753 | 896 | 370129 | 24358 |
| AKR1C2 | 151632 | 421196 | 897 | 392694 | 24359 |
| AKR1C2 | 151632 | 460124 | 898 | N/A | |
| AKR1C2 | 151632 | 604507 | 899 | 474566 | 24360 |
| AKR1C2 | 151632 | 604184 | 900 | N/A | |
| AKR1C2 | 151632 | 604428 | 901 | N/A | |
| AKR1C2 | 151632 | 604711 | 902 | N/A | |
| AKR1C2 | 151632 | 603073 | 903 | N/A | |
| AKR1C2 | 151632 | 604439 | 904 | N/A | |
| AKR1C2 | 151632 | 455190 | 905 | 408440 | 24361 |
| AKR1C3 | 196139 | 605781 | 906 | N/A | |
| AKR1C3 | 196139 | 470862 | 907 | N/A | |
| AKR1C3 | 196139 | 480822 | 908 | N/A | |
| AKR1C3 | 196139 | 602997 | 909 | 474188 | 24362 |
| AKR1C3 | 196139 | 439082 | 910 | 401327 | 24363 |
| AKR1C3 | 196139 | 605149 | 911 | 474882 | 24364 |
| AKR1C3 | 196139 | 380554 | 912 | 369927 | 24365 |
| AKR1C3 | 196139 | 480697 | 913 | N/A | |
| AKR1C3 | 196139 | 605322 | 914 | N/A | |
| AKR1C3 | 196139 | 603312 | 915 | N/A | |
| AKR1C3 | 196139 | 603484 | 916 | N/A | |
| AKR1C4 | 198610 | 469875 | 917 | N/A | |
| AKR1C4 | 198610 | 380448 | 918 | 369814 | 24366 |
| AKR1C4 | 198610 | 263126 | 919 | 263126 | 24367 |
| ALAS2 | 158578 | 396198 | 920 | 379501 | 24368 |
| ALAS2 | 158578 | 330807 | 921 | 332369 | 24369 |
| ALAS2 | 158578 | 335854 | 922 | 337131 | 24370 |
| ALAS2 | 158578 | 498636 | 923 | N/A | |
| ALAS2 | 158578 | 463868 | 924 | N/A | |
| ALAS2 | 158578 | 477869 | 925 | N/A | |
| ALAS2 | 158578 | 455688 | 926 | 407204 | 24371 |
| ALAS2 | 158578 | 493869 | 927 | N/A | |
| ALCAM | 170017 | 306107 | 928 | 305988 | 24372 |
| ALCAM | 170017 | 470756 | 929 | N/A | |
| ALCAM | 170017 | 472644 | 930 | 419236 | 24373 |
| ALCAM | 170017 | 481337 | 931 | N/A | |
| ALCAM | 170017 | 486979 | 932 | 418213 | 24374 |
| ALCAM | 170017 | 460954 | 933 | N/A | |
| ALCAM | 170017 | 465413 | 934 | 418937 | 24375 |
| ALCAM | 170017 | 491388 | 935 | N/A | |
| ALCAM | 170017 | 489178 | 936 | N/A | |
| ALDH1A1 | 165092 | 297785 | 937 | 297785 | 24376 |
| ALDH1A1 | 165092 | 376939 | 938 | 366138 | 24377 |
| ALDH1A1 | 165092 | 482210 | 939 | N/A | |
| ALDH1A1 | 165092 | 419959 | 940 | 388026 | 24378 |
| ALDH1A1 | 165092 | 446946 | 941 | 401361 | 24379 |
| ALDH1A1 | 165092 | 493113 | 942 | N/A | |
| ALDH1A1 | 165092 | 493311 | 943 | N/A | |
| ALDH1A1 | 165092 | 297785 | 944 | 297785 | 24380 |
| ALDH1A1 | 165092 | 376939 | 945 | 366138 | 24381 |
| ALDH1A1 | 165092 | 482210 | 946 | N/A | |
| ALDH1A1 | 165092 | 419959 | 947 | 388026 | 24382 |
| ALDH1A1 | 165092 | 446946 | 948 | 401361 | 24383 |
| ALDH1A1 | 165092 | 493113 | 949 | N/A | |
| ALDH1A1 | 165092 | 493311 | 950 | N/A | |
| ALDH1A3 | 184254 | 561338 | 951 | 452789 | 24384 |
| ALDH1A3 | 184254 | 329841 | 952 | 332256 | 24385 |
| ALDH1A3 | 184254 | 558033 | 953 | 454107 | 24386 |
| ALDH1A3 | 184254 | 557963 | 954 | 453328 | 24387 |
| ALDH1A3 | 184254 | 560555 | 955 | N/A | |
| ALDH1A3 | 184254 | 346623 | 956 | 343294 | 24388 |
| ALDH1A3 | 184254 | 558869 | 957 | N/A | |
| ALDH1L1 | 144908 | 273450 | 958 | 273450 | 24389 |
| ALDH1L1 | 144908 | 472186 | 959 | 420293 | 24390 |
| ALDH1L1 | 144908 | 467370 | 960 | N/A | |
| ALDH1L1 | 144908 | 452905 | 961 | 395881 | 24391 |
| ALDH1L1 | 144908 | 393434 | 962 | 377083 | 24392 |
| ALDH1L1 | 144908 | 462808 | 963 | N/A | |
| ALDH1L1 | 144908 | 476245 | 964 | N/A | |
| ALDH1L1 | 144908 | 473607 | 965 | 419448 | 24393 |
| ALDH1L1 | 144908 | 413612 | 966 | N/A | |
| ALDH1L1 | 144908 | 484724 | 967 | N/A | |

| Symbol | ENSG | ENST | SEQ ID | ENSP | SEQ ID |
|---|---|---|---|---|---|
| ALDH1L1 | 144908 | 493803 | 968 | 418905 | 24394 |
| ALDH1L1 | 144908 | 490367 | 969 | 418711 | 24395 |
| ALDH1L1 | 144908 | 460368 | 970 | 419826 | 24396 |
| ALDH1L1 | 144908 | 488356 | 971 | 419955 | 24397 |
| ALDH1L1 | 144908 | 509952 | 972 | 426594 | 24398 |
| ALDH1L1 | 144908 | 511283 | 973 | 426713 | 24399 |
| ALDH1L1 | 144908 | 393431 | 974 | 377081 | 24400 |
| ALDH1L1 | 144908 | 455064 | 975 | 414126 | 24401 |
| ALDH1L2 | 136010 | 549335 | 976 | N/A | |
| ALDH1L2 | 136010 | 258494 | 977 | 258494 | 24402 |
| ALDH1L2 | 136010 | 552270 | 978 | 447538 | 24403 |
| ALDH1L2 | 136010 | 548418 | 979 | 447464 | 24404 |
| ALDH1L2 | 136010 | 552427 | 980 | N/A | |
| ALDH6A1 | 119711 | 553458 | 981 | 450436 | 24405 |
| ALDH6A1 | 119711 | 554501 | 982 | N/A | |
| ALDH6A1 | 119711 | 350259 | 983 | 342564 | 24406 |
| ALDH6A1 | 119711 | 555126 | 984 | 452081 | 24407 |
| ALDH6A1 | 119711 | 554231 | 985 | N/A | |
| ALDH6A1 | 119711 | 553814 | 986 | N/A | |
| ALDH6A1 | 119711 | 556852 | 987 | N/A | |
| ALDOC | 109107 | 395319 | 988 | 378729 | 24408 |
| ALDOC | 109107 | 395321 | 989 | 378731 | 24409 |
| ALDOC | 109107 | 226253 | 990 | 226253 | 24410 |
| ALDOC | 109107 | 460201 | 991 | 463174 | 24411 |
| ALDOC | 109107 | 584086 | 992 | 462674 | 24412 |
| ALDOC | 109107 | 581807 | 993 | 465623 | 24413 |
| ALDOC | 109107 | 435638 | 994 | 398976 | 24414 |
| ALDOC | 109107 | 578590 | 995 | 463118 | 24415 |
| ALDOC | 109107 | 582381 | 996 | N/A | |
| ALK | 171094 | 642122 | 997 | 493203 | 24416 |
| ALK | 171094 | 389048 | 998 | 373700 | 24417 |
| ALK | 171094 | 431873 | 999 | 414027 | 24418 |
| ALK | 171094 | 638605 | 1000 | N/A | |
| ALK | 171094 | 453137 | 1001 | 387488 | 24419 |
| ALK | 171094 | 498037 | 1002 | N/A | |
| ALK | 171094 | 618119 | 1003 | 482733 | 24420 |
| ALOX5 | 275565 | 610656 | 1004 | 484468 | 24421 |
| ALOX5 | 275565 | 622032 | 1005 | N/A | |
| ALOX5 | 275565 | 622781 | 1006 | N/A | |
| ALOX5 | 275565 | 616521 | 1007 | N/A | |
| ALOX5 | 275565 | 612275 | 1008 | N/A | |
| ALOX5 | 275565 | 617751 | 1009 | N/A | |
| ALOX5 | 275565 | 622021 | 1010 | 479958 | 24422 |
| ALOX5 | 275565 | 622238 | 1011 | 479452 | 24423 |
| ALOX5 | 012779 | 374391 | 1012 | 363512 | 24424 |
| ALOX5 | 012779 | 483623 | 1013 | N/A | |
| ALOX5 | 012779 | 475300 | 1014 | N/A | |
| ALOX5 | 012779 | 493336 | 1015 | N/A | |
| ALOX5 | 012779 | 481117 | 1016 | N/A | |
| ALOX5 | 012779 | 498461 | 1017 | N/A | |
| ALOX5 | 012779 | 542434 | 1018 | 437634 | 24425 |
| ALOX5 | 012779 | 612635 | 1019 | 483803 | 24426 |
| ALS2 | 003393 | 264276 | 1020 | 264276 | 24427 |
| ALS2 | 003393 | 439495 | 1021 | 403832 | 24428 |
| ALS2 | 003393 | 489440 | 1022 | N/A | |
| ALS2 | 003393 | 482891 | 1023 | N/A | |
| ALS2 | 003393 | 494017 | 1024 | N/A | |
| ALS2 | 003393 | 483703 | 1025 | N/A | |
| ALS2 | 003393 | 482789 | 1026 | N/A | |
| ALS2 | 003393 | 467448 | 1027 | 429223 | 24429 |
| ALS2 | 003393 | 496244 | 1028 | N/A | |
| ALS2 | 003393 | 409632 | 1029 | 386384 | 24430 |
| ALS2 | 003393 | 410052 | 1030 | 386948 | 24431 |
| ALS2 | 003393 | 462747 | 1031 | N/A | |
| ALS2CR12 | 155749 | 286190 | 1032 | 286190 | 24432 |
| ALS2CR12 | 155749 | 415745 | 1033 | 402327 | 24433 |
| ALS2CR12 | 155749 | 494171 | 1034 | N/A | |
| ALS2CR12 | 155749 | 392257 | 1035 | 376086 | 24434 |
| ALS2CR12 | 155749 | 439709 | 1036 | 412073 | 24435 |
| ALS2CR12 | 155749 | 494223 | 1037 | N/A | |
| ALS2CR12 | 155749 | 425488 | 1038 | 393945 | 24436 |
| ALS2CR12 | 155749 | 448967 | 1039 | N/A | |
| ALS2CR12 | 155749 | 418364 | 1040 | 407585 | 24437 |
| ALS2CR12 | 155749 | 405148 | 1041 | 385098 | 24438 |
| AMPD3 | 133805 | 527261 | 1042 | N/A | |
| AMPD3 | 133805 | 532250 | 1043 | 432707 | 24439 |

311

-continued

| Symbol | ENSG | ENST | SEQ ID | ENSP | SEQ ID |
|---|---|---|---|---|---|
| AMPD3 | 133805 | 295663 | 1044 | N/A | |
| AMPD3 | 133805 | 532966 | 1045 | N/A | |
| AMPD3 | 133805 | 527369 | 1046 | N/A | |
| AMPD3 | 133805 | 529835 | 1047 | N/A | |
| AMPD3 | 133805 | 396554 | 1048 | 379802 | 24440 |
| AMPD3 | 133805 | 524866 | 1049 | 433284 | 24441 |
| AMPD3 | 133805 | 534047 | 1050 | 433937 | 24442 |
| AMPD3 | 133805 | 396553 | 1051 | 379801 | 24443 |
| AMPD3 | 133805 | 529834 | 1052 | 435382 | 24444 |
| AMPD3 | 133805 | 528723 | 1053 | 436987 | 24445 |
| AMPD3 | 133805 | 529507 | 1054 | 431648 | 24446 |
| AMPD3 | 133805 | 531227 | 1055 | N/A | |
| AMPD3 | 133805 | 533116 | 1056 | 433351 | 24447 |
| AMPD3 | 133805 | 530864 | 1057 | N/A | |
| AMPD3 | 133805 | 529744 | 1058 | 434608 | 24448 |
| AMPD3 | 133805 | 444303 | 1059 | 396000 | 24449 |
| AMZ1 | 174945 | 312371 | 1060 | 308149 | 24450 |
| AMZ1 | 174945 | 407112 | 1061 | 386020 | 24451 |
| AMZ1 | 174945 | 485540 | 1062 | N/A | |
| AMZ1 | 174945 | 480560 | 1063 | N/A | |
| AMZ1 | 174945 | 489665 | 1064 | N/A | |
| AMZ1 | 174945 | 433945 | 1065 | N/A | |
| ANGPT1 | 154188 | 517746 | 1066 | 428340 | 24452 |
| ANGPT1 | 154188 | 297450 | 1067 | 297450 | 24453 |
| ANGPT1 | 154188 | 520734 | 1068 | 430750 | 24454 |
| ANGPT1 | 154188 | 520052 | 1069 | 429349 | 24455 |
| ANGPT1 | 154188 | 518386 | 1070 | N/A | |
| ANGPT1 | 154188 | 521950 | 1071 | N/A | |
| ANGPT1 | 154188 | 522400 | 1072 | N/A | |
| ANGPT1 | 154188 | 520033 | 1073 | 428908 | 24456 |
| ANGPTL3 | 132855 | 371129 | 1074 | 360170 | 24457 |
| ANGPTL3 | 132855 | 482591 | 1075 | N/A | |
| ANGPTL3 | 132855 | 493994 | 1076 | N/A | |
| ANKRD33B | 164236 | 504806 | 1077 | 422195 | 24458 |
| ANKRD33B | 164236 | 296657 | 1078 | 296657 | 24459 |
| ANKRD37 | 186352 | 507479 | 1079 | N/A | |
| ANKRD37 | 186352 | 507753 | 1080 | 421529 | 24460 |
| ANKRD37 | 186352 | 335174 | 1081 | 335147 | 24461 |
| ANKRD37 | 186352 | 511393 | 1082 | N/A | |
| ANKRD37 | 186352 | 511311 | 1083 | N/A | |
| ANKRD37 | 186352 | 506424 | 1084 | N/A | |
| ANKRD42 | 137494 | 393389 | 1085 | 377049 | 24462 |
| ANKRD42 | 137494 | 528722 | 1086 | 432375 | 24463 |
| ANKRD42 | 137494 | 260047 | 1087 | 260047 | 24464 |
| ANKRD42 | 137494 | 526731 | 1088 | 433585 | 24465 |
| ANKRD42 | 137494 | 531895 | 1089 | 434666 | 24466 |
| ANKRD42 | 137494 | 393392 | 1090 | 377051 | 24467 |
| ANKRD42 | 137494 | 533342 | 1091 | 435790 | 24468 |
| ANKRD42 | 137494 | 531815 | 1092 | 435197 | 24469 |
| ANKRD42 | 137494 | 528190 | 1093 | N/A | |
| ANLN | 011426 | 265748 | 1094 | 265748 | 24470 |
| ANLN | 011426 | 396068 | 1095 | 379380 | 24471 |
| ANLN | 011426 | 424865 | 1096 | 404979 | 24472 |
| ANLN | 011426 | 418118 | 1097 | 406584 | 24473 |
| ANLN | 011426 | 460598 | 1098 | N/A | |
| ANLN | 011426 | 429082 | 1099 | 398712 | 24474 |
| ANLN | 011426 | 441696 | 1100 | 397465 | 24475 |
| ANLN | 011426 | 452877 | 1101 | 413441 | 24476 |
| ANLN | 011426 | 495714 | 1102 | N/A | |
| ANLN | 011426 | 428612 | 1103 | 413522 | 24477 |
| ANLN | 011426 | 446635 | 1104 | 400777 | 24478 |
| ANLN | 011426 | 457743 | 1105 | 399553 | 24479 |
| ANLN | 011426 | 491782 | 1106 | N/A | |
| ANO4 | 262139 | 573650 | 1107 | 469449 | 24480 |
| ANO4 | 262139 | 575847 | 1108 | 470039 | 24481 |
| ANO4 | 262139 | 570509 | 1109 | 471431 | 24482 |
| ANO4 | 151572 | 549155 | 1110 | 449116 | 24483 |
| ANO4 | 151572 | 551148 | 1111 | N/A | |
| ANO4 | 151572 | 546991 | 1112 | 447867 | 24484 |
| ANO4 | 151572 | 392979 | 1113 | 376705 | 24485 |
| ANO4 | 151572 | 392977 | 1114 | 376703 | 24486 |
| ANO4 | 151572 | 549234 | 1115 | N/A | |
| ANO4 | 151572 | 548940 | 1116 | N/A | |
| ANO4 | 151572 | 550015 | 1117 | 450192 | 24487 |
| ANO6 | 177119 | 426898 | 1118 | N/A | |
| ANO6 | 177119 | 425752 | 1119 | 391417 | 24488 |

312

-continued

| Symbol | ENSG | ENST | SEQ ID | ENSP | SEQ ID |
|---|---|---|---|---|---|
| ANO6 | 177119 | 423947 | 1120 | 409126 | 24489 |
| ANO6 | 177119 | 550630 | 1121 | 449423 | 24490 |
| ANO6 | 177119 | 320560 | 1122 | 320087 | 24491 |
| ANO6 | 177119 | 441606 | 1123 | 413137 | 24492 |
| ANO6 | 177119 | 551667 | 1124 | N/A | |
| ANXA3 | 138772 | 264908 | 1125 | 264908 | 24493 |
| ANXA3 | 138772 | 512884 | 1126 | 423068 | 24494 |
| ANXA3 | 138772 | 512542 | 1127 | 426591 | 24495 |
| ANXA3 | 138772 | 503570 | 1128 | 421015 | 24496 |
| ANXA3 | 138772 | 510502 | 1129 | N/A | |
| ANXA3 | 138772 | 512373 | 1130 | 424584 | 24497 |
| ANXA3 | 138772 | 514171 | 1131 | 421512 | 24498 |
| ANXA3 | 138772 | 508214 | 1132 | 422281 | 24499 |
| ANXA3 | 138772 | 505805 | 1133 | N/A | |
| ANXA3 | 138772 | 503776 | 1134 | N/A | |
| AOX1 | 138356 | 374700 | 1135 | 363832 | 24500 |
| AOX1 | 138356 | 454629 | 1136 | 392485 | 24501 |
| AOX1 | 138356 | 485965 | 1137 | N/A | |
| AOX1 | 138356 | 465297 | 1138 | N/A | |
| AOX1 | 138356 | 485106 | 1139 | N/A | |
| AOX1 | 138356 | 472553 | 1140 | N/A | |
| AOX1 | 138356 | 260930 | 1141 | 260930 | 24502 |
| AOX1 | 138356 | 439380 | 1142 | 413326 | 24503 |
| AP1S3 | 152056 | 443700 | 1143 | 397155 | 24504 |
| AP1S3 | 152056 | 415298 | 1144 | 401705 | 24505 |
| AP1S3 | 152056 | 334271 | 1145 | 333888 | 24506 |
| AP1S3 | 152056 | 396654 | 1146 | 379891 | 24507 |
| AP1S3 | 152056 | 396653 | 1147 | 379890 | 24508 |
| AP1S3 | 152056 | 446015 | 1148 | 388738 | 24509 |
| AP1S3 | 152056 | 444408 | 1149 | 399738 | 24510 |
| AP1S3 | 152056 | 409375 | 1150 | 387199 | 24511 |
| APBA2 | 276495 | 632247 | 1151 | 488632 | 24512 |
| APBA2 | 276495 | 631794 | 1152 | 488322 | 24513 |
| APBA2 | 276495 | 633212 | 1153 | N/A | |
| APBA2 | 276495 | 612449 | 1154 | 483174 | 24514 |
| APBA2 | 276495 | 631894 | 1155 | 488107 | 24515 |
| APBA2 | 276495 | 620457 | 1156 | 480384 | 24516 |
| APBA2 | 276495 | 632415 | 1157 | 488620 | 24517 |
| APBA2 | 276495 | 631996 | 1158 | 488031 | 24518 |
| APBA2 | 276495 | 632681 | 1159 | 487880 | 24519 |
| APBA2 | 276495 | 632204 | 1160 | N/A | |
| APBA2 | 034053 | 561069 | 1161 | 453144 | 24520 |
| APBA2 | 034053 | 558402 | 1162 | 453293 | 24521 |
| APBA2 | 034053 | 558330 | 1163 | 452722 | 24522 |
| APBA2 | 034053 | 559814 | 1164 | N/A | |
| APBA2 | 034053 | 559709 | 1165 | 452699 | 24523 |
| APBA2 | 034053 | 558804 | 1166 | 454001 | 24524 |
| APBA2 | 034053 | 560283 | 1167 | 453034 | 24525 |
| APBA2 | 034053 | 558206 | 1168 | 453981 | 24526 |
| APBA2 | 034053 | 558358 | 1169 | 453715 | 24527 |
| APBA2 | 034053 | 382938 | 1170 | N/A | |
| APBA2 | 034053 | 558259 | 1171 | 454171 | 24528 |
| APBA2 | 034053 | 411764 | 1172 | 409312 | 24529 |
| APBB2 | 163697 | 295974 | 1173 | 295974 | 24530 |
| APBB2 | 163697 | 513140 | 1174 | 426018 | 24531 |
| APBB2 | 163697 | 513611 | 1175 | 427307 | 24532 |
| APBB2 | 163697 | 508593 | 1176 | 427211 | 24533 |
| APBB2 | 163697 | 502841 | 1177 | 425802 | 24534 |
| APBB2 | 163697 | 506352 | 1178 | 421539 | 24535 |
| APBB2 | 163697 | 504305 | 1179 | 423765 | 24536 |
| APBB2 | 163697 | 502687 | 1180 | N/A | |
| APBB2 | 163697 | 510925 | 1181 | 422948 | 24537 |
| APBB2 | 163697 | 512510 | 1182 | 426429 | 24538 |
| APBB2 | 163697 | 510670 | 1183 | 427107 | 24539 |
| APBB2 | 163697 | 514920 | 1184 | 421751 | 24540 |
| APBB2 | 163697 | 507831 | 1185 | N/A | |
| APBB2 | 163697 | 513516 | 1186 | 421301 | 24541 |
| APBB2 | 163697 | 513493 | 1187 | 425121 | 24542 |
| APBB2 | 163697 | 514094 | 1188 | N/A | |
| APBB2 | 163697 | 509475 | 1189 | N/A | |
| APBB2 | 163697 | 504484 | 1190 | N/A | |
| APBB2 | 163697 | 511120 | 1191 | N/A | |
| APBB2 | 163697 | 509446 | 1192 | 424414 | 24543 |
| APBB2 | 163697 | 508707 | 1193 | 424579 | 24544 |
| APBB2 | 163697 | 503264 | 1194 | 425202 | 24545 |
| APBB2 | 163697 | 508676 | 1195 | 422723 | 24546 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| APBB2 | 163697 | 503503 | 1196 | 421205 | 24547 | 5 | AQP7 | 165269 | 624890 | 1272 | 485131 | 24599 |
| APBB2 | 163697 | 506999 | 1197 | N/A | | | AQP7 | 165269 | 624005 | 1273 | 485224 | 24600 |
| APBB2 | 163697 | 503555 | 1198 | N/A | | | AQP7 | 165269 | 447660 | 1274 | 412868 | 24601 |
| APBB2 | 163697 | 511572 | 1199 | N/A | | | AQP7 | 165269 | 379503 | 1275 | N/A | |
| APBB2 | 163697 | 502682 | 1200 | N/A | | | AQP7 | 165269 | 624420 | 1276 | 485348 | 24602 |
| APBB2 | 163697 | 505266 | 1201 | N/A | | | AQP7 | 165269 | 624095 | 1277 | 485419 | 24603 |
| APBB2 | 163697 | 543538 | 1202 | 439357 | 24548 | 10 | AQP7 | 165269 | 625109 | 1278 | 485081 | 24604 |
| APCDD1 | 154856 | 355285 | 1203 | 347433 | 24549 | | AQP7 | 165269 | 624432 | 1279 | N/A | |
| APCDD1 | 154856 | 423585 | 1204 | 404930 | 24550 | | AQP7 | 165269 | 623743 | 1280 | N/A | |
| APCDD1 | 154856 | 582723 | 1205 | 463110 | 24551 | | AQP7 | 165269 | 625032 | 1281 | 485246 | 24605 |
| APCDD1 | 154856 | 578882 | 1206 | 463104 | 24552 | | AQP7 | 165269 | 623519 | 1282 | N/A | |
| APCDD1 | 154856 | 584596 | 1207 | 476491 | 24553 | | AQP9 | 103569 | 536493 | 1283 | 441390 | 24606 |
| APCDD1 | 154856 | 579685 | 1208 | 464649 | 24554 | 15 | AQP9 | 103569 | 559443 | 1284 | N/A | |
| APEX2 | 169188 | 374987 | 1209 | 364126 | 24555 | | AQP9 | 103569 | 219919 | 1285 | 219919 | 24607 |
| APEX2 | 169188 | 471758 | 1210 | N/A | | | AQP9 | 103569 | 558772 | 1286 | 452673 | 24608 |
| APH1B | 138613 | 560890 | 1211 | 453002 | 24556 | | AR | 169083 | 374690 | 1287 | 363822 | 24609 |
| APH1B | 138613 | 559744 | 1212 | N/A | | | AR | 169083 | 513847 | 1288 | N/A | |
| APH1B | 138613 | 261879 | 1213 | 261879 | 24557 | | AR | 169083 | 504326 | 1289 | 421155 | 24610 |
| APH1B | 138613 | 380343 | 1214 | 369700 | 24558 | 20 | AR | 169083 | 514029 | 1290 | 425199 | 24611 |
| APH1B | 138613 | 380340 | 1215 | 369697 | 24559 | | AR | 169083 | 396043 | 1291 | 379358 | 24612 |
| APH1B | 138613 | 560353 | 1216 | 453327 | 24560 | | AR | 169083 | 612010 | 1292 | 482407 | 24613 |
| APH1B | 138613 | 559971 | 1217 | 453516 | 24561 | | AR | 169083 | 613054 | 1293 | 479013 | 24614 |
| APH1B | 138613 | 558631 | 1218 | N/A | | | AR | 169083 | 612452 | 1294 | 484033 | 24615 |
| APH1B | 138613 | 559823 | 1219 | N/A | | | AR | 169083 | 396044 | 1295 | 379359 | 24616 |
| APH1B | 138613 | 560716 | 1220 | N/A | | | ARAP3 | 120318 | 508305 | 1296 | 421826 | 24617 |
| APLNR | 134817 | 257254 | 1221 | 257254 | 24562 | 25 | ARAP3 | 120318 | 239440 | 1297 | 239440 | 24618 |
| APLNR | 134817 | 606794 | 1222 | 475344 | 24563 | | ARAP3 | 120318 | 512390 | 1298 | N/A | |
| APLNR | 134817 | 611099 | 1223 | 477818 | 24564 | | ARAP3 | 120318 | 513878 | 1299 | 421468 | 24619 |
| APLP1 | 105290 | 537454 | 1224 | 441501 | 24565 | | ARAP3 | 120318 | 504448 | 1300 | 421148 | 24620 |
| APLP1 | 105290 | 221891 | 1225 | 221891 | 24566 | | ARAP3 | 120318 | 524066 | 1301 | N/A | |
| APLP1 | 105290 | 590561 | 1226 | 466623 | 24567 | | ARAP3 | 120318 | 626478 | 1302 | 486980 | 24621 |
| APLP1 | 105290 | 586861 | 1227 | 465694 | 24568 | 30 | ARC | 198576 | 356613 | 1303 | 349022 | 24622 |
| APLP1 | 105290 | 589743 | 1228 | 466116 | 24569 | | ARC | 198576 | 581404 | 1304 | N/A | |
| APLP1 | 105290 | 592316 | 1229 | 467854 | 24570 | | ARF4 | 168374 | 303436 | 1305 | 306010 | 24623 |
| APLP1 | 105290 | 588808 | 1230 | 466576 | 24571 | | ARF4 | 168374 | 496292 | 1306 | 417501 | 24624 |
| APLP1 | 105290 | 589298 | 1231 | N/A | | | ARF4 | 168374 | 489843 | 1307 | 475828 | 24625 |
| APLP1 | 105290 | 587274 | 1232 | 474762 | 24572 | | ARF4 | 168374 | 486310 | 1308 | 420655 | 24626 |
| APLP1 | 105290 | 590926 | 1233 | N/A | | 35 | ARF4 | 168374 | 483848 | 1309 | N/A | |
| APLP1 | 105290 | 591165 | 1234 | N/A | | | ARF4 | 168374 | 463880 | 1310 | 420254 | 24627 |
| APOD | 189058 | 343267 | 1235 | 345179 | 24573 | | ARF4 | 168374 | 493378 | 1311 | N/A | |
| APOD | 189058 | 458447 | 1236 | 391597 | 24574 | | ARF4 | 168374 | 495354 | 1312 | N/A | |
| APOD | 189058 | 421243 | 1237 | 415235 | 24575 | | ARF4 | 168374 | 488156 | 1313 | 418388 | 24628 |
| APOD | 189058 | 453131 | 1238 | 393076 | 24576 | | ARG2 | 081181 | 261783 | 1314 | 261783 | 24629 |
| APOD | 189058 | 463719 | 1239 | N/A | | 40 | ARG2 | 081181 | 557120 | 1315 | N/A | |
| APPL2 | 136044 | 258530 | 1240 | 258530 | 24577 | | ARG2 | 081181 | 556491 | 1316 | N/A | |
| APPL2 | 136044 | 547439 | 1241 | 449410 | 24578 | | ARG2 | 081181 | 557319 | 1317 | N/A | |
| APPL2 | 136044 | 539978 | 1242 | 444472 | 24579 | | ARHGAP10 | 071205 | 510379 | 1318 | N/A | |
| APPL2 | 136044 | 547790 | 1243 | N/A | | | ARHGAP10 | 071205 | 336498 | 1319 | 336923 | 24630 |
| APPL2 | 136044 | 546731 | 1244 | 447828 | 24580 | | ARHGAP10 | 071205 | 506054 | 1320 | N/A | |
| APPL2 | 136044 | 551662 | 1245 | 446917 | 24581 | | ARHGAP10 | 071205 | 507661 | 1321 | 422358 | 24631 |
| APPL2 | 136044 | 553109 | 1246 | 446510 | 24582 | 45 | ARHGAP10 | 071205 | 506020 | 1322 | N/A | |
| APPL2 | 136044 | 548425 | 1247 | N/A | | | ARHGAP10 | 071205 | 513548 | 1323 | N/A | |
| APPL2 | 136044 | 547809 | 1248 | N/A | | | ARHGAP10 | 071205 | 510076 | 1324 | N/A | |
| APPL2 | 136044 | 552945 | 1249 | N/A | | | ARHGAP15 | 075884 | 409869 | 1325 | 386560 | 24632 |
| APPL2 | 136044 | 549573 | 1250 | N/A | | | ARHGAP15 | 075884 | 295095 | 1326 | 295095 | 24633 |
| APPL2 | 136044 | 549974 | 1251 | 448569 | 24583 | | ARHGAP15 | 075884 | 552641 | 1327 | N/A | |
| APPL2 | 136044 | 550648 | 1252 | N/A | | 50 | ARHGAP15 | 075884 | 460776 | 1328 | N/A | |
| APPL2 | 136044 | 546768 | 1253 | N/A | | | ARHGAP15 | 075884 | 474474 | 1329 | N/A | |
| APPL2 | 136044 | 553097 | 1254 | 449767 | 24584 | | ARHGAP15 | 075884 | 469117 | 1330 | N/A | |
| APPL2 | 136044 | 549056 | 1255 | 447520 | 24585 | | ARHGAP15 | 075884 | 548800 | 1331 | N/A | |
| AQP4 | 171885 | 383168 | 1256 | 372654 | 24586 | | ARHGAP15 | 075884 | 548242 | 1332 | N/A | |
| AQP4 | 171885 | 581374 | 1257 | 462597 | 24587 | | ARHGAP15 | 075884 | 548929 | 1333 | N/A | |
| AQP4 | 171885 | 440832 | 1258 | 393121 | 24588 | | ARHGAP15 | 075884 | 552289 | 1334 | N/A | |
| AQP4 | 171885 | 583022 | 1259 | N/A | | 55 | ARHGAP15 | 075884 | 549436 | 1335 | N/A | |
| AQP4 | 171885 | 584088 | 1260 | N/A | | | ARHGAP15 | 075884 | 419455 | 1336 | 390310 | 24634 |
| AQP4 | 171885 | 578776 | 1261 | 462075 | 24589 | | ARHGAP15 | 075884 | 549060 | 1337 | N/A | |
| AQP4 | 171885 | 383170 | 1262 | 372656 | 24590 | | ARHGAP20 | 137727 | 260283 | 1338 | 260283 | 24635 |
| AQP4 | 171885 | 622234 | 1263 | 484446 | 24591 | | ARHGAP20 | 137727 | 529591 | 1339 | 437905 | 24636 |
| AQP7 | 165269 | 379507 | 1264 | 368821 | 24592 | 60 | ARHGAP20 | 137727 | 524756 | 1340 | 432076 | 24637 |
| AQP7 | 165269 | 537089 | 1265 | 441619 | 24593 | | ARHGAP20 | 137727 | 528829 | 1341 | 436319 | 24638 |
| AQP7 | 165269 | 377425 | 1266 | 396111 | 24594 | | ARHGAP20 | 137727 | 533353 | 1342 | 436522 | 24639 |
| AQP7 | 165269 | 297988 | 1267 | 297988 | 24595 | | ARHGAP20 | 137727 | 527598 | 1343 | 431399 | 24640 |
| AQP7 | 165269 | 623097 | 1268 | N/A | | | ARHGAP22 | 128805 | 249601 | 1344 | 249601 | 24641 |
| AQP7 | 165269 | 439678 | 1269 | 410138 | 24596 | | ARHGAP22 | 128805 | 477708 | 1345 | 422868 | 24642 |
| AQP7 | 165269 | 379506 | 1270 | 368820 | 24597 | 65 | ARHGAP22 | 128805 | 374170 | 1346 | 363285 | 24643 |
| AQP7 | 165269 | 624075 | 1271 | 485332 | 24598 | | ARHGAP22 | 128805 | 374172 | 1347 | 363287 | 24644 |

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| ARHGAP22 | 128805 | 417247 | 1348 | 410054 | 24645 | 5 | ARHGAP26 | 145819 | 443045 | 1424 | 392186 | 24688 |
| ARHGAP22 | 128805 | 435790 | 1349 | 416701 | 24646 | | ARHGAP26 | 145819 | 419676 | 1425 | 413283 | 24689 |
| ARHGAP22 | 128805 | 417912 | 1350 | 412461 | 24647 | | ARHGAP26 | 145819 | 424007 | 1426 | 400565 | 24690 |
| ARHGAP22 | 128805 | 460425 | 1351 | 422663 | 24648 | | ARHGAP26 | 145819 | 489924 | 1427 | N/A | |
| ARHGAP22 | 128805 | 515523 | 1352 | N/A | | | ARHGAP26 | 145819 | 486650 | 1428 | N/A | |
| ARHGAP22 | 128805 | 471013 | 1353 | N/A | | | ARHGAP26 | 145819 | 421521 | 1429 | 389137 | 24691 |
| ARHGAP22 | 128805 | 489984 | 1354 | N/A | | 10 | ARHGAP26 | 145819 | 425417 | 1430 | 403388 | 24692 |
| ARHGAP22 | 128805 | 493012 | 1355 | N/A | | | ARHGAP29 | 137962 | 546444 | 1431 | N/A | |
| ARHGAP22 | 128805 | 491108 | 1356 | N/A | | | ARHGAP29 | 137962 | 552844 | 1432 | 449764 | 24693 |
| ARHGAP22 | 128805 | 511570 | 1357 | N/A | | | ARHGAP29 | 137962 | 260526 | 1433 | 260526 | 24694 |
| ARHGAP22 | 128805 | 464445 | 1358 | N/A | | | ARHGAP29 | 137962 | 482481 | 1434 | N/A | |
| ARHGAP23 | 275832 | 633445 | 1359 | N/A | | | ARHGAP29 | 137962 | 370217 | 1435 | 359237 | 24695 |
| ARHGAP23 | 275832 | 622683 | 1360 | 481862 | 24649 | 15 | ARHGAP32 | 134909 | 310343 | 1436 | 310561 | 24696 |
| ARHGAP23 | 275832 | 620417 | 1361 | 482992 | 24650 | | ARHGAP32 | 134909 | 526162 | 1437 | N/A | |
| ARHGAP23 | 275832 | 616767 | 1362 | N/A | | | ARHGAP32 | 134909 | 392657 | 1438 | 376425 | 24697 |
| ARHGAP23 | 275832 | 618942 | 1363 | 482982 | 24651 | | ARHGAP32 | 134909 | 524655 | 1439 | 432468 | 24698 |
| ARHGAP23 | 275832 | 619156 | 1364 | 483748 | 24652 | | ARHGAP32 | 134909 | 527272 | 1440 | 432862 | 24699 |
| ARHGAP23 | 275832 | 616909 | 1365 | 481292 | 24653 | | ARHGAP32 | 134909 | 534357 | 1441 | N/A | |
| ARHGAP23 | 275832 | 620325 | 1366 | 482425 | 24654 | | ARHGAP32 | 134909 | 533509 | 1442 | N/A | |
| ARHGAP23 | 275832 | 620329 | 1367 | 478142 | 24655 | 20 | ARHGAP32 | 134909 | 525234 | 1443 | 432303 | 24700 |
| ARHGAP23 | 275832 | 617798 | 1368 | N/A | | | ARHGEF10L | 074964 | 361221 | 1444 | 355060 | 24701 |
| ARHGAP23 | 275832 | 614693 | 1369 | 484509 | 24656 | | ARHGEF10L | 074964 | 375415 | 1445 | 364564 | 24702 |
| ARHGAP23 | 275832 | 618325 | 1370 | N/A | | | ARHGEF10L | 074964 | 482892 | 1446 | N/A | |
| ARHGAP23 | 273780 | 610551 | 1371 | 479208 | 24657 | | ARHGEF10L | 074964 | 469726 | 1447 | N/A | |
| ARHGAP23 | 273780 | 631799 | 1372 | 488428 | 24658 | | ARHGEF10L | 074964 | 375408 | 1448 | 364557 | 24703 |
| ARHGAP23 | 273780 | 633736 | 1373 | N/A | | 25 | ARHGEF10L | 074964 | 167825 | 1449 | 167825 | 24704 |
| ARHGAP23 | 273780 | 632947 | 1374 | 488885 | 24659 | | ARHGEF10L | 074964 | 482359 | 1450 | N/A | |
| ARHGAP23 | 273780 | 633443 | 1375 | 487883 | 24660 | | ARHGEF10L | 074964 | 466782 | 1451 | N/A | |
| ARHGAP23 | 273780 | 633302 | 1376 | 488827 | 24661 | | ARHGEF10L | 074964 | 495593 | 1452 | N/A | |
| ARHGAP23 | 273780 | 632895 | 1377 | 488699 | 24662 | | ARHGEF2 | 116584 | 313695 | 1453 | 315325 | 24705 |
| ARHGAP23 | 273780 | 631490 | 1378 | 488310 | 24663 | | ARHGEF2 | 116584 | 361247 | 1454 | 354837 | 24706 |
| ARHGAP23 | 273780 | 633368 | 1379 | N/A | | 30 | ARHGEF2 | 116584 | 462460 | 1455 | 476916 | 24707 |
| ARHGAP23 | 273780 | 634129 | 1380 | 487994 | 24664 | | ARHGEF2 | 116584 | 477754 | 1456 | N/A | |
| ARHGAP23 | 273780 | 633715 | 1381 | N/A | | | ARHGEF2 | 116584 | 470541 | 1457 | 476689 | 24708 |
| ARHGAP24 | 138639 | 395184 | 1382 | 378601 | 24665 | | ARHGEF2 | 116584 | 313667 | 1458 | 314787 | 24709 |
| ARHGAP24 | 138639 | 503995 | 1383 | 423206 | 24666 | | ARHGEF2 | 116584 | 474428 | 1459 | N/A | |
| ARHGAP24 | 138639 | 506421 | 1384 | N/A | | | ARHGEF2 | 116584 | 470975 | 1460 | N/A | |
| ARHGAP24 | 138639 | 505856 | 1385 | N/A | | 35 | ARHGEF2 | 116584 | 608543 | 1461 | N/A | |
| ARHGAP24 | 138639 | 509709 | 1386 | N/A | | | ARHGEF2 | 116584 | 470874 | 1462 | 477448 | 24710 |
| ARHGAP24 | 138639 | 512201 | 1387 | 426105 | 24667 | | ARHGEF2 | 116584 | 471589 | 1463 | 477299 | 24711 |
| ARHGAP24 | 138639 | 395183 | 1388 | 378610 | 24668 | | ARHGEF2 | 116584 | 497907 | 1464 | 476724 | 24712 |
| ARHGAP24 | 138639 | 509300 | 1389 | 424256 | 24669 | | ARHGEF2 | 116584 | 476273 | 1465 | N/A | |
| ARHGAP24 | 138639 | 514229 | 1390 | 425589 | 24670 | | ARHGEF2 | 116584 | 609707 | 1466 | 476699 | 24713 |
| ARHGAP24 | 138639 | 502537 | 1391 | N/A | | 40 | ARHGEF2 | 116584 | 487755 | 1467 | N/A | |
| ARHGAP24 | 138639 | 503917 | 1392 | N/A | | | ARHGEF2 | 116584 | 465079 | 1468 | N/A | |
| ARHGAP24 | 138639 | 264343 | 1393 | 264343 | 24671 | | ARHGEF2 | 116584 | 495070 | 1469 | 476532 | 24714 |
| ARHGAP25 | 163219 | 463483 | 1394 | 417283 | 24672 | | ARHGEF2 | 116584 | 423422 | 1470 | 476518 | 24715 |
| ARHGAP25 | 163219 | 481684 | 1395 | N/A | | | ARHGEF2 | 116584 | 609126 | 1471 | N/A | |
| ARHGAP25 | 163219 | 491237 | 1396 | N/A | | | ARHGEF2 | 116584 | 368315 | 1472 | 357298 | 24716 |
| ARHGAP25 | 163219 | 409202 | 1397 | 386911 | 24673 | 45 | ARHGEF26 | 114790 | 356448 | 1473 | 348828 | 24717 |
| ARHGAP25 | 163219 | 456116 | 1398 | N/A | | | ARHGEF26 | 114790 | 465093 | 1474 | 423418 | 24718 |
| ARHGAP25 | 163219 | 467265 | 1399 | 420583 | 24674 | | ARHGEF26 | 114790 | 496710 | 1475 | 424446 | 24719 |
| ARHGAP25 | 163219 | 485573 | 1400 | N/A | | | ARHGEF26 | 114790 | 465817 | 1476 | 423295 | 24720 |
| ARHGAP25 | 163219 | 488795 | 1401 | 420427 | 24675 | | ARHGEF26 | 114790 | 483068 | 1477 | N/A | |
| ARHGAP25 | 163219 | 463061 | 1402 | N/A | | | ARHGEF26 | 277101 | 630534 | 1478 | N/A | |
| ARHGAP25 | 163219 | 485700 | 1403 | N/A | | | ARHGEF26 | 277101 | 629129 | 1479 | 486665 | 24721 |
| ARHGAP25 | 163219 | 496266 | 1404 | N/A | | 50 | ARHGEF26 | 277101 | 630729 | 1480 | 487265 | 24722 |
| ARHGAP25 | 163219 | 409030 | 1405 | 386863 | 24676 | | ARHGEF26 | 277101 | 614308 | 1481 | 481927 | 24723 |
| ARHGAP25 | 163219 | 409220 | 1406 | 386241 | 24677 | | ARHGEF26 | 277101 | 618535 | 1482 | 484367 | 24724 |
| ARHGAP25 | 163219 | 473986 | 1407 | 417425 | 24678 | | ARHGEF28 | 214944 | 296794 | 1483 | 296794 | 24725 |
| ARHGAP25 | 163219 | 497079 | 1408 | 417139 | 24679 | | ARHGEF28 | 214944 | 509848 | 1484 | 421859 | 24726 |
| ARHGAP25 | 163219 | 497259 | 1409 | 417818 | 24680 | | ARHGEF28 | 214944 | 437974 | 1485 | 411459 | 24727 |
| ARHGAP25 | 163219 | 479844 | 1410 | 417467 | 24681 | 55 | ARHGEF28 | 214944 | 426542 | 1486 | 412175 | 24728 |
| ARHGAP26 | 145819 | 274498 | 1411 | 274498 | 24682 | | ARHGEF28 | 214944 | 510131 | 1487 | N/A | |
| ARHGAP26 | 145819 | 378004 | 1412 | 367243 | 24683 | | ARHGEF28 | 214944 | 296799 | 1488 | 296799 | 24729 |
| ARHGAP26 | 145819 | 378013 | 1413 | 367252 | 24684 | | ARHGEF28 | 214944 | 513841 | 1489 | N/A | |
| ARHGAP26 | 145819 | 475287 | 1414 | N/A | | | ARHGEF28 | 214944 | 506334 | 1490 | N/A | |
| ARHGAP26 | 145819 | 477867 | 1415 | N/A | | | ARHGEF28 | 214944 | 510312 | 1491 | N/A | |
| ARHGAP26 | 145819 | 451259 | 1416 | 411571 | 24685 | 60 | ARHGEF28 | 214944 | 512883 | 1492 | 421081 | 24730 |
| ARHGAP26 | 145819 | 461314 | 1417 | N/A | | | ARHGEF28 | 214944 | 504003 | 1493 | N/A | |
| ARHGAP26 | 145819 | 469131 | 1418 | N/A | | | ARHGEF28 | 214944 | 503341 | 1494 | N/A | |
| ARHGAP26 | 145819 | 469396 | 1419 | N/A | | | ARHGEF28 | 214944 | 545377 | 1495 | 441913 | 24731 |
| ARHGAP26 | 145819 | 464838 | 1420 | N/A | | | ARHGEF28 | 214944 | 513042 | 1496 | 441436 | 24732 |
| ARHGAP26 | 145819 | 470032 | 1421 | N/A | | | ARHGEF3 | 163947 | 296315 | 1497 | 296315 | 24733 |
| ARHGAP26 | 145819 | 443674 | 1422 | 393276 | 24686 | 65 | ARHGEF3 | 163947 | 338458 | 1498 | 341071 | 24734 |
| ARHGAP26 | 145819 | 418236 | 1423 | 416889 | 24687 | | ARHGEF3 | 163947 | 413728 | 1499 | 410922 | 24735 |

-continued

-continued

| Symbol | ENSG | ENST | SEQ ID | ENSP | SEQ ID |
|---|---|---|---|---|---|
| ARHGEF3 | 163947 | 465659 | 1500 | 417810 | 24736 |
| ARHGEF3 | 163947 | 496106 | 1501 | 420420 | 24737 |
| ARHGEF3 | 163947 | 497267 | 1502 | 418826 | 24738 |
| ARHGEF3 | 163947 | 495373 | 1503 | 417986 | 24739 |
| ARHGEF3 | 163947 | 468727 | 1504 | 417087 | 24740 |
| ARHGEF3 | 163947 | 473779 | 1505 | 420102 | 24741 |
| ARHGEF3 | 163947 | 481422 | 1506 | N/A | |
| ARHGEF3 | 163947 | 498517 | 1507 | N/A | |
| ARHGEF3 | 163947 | 477833 | 1508 | 418984 | 24742 |
| ARHGEF3 | 163947 | 477440 | 1509 | N/A | |
| ARHGEF3 | 163947 | 468466 | 1510 | 418469 | 24743 |
| ARHGEF3 | 163947 | 486829 | 1511 | 420633 | 24744 |
| ARHGEF33 | 214694 | 409978 | 1512 | 387020 | 24745 |
| ARHGEF33 | 214694 | 488692 | 1513 | N/A | |
| ARHGEF33 | 214694 | 486958 | 1514 | N/A | |
| ARHGEF33 | 214694 | 483305 | 1515 | N/A | |
| ARHGEF33 | 214694 | 411874 | 1516 | 399688 | 24746 |
| ARHGEF33 | 214694 | 433605 | 1517 | 413620 | 24747 |
| ARHGEF33 | 214694 | 430382 | 1518 | N/A | |
| ARHGEF33 | 214694 | 398800 | 1519 | 381780 | 24748 |
| ARHGEF37 | 183111 | 505810 | 1520 | 425621 | 24749 |
| ARHGEF37 | 183111 | 333677 | 1521 | 328083 | 24750 |
| ARHGEF37 | 183111 | 509831 | 1522 | N/A | |
| ARHGEF4 | 136002 | 409359 | 1523 | 386794 | 24751 |
| ARHGEF4 | 136002 | 526381 | 1524 | N/A | |
| ARHGEF4 | 136002 | 636987 | 1525 | 490717 | 24752 |
| ARHGEF4 | 136002 | 438985 | 1526 | 389661 | 24753 |
| ARHGEF4 | 136002 | 392953 | 1527 | 376680 | 24754 |
| ARHGEF4 | 136002 | 409303 | 1528 | 387285 | 24755 |
| ARHGEF4 | 136002 | 355771 | 1529 | 348017 | 24756 |
| ARHGEF4 | 136002 | 496764 | 1530 | N/A | |
| ARHGEF4 | 136002 | 439368 | 1531 | N/A | |
| ARHGEF4 | 136002 | 528247 | 1532 | N/A | |
| ARHGEF4 | 136002 | 490728 | 1533 | N/A | |
| ARHGEF4 | 136002 | 532720 | 1534 | 432301 | 24757 |
| ARHGEF4 | 136002 | 527365 | 1535 | N/A | |
| ARHGEF4 | 136002 | 525092 | 1536 | N/A | |
| ARHGEF4 | 136002 | 326016 | 1537 | 316845 | 24758 |
| ARHGEF4 | 136002 | 525839 | 1538 | 432267 | 24759 |
| ARHGEF4 | 136002 | 611048 | 1539 | 483548 | 24760 |
| ARHGEF4 | 136002 | 428230 | 1540 | 398455 | 24761 |
| ARHGEF6 | 129675 | 370620 | 1541 | 359654 | 24762 |
| ARHGEF6 | 129675 | 370622 | 1542 | 359656 | 24763 |
| ARHGEF6 | 129675 | 250617 | 1543 | 250617 | 24764 |
| ARIH1 | 166233 | 379887 | 1544 | 369217 | 24765 |
| ARIH1 | 166233 | 570085 | 1545 | 456746 | 24766 |
| ARIH1 | 166233 | 564062 | 1546 | 454774 | 24767 |
| ARIH1 | 166233 | 567762 | 1547 | N/A | |
| ARIH1 | 166233 | 561987 | 1548 | N/A | |
| ARIH1 | 166233 | 565950 | 1549 | N/A | |
| ARIH1 | 166233 | 561770 | 1550 | 457767 | 24768 |
| ARIH1 | 166233 | 566063 | 1551 | N/A | |
| ARIH1 | 166233 | 562891 | 1552 | 477687 | 24769 |
| ARIH1 | 166233 | 563310 | 1553 | N/A | |
| ARL4A | 122644 | 396662 | 1554 | 379897 | 24770 |
| ARL4A | 122644 | 356797 | 1555 | 349250 | 24771 |
| ARL4A | 122644 | 396664 | 1556 | 379899 | 24772 |
| ARL4A | 122644 | 439721 | 1557 | 397651 | 24773 |
| ARL4A | 122644 | 404894 | 1558 | 385236 | 24774 |
| ARL4A | 122644 | 396663 | 1559 | 379898 | 24775 |
| ARL5B | 165997 | 377275 | 1560 | 366487 | 24776 |
| ARMCX1 | 126947 | 372829 | 1561 | 361917 | 24777 |
| ARNT2 | 172379 | 529181 | 1562 | N/A | |
| ARNT2 | 172379 | 303329 | 1563 | 307479 | 24778 |
| ARNT2 | 172379 | 533983 | 1564 | 453651 | 24779 |
| ARNT2 | 172379 | 527771 | 1565 | 453792 | 24780 |
| ARNT2 | 172379 | 525103 | 1566 | 452961 | 24781 |
| ARNT2 | 172379 | 531595 | 1567 | N/A | |
| ARNT2 | 172379 | 558849 | 1568 | N/A | |
| ARNT2 | 172379 | 525505 | 1569 | N/A | |
| ARNT2 | 172379 | 622346 | 1570 | 479393 | 24782 |
| ARPP21 | 172995 | 450234 | 1571 | 411644 | 24783 |
| ARPP21 | 172995 | 428373 | 1572 | 412411 | 24784 |
| ARPP21 | 172995 | 421492 | 1573 | 398598 | 24785 |
| ARPP21 | 172995 | 444190 | 1574 | 405276 | 24786 |
| ARPP21 | 172995 | 449196 | 1575 | 409808 | 24787 |

| Symbol | ENSG | ENST | SEQ ID | ENSP | SEQ ID |
|---|---|---|---|---|---|
| ARPP21 | 172995 | 187397 | 1576 | 187397 | 24788 |
| ARPP21 | 172995 | 452563 | 1577 | 396324 | 24789 |
| ARPP21 | 172995 | 438577 | 1578 | 409331 | 24790 |
| ARPP21 | 172995 | 414496 | 1579 | 415134 | 24791 |
| ARPP21 | 172995 | 419330 | 1580 | 413005 | 24792 |
| ARPP21 | 172995 | 427542 | 1581 | 401602 | 24793 |
| ARPP21 | 172995 | 474696 | 1582 | 417838 | 24794 |
| ARPP21 | 172995 | 412048 | 1583 | 390151 | 24795 |
| ARPP21 | 172995 | 396482 | 1584 | 379742 | 24796 |
| ARPP21 | 172995 | 432682 | 1585 | 389754 | 24797 |
| ARPP21 | 172995 | 432450 | 1586 | 412341 | 24798 |
| ARPP21 | 172995 | 413378 | 1587 | 390169 | 24799 |
| ARPP21 | 172995 | 417925 | 1588 | 412326 | 24800 |
| ARPP21 | 172995 | 396481 | 1589 | 379741 | 24801 |
| ARPP21 | 172995 | 434383 | 1590 | N/A | |
| ARPP21 | 172995 | 441454 | 1591 | 406964 | 24802 |
| ARPP21 | 172995 | 436702 | 1592 | 397720 | 24803 |
| ARPP21 | 172995 | 438071 | 1593 | 410171 | 24804 |
| ARPP21 | 172995 | 461826 | 1594 | N/A | |
| ARPP21 | 172995 | 446068 | 1595 | 399482 | 24805 |
| ARPP21 | 172995 | 425289 | 1596 | 408271 | 24806 |
| ARPP21 | 172995 | 427590 | 1597 | 396116 | 24807 |
| ARPP21 | 172995 | 476327 | 1598 | N/A | |
| ARPP21 | 172995 | 494494 | 1599 | N/A | |
| ARPP21 | 172995 | 481854 | 1600 | N/A | |
| ARPP21 | 172995 | 457165 | 1601 | 412233 | 24808 |
| ARPP21 | 172995 | 462173 | 1602 | N/A | |
| ARPP21 | 172995 | 463970 | 1603 | N/A | |
| ARPP21 | 172995 | 473138 | 1604 | N/A | |
| ARPP21 | 172995 | 476052 | 1605 | N/A | |
| ARRB1 | 137486 | 420843 | 1606 | 409581 | 24809 |
| ARRB1 | 137486 | 360025 | 1607 | 353124 | 24810 |
| ARRB1 | 137486 | 532447 | 1608 | 436530 | 24811 |
| ARRB1 | 137486 | 531012 | 1609 | N/A | |
| ARRB1 | 137486 | 529741 | 1610 | N/A | |
| ARRB1 | 137486 | 532525 | 1611 | 433171 | 24812 |
| ARRB1 | 137486 | 524400 | 1612 | 434196 | 24813 |
| ARRB1 | 137486 | 533609 | 1613 | 436352 | 24814 |
| ARRB1 | 137486 | 527385 | 1614 | 433137 | 24815 |
| ARRB1 | 137486 | 530086 | 1615 | N/A | |
| ARRB1 | 137486 | 529280 | 1616 | N/A | |
| ARRB1 | 137486 | 533255 | 1617 | N/A | |
| ARRDC3 | 113369 | 265138 | 1618 | 265138 | 24816 |
| ARRDC3 | 113369 | 511391 | 1619 | N/A | |
| ARRDC3 | 113369 | 505631 | 1620 | N/A | |
| ARRDC3 | 113369 | 514284 | 1621 | N/A | |
| ARRDC3 | 113369 | 508948 | 1622 | N/A | |
| ARRDC3 | 113369 | 503192 | 1623 | N/A | |
| ARRDC3 | 113369 | 507075 | 1624 | N/A | |
| ARSDP1 | 225117 | 443820 | 1625 | N/A | |
| ARSG | 141337 | 448504 | 1626 | 407193 | 24817 |
| ARSG | 141337 | 578726 | 1627 | N/A | |
| ARSG | 141337 | 581639 | 1628 | 462306 | 24818 |
| ARSG | 141337 | 452479 | 1629 | 413953 | 24819 |
| ARSG | 141337 | 582154 | 1630 | N/A | |
| ARSG | 141337 | 581032 | 1631 | N/A | |
| ARSG | 141337 | 578554 | 1632 | N/A | |
| ARSG | 141337 | 590690 | 1633 | N/A | |
| ARSG | 141337 | 621439 | 1634 | 480910 | 24820 |
| ARX | 004848 | 379044 | 1635 | 368332 | 24821 |
| ARX | 004848 | 636885 | 1636 | N/A | |
| ARX | 004848 | 637993 | 1637 | 490122 | 24822 |
| ARX | 004848 | 636609 | 1638 | N/A | |
| ARX | 004848 | 637394 | 1639 | N/A | |
| ASAP3 | 088280 | 495646 | 1640 | 436150 | 24823 |
| ASAP3 | 088280 | 336689 | 1641 | 338769 | 24824 |
| ASAP3 | 088280 | 465372 | 1642 | 435394 | 24825 |
| ASAP3 | 088280 | 492982 | 1643 | 435858 | 24826 |
| ASAP3 | 088280 | 437606 | 1644 | 408826 | 24827 |
| ASAP3 | 088280 | 484418 | 1645 | 434897 | 24828 |
| ASAP3 | 088280 | 475814 | 1646 | 436439 | 24829 |
| ASAP3 | 088280 | 530874 | 1647 | N/A | |
| ASAP3 | 088280 | 478858 | 1648 | N/A | |
| ASAP3 | 088280 | 608765 | 1649 | 476400 | 24830 |
| ASAP3 | 088280 | 449467 | 1650 | N/A | |
| ASAP3 | 088280 | 618240 | 1651 | 483740 | 24831 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| ASAP3 | 282854 | 634513 | 1652 | 488934 | 24832 | 5 | ASTN2 | 148219 | 358637 | 1728 | 351460 | 24887 |
| ASAP3 | 282854 | 634561 | 1653 | 488946 | 24833 | | ASTN2 | 148219 | 361477 | 1729 | 355116 | 24888 |
| ASAP3 | 282854 | 635693 | 1654 | 489432 | 24834 | | ASTN2 | 148219 | 313400 | 1730 | 314038 | 24889 |
| ASAP3 | 282854 | 635461 | 1655 | 489483 | 24835 | | AEAD2 | 156802 | 517666 | 1731 | 429331 | 24890 |
| ASAP3 | 282854 | 634705 | 1656 | 489485 | 24836 | | AEAD2 | 156802 | 287394 | 1732 | 287394 | 24891 |
| ASAP3 | 282854 | 635198 | 1657 | 488953 | 24837 | | ATAD2 | 156802 | 521903 | 1733 | 429213 | 24892 |
| ASAP3 | 282854 | 635167 | 1658 | 489344 | 24838 | 10 | ATAD2 | 156802 | 519124 | 1734 | 429617 | 24893 |
| ASAP3 | 282854 | 634883 | 1659 | 489094 | 24839 | | ATAD2 | 156802 | 521496 | 1735 | N/A | |
| ASAP3 | 282854 | 635442 | 1660 | N/A | | | ATAD2 | 156802 | 550993 | 1736 | N/A | |
| ASAP3 | 282854 | 634459 | 1661 | N/A | | | ATAD2 | 156802 | 534257 | 1737 | N/A | |
| ASAP3 | 282854 | 634548 | 1662 | 489187 | 24840 | | ATAD2 | 156802 | 530065 | 1738 | N/A | |
| ASAP3 | 282854 | 635351 | 1663 | N/A | | | ATF3 | 162772 | 366981 | 1739 | 355948 | 24894 |
| ASCL1 | 139352 | 266744 | 1664 | 266744 | 24841 | 15 | ATF3 | 162772 | 465155 | 1740 | N/A | |
| ASGR1 | 141505 | 269299 | 1665 | 269299 | 24842 | | ATF3 | 162772 | 341491 | 1741 | 344352 | 24895 |
| ASGR1 | 141505 | 380920 | 1666 | 370307 | 24843 | | ATF3 | 162772 | 366985 | 1742 | 355952 | 24896 |
| ASGR1 | 141505 | 574330 | 1667 | 467511 | 24844 | | ATF3 | 162772 | 492118 | 1743 | N/A | |
| ASGR1 | 141505 | 574388 | 1668 | 459169 | 24845 | | ATF3 | 162772 | 336937 | 1744 | 336908 | 24897 |
| ASGR1 | 141505 | 572879 | 1669 | 458530 | 24846 | | ATF3 | 162772 | 464547 | 1745 | 432208 | 24898 |
| ASGR1 | 141505 | 570576 | 1670 | 458803 | 24847 | 20 | ATF3 | 162772 | 366983 | 1746 | 355950 | 24899 |
| ASGR1 | 141505 | 573596 | 1671 | N/A | | | ATF3 | 162772 | 613104 | 1747 | 480606 | 24900 |
| ASGR1 | 141505 | 573083 | 1672 | 459896 | 24848 | | ATF3 | 162772 | 366987 | 1748 | 355954 | 24901 |
| ASGR1 | 141505 | 619926 | 1673 | 481182 | 24849 | | ATF3 | 162772 | 613954 | 1749 | 483576 | 24902 |
| ASIC1 | 110881 | 228468 | 1674 | 228468 | 24850 | | ATF6B | 234539 | 427136 | 1750 | 404725 | 24903 |
| ASIC1 | 110881 | 447966 | 1675 | 400228 | 24851 | | ATF6B | 234539 | 439240 | 1751 | 391131 | 24904 |
| ASIC1 | 110881 | 550558 | 1676 | 448263 | 24852 | | ATF6B | 234539 | 417614 | 1752 | 399944 | 24905 |
| ASIC1 | 110881 | 453327 | 1677 | 402896 | 24853 | 25 | ATF6B | 234539 | 477445 | 1753 | N/A | |
| ASIC1 | 110881 | 551199 | 1678 | N/A | | | ATF6B | 234539 | 465605 | 1754 | N/A | |
| ASIC1 | 110881 | 552438 | 1679 | 450247 | 24854 | | ATF6B | 234539 | 498564 | 1755 | N/A | |
| ASIC1 | 110881 | 549792 | 1680 | N/A | | | ATF6B | 234539 | 477295 | 1756 | N/A | |
| ASIC1 | 110881 | 548350 | 1681 | N/A | | | ATF6B | 234539 | 475964 | 1757 | N/A | |
| ASIC1 | 110881 | 552633 | 1682 | 446863 | 24855 | | ATF6B | 213676 | 494022 | 1758 | N/A | |
| ASIC2 | 108684 | 225823 | 1683 | 225823 | 24856 | 30 | ATF6B | 213676 | 375203 | 1759 | 364349 | 24906 |
| ASIC2 | 108684 | 359872 | 1684 | 352934 | 24857 | | ATF6B | 213676 | 375201 | 1760 | 364347 | 24907 |
| ASIC2 | 108684 | 448983 | 1685 | N/A | | | ATF6B | 213676 | 453203 | 1761 | 393419 | 24908 |
| ASIC2 | 108684 | 579816 | 1686 | N/A | | | ATF6B | 213676 | 475705 | 1762 | N/A | |
| ASIC2 | 108684 | 583395 | 1687 | N/A | | | ATF6B | 213676 | 492342 | 1763 | N/A | |
| ASIC4 | 072182 | 461395 | 1688 | N/A | | | ATF6B | 213676 | 495579 | 1764 | N/A | |
| ASIC4 | 072182 | 347842 | 1689 | 326627 | 24858 | 35 | ATF6B | 213676 | 485314 | 1765 | N/A | |
| ASIC4 | 072182 | 358078 | 1690 | 350786 | 24859 | | ATF6B | 213676 | 468502 | 1766 | N/A | |
| ASIC4 | 072182 | 474489 | 1691 | N/A | | | ATF6B | 228628 | 425571 | 1767 | 404814 | 24909 |
| ASIC4 | 072182 | 473709 | 1692 | N/A | | | ATF6B | 228628 | 435768 | 1768 | 399764 | 24910 |
| ASNS | 070669 | 394309 | 1693 | 377846 | 24860 | | ATF6B | 228628 | 436157 | 1769 | 389467 | 24911 |
| ASNS | 070669 | 454046 | 1694 | 401651 | 24861 | | ATF6B | 228628 | 462947 | 1770 | N/A | |
| ASNS | 070669 | 437628 | 1695 | 414379 | 24862 | 40 | ATF6B | 228628 | 461317 | 1771 | N/A | |
| ASNS | 070669 | 394308 | 1696 | 377845 | 24863 | | ATF6B | 228628 | 492011 | 1772 | N/A | |
| ASNS | 070669 | 422745 | 1697 | 414901 | 24864 | | ATF6B | 228628 | 483144 | 1773 | N/A | |
| ASNS | 070669 | 455086 | 1698 | 408472 | 24865 | | ATF6B | 228628 | 476416 | 1774 | N/A | |
| ASNS | 070669 | 444334 | 1699 | 406994 | 24866 | | ATF6B | 168468 | 293709 | 1775 | 293709 | 24912 |
| ASNS | 070669 | 487714 | 1700 | N/A | | | ATF6B | 168468 | 383156 | 1776 | 372642 | 24913 |
| ASNS | 070669 | 462436 | 1701 | N/A | | | ATF6B | 168468 | 413319 | 1777 | 412066 | 24914 |
| ASNS | 070669 | 442734 | 1702 | 400422 | 24867 | 45 | ATF6B | 168468 | 465333 | 1778 | N/A | |
| ASNS | 070669 | 495255 | 1703 | N/A | | | ATF6B | 168468 | 491968 | 1779 | N/A | |
| ASNS | 070669 | 437657 | 1704 | 394242 | 24868 | | ATF6B | 168468 | 463669 | 1780 | N/A | |
| ASNS | 070669 | 448127 | 1705 | 402350 | 24869 | | ATF6B | 168468 | 465377 | 1781 | N/A | |
| ASNS | 070669 | 453600 | 1706 | 408797 | 24870 | | ATF6B | 168468 | 467437 | 1782 | N/A | |
| ASNS | 070669 | 451771 | 1707 | 397802 | 24871 | | ATL2 | 119787 | 378954 | 1783 | 368237 | 24915 |
| ASNS | 070669 | 414884 | 1708 | 413797 | 24872 | 50 | ATL2 | 119787 | 406122 | 1784 | 385446 | 24916 |
| ASNS | 070669 | 175506 | 1709 | 175506 | 24873 | | ATL2 | 119787 | 402054 | 1785 | 384062 | 24917 |
| ASPA | 108381 | 577034 | 1710 | 458324 | 24874 | | ATL2 | 119787 | 405384 | 1786 | 383944 | 24918 |
| ASPA | 108381 | 456349 | 1711 | 409976 | 24875 | | ATL2 | 119787 | 419554 | 1787 | 415336 | 24919 |
| ASPA | 108381 | 263080 | 1712 | 263080 | 24876 | | ATL2 | 119787 | 452935 | 1788 | 390743 | 24920 |
| ASPA | 108381 | 571278 | 1713 | 461358 | 24877 | | ATL2 | 119787 | 477642 | 1789 | N/A | |
| ASPG | 166183 | 551177 | 1714 | 450040 | 24878 | 55 | ATL2 | 119787 | 489896 | 1790 | N/A | |
| ASPG | 166183 | 548372 | 1715 | N/A | | | ATL2 | 119787 | 449130 | 1791 | 409811 | 24921 |
| ASPG | 166183 | 546892 | 1716 | 448911 | 24879 | | ATL2 | 119787 | 443098 | 1792 | 410592 | 24922 |
| ASPG | 166183 | 551170 | 1717 | 447032 | 24880 | | ATL2 | 119787 | 456736 | 1793 | 413216 | 24923 |
| ASPG | 166183 | 549809 | 1718 | N/A | | | ATL2 | 119787 | 474535 | 1794 | N/A | |
| ASPG | 166183 | 552126 | 1719 | N/A | | | ATL2 | 119787 | 472097 | 1795 | N/A | |
| ASPG | 166183 | 556267 | 1720 | N/A | | 60 | ATL2 | 119787 | 451483 | 1796 | 404921 | 24924 |
| ASPG | 166183 | 550583 | 1721 | 446856 | 24881 | | ATL2 | 119787 | 486927 | 1797 | N/A | |
| ASPG | 166183 | 551871 | 1722 | N/A | | | ATL2 | 119787 | 416222 | 1798 | 406004 | 24925 |
| ASTN2 | 148219 | 288520 | 1723 | 288520 | 24882 | | ATL2 | 119787 | 629272 | 1799 | 486809 | 24926 |
| ASTN2 | 148219 | 341734 | 1724 | 339925 | 24883 | | ATL3 | 184743 | 398868 | 1800 | 381844 | 24927 |
| ASTN2 | 148219 | 373986 | 1725 | 363098 | 24884 | | ATL3 | 184743 | 538786 | 1801 | 437593 | 24928 |
| ASTN2 | 148219 | 361209 | 1726 | 354504 | 24885 | 65 | ATL3 | 184743 | 540699 | 1802 | 441842 | 24929 |
| ASTN2 | 148219 | 417725 | 1727 | 412099 | 24886 | | ATL3 | 184743 | 535789 | 1803 | N/A | |

-continued

-continued

| Symbol | ENSG | ENST | SEQ ID | ENSP | SEQ ID |
|---|---|---|---|---|---|
| ATOH8 | 168874 | 469442 | 1804 | N/A | |
| ATOH8 | 168874 | 306279 | 1805 | 304676 | 24930 |
| ATOH8 | 168874 | 463422 | 1806 | N/A | |
| ATOH8 | 168874 | 473116 | 1807 | N/A | |
| ATOH8 | 168874 | 489682 | 1808 | N/A | |
| ATP13A4 | 127249 | 400270 | 1809 | 383129 | 24931 |
| ATP13A4 | 127249 | 428352 | 1810 | 395367 | 24932 |
| ATP13A4 | 127249 | 450950 | 1811 | 402023 | 24933 |
| ATP13A4 | 127249 | 392443 | 1812 | 376238 | 24934 |
| ATP13A4 | 127249 | 342695 | 1813 | 339182 | 24935 |
| ATP13A4 | 127249 | 482964 | 1814 | N/A | |
| ATP13A4 | 127249 | 474776 | 1815 | N/A | |
| ATP13A4 | 127249 | 437904 | 1816 | 401481 | 24936 |
| ATP13A4 | 127249 | 490925 | 1817 | N/A | |
| ATP13A4 | 127249 | 295548 | 1818 | 295548 | 24937 |
| ATP13A4 | 127249 | 489140 | 1819 | N/A | |
| ATP1A1 | 163399 | 418797 | 1820 | 400124 | 24938 |
| ATP1A1 | 163399 | 295598 | 1821 | 295598 | 24939 |
| ATP1A1 | 163399 | 488733 | 1822 | N/A | |
| ATP1A1 | 163399 | 369494 | 1823 | 358506 | 24940 |
| ATP1A1 | 163399 | 463382 | 1824 | N/A | |
| ATP1A1 | 163399 | 491156 | 1825 | N/A | |
| ATP1A1 | 163399 | 440951 | 1826 | 396236 | 24941 |
| ATP1A1 | 163399 | 479960 | 1827 | N/A | |
| ATP1A1 | 163399 | 495965 | 1828 | N/A | |
| ATP1A1 | 163399 | 369496 | 1829 | 358508 | 24942 |
| ATP1A1 | 163399 | 537345 | 1830 | 445306 | 24943 |
| ATP1A2 | 018625 | 472488 | 1831 | N/A | |
| ATP1A2 | 018625 | 478587 | 1832 | N/A | |
| ATP1A2 | 018625 | 361216 | 1833 | 354490 | 24944 |
| ATP1A2 | 018625 | 392233 | 1834 | 376066 | 24945 |
| ATP1A2 | 018625 | 468587 | 1835 | N/A | |
| ATP1A2 | 018625 | 447527 | 1836 | 411705 | 24946 |
| ATP1A2 | 018625 | 463989 | 1837 | N/A | |
| ATP1A2 | 018625 | 459972 | 1838 | N/A | |
| ATP1A3 | 105409 | 441343 | 1839 | 411503 | 24947 |
| ATP1A3 | 105409 | 302102 | 1840 | 302397 | 24948 |
| ATP1A3 | 105409 | 602133 | 1841 | 471581 | 24949 |
| ATP1A3 | 105409 | 545399 | 1842 | 444688 | 24950 |
| ATP1A3 | 105409 | 543770 | 1843 | 437577 | 24951 |
| ATP1A3 | 105409 | 485672 | 1844 | N/A | |
| ATP1A3 | 105409 | 473086 | 1845 | 469129 | 24952 |
| ATP1A3 | 105409 | 468774 | 1846 | N/A | |
| ATP1A3 | 105409 | 465007 | 1847 | N/A | |
| ATP1A3 | 105409 | 636197 | 1848 | 489877 | 24953 |
| ATP1A3 | 105409 | 636258 | 1849 | N/A | |
| ATP1A3 | 105409 | 636282 | 1850 | N/A | |
| ATP1A3 | 105409 | 637406 | 1851 | N/A | |
| ATP1B1 | 143153 | 494797 | 1852 | 477015 | 24954 |
| ATP1B1 | 143153 | 367815 | 1853 | 356789 | 24955 |
| ATP1B1 | 143153 | 367816 | 1854 | 356790 | 24956 |
| ATP1B2 | 129244 | 577026 | 1855 | 459145 | 24957 |
| ATP1B2 | 129244 | 250111 | 1856 | 250111 | 24958 |
| ATP1B2 | 129244 | 577113 | 1857 | 460499 | 24959 |
| ATP1B3 | 069849 | 475483 | 1858 | 417522 | 24960 |
| ATP1B3 | 069849 | 286371 | 1859 | 286371 | 24961 |
| ATP1B3 | 069849 | 465172 | 1860 | 418280 | 24962 |
| ATP1B3 | 069849 | 466678 | 1861 | 418952 | 24963 |
| ATP1B3 | 069849 | 462082 | 1862 | 418353 | 24964 |
| ATP1B3 | 069849 | 495216 | 1863 | 419962 | 24965 |
| ATP1B3 | 069849 | 482635 | 1864 | N/A | |
| ATP1B3 | 069849 | 487199 | 1865 | 417608 | 24966 |
| ATP1B3 | 069849 | 484727 | 1866 | N/A | |
| ATP1B3 | 069849 | 486782 | 1867 | N/A | |
| ATP2A3 | 074370 | 397041 | 1868 | 380234 | 24967 |
| ATP2A3 | 074370 | 397035 | 1869 | 380229 | 24968 |
| ATP2A3 | 074370 | 574999 | 1870 | N/A | |
| ATP2A3 | 074370 | 570773 | 1871 | N/A | |
| ATP2A3 | 074370 | 570845 | 1872 | 461480 | 24969 |
| ATP2A3 | 074370 | 359983 | 1873 | 353072 | 24970 |
| ATP2A3 | 074370 | 352011 | 1874 | 301387 | 24971 |
| ATP2A3 | 074370 | 397043 | 1875 | 380236 | 24972 |
| ATP2A3 | 074370 | 572116 | 1876 | 458865 | 24973 |
| ATP2A3 | 074370 | 571245 | 1877 | N/A | |
| ATP2A3 | 074370 | 576957 | 1878 | N/A | |
| ATP2A3 | 074370 | 572176 | 1879 | N/A | |
| ATP2A3 | 074370 | 572694 | 1880 | N/A | |
| ATP2A3 | 074370 | 574202 | 1881 | N/A | |
| ATP2A3 | 074370 | 309890 | 1882 | 312577 | 24974 |
| ATP2B2 | 157087 | 352432 | 1883 | 324172 | 24975 |
| ATP2B2 | 157087 | 383800 | 1884 | 373311 | 24976 |
| ATP2B2 | 157087 | 460129 | 1885 | 424494 | 24977 |
| ATP2B2 | 157087 | 397077 | 1886 | 380267 | 24978 |
| ATP2B2 | 157087 | 452124 | 1887 | 414854 | 24979 |
| ATP2B2 | 157087 | 467702 | 1888 | N/A | |
| ATP2B2 | 157087 | 468426 | 1889 | N/A | |
| ATP2B2 | 157087 | 480680 | 1890 | N/A | |
| ATP2B2 | 157087 | 638646 | 1891 | 492732 | 24980 |
| ATP2B2 | 157087 | 360273 | 1892 | 353414 | 24981 |
| ATP2B3 | 067842 | 349466 | 1893 | 343886 | 24982 |
| ATP2B3 | 067842 | 370186 | 1894 | 359205 | 24983 |
| ATP2B3 | 067842 | 393842 | 1895 | 377425 | 24984 |
| ATP2B3 | 067842 | 359149 | 1896 | 352062 | 24985 |
| ATP2B3 | 067842 | 460549 | 1897 | N/A | |
| ATP2B3 | 067842 | 496610 | 1898 | N/A | |
| ATP2B3 | 067842 | 263519 | 1899 | 263519 | 24986 |
| ATP2C2 | 064270 | 262429 | 1900 | 262429 | 24987 |
| ATP2C2 | 064270 | 416219 | 1901 | 397925 | 24988 |
| ATP2C2 | 064270 | 565631 | 1902 | N/A | |
| ATP2C2 | 064270 | 569207 | 1903 | 456595 | 24989 |
| ATP2C2 | 064270 | 565546 | 1904 | N/A | |
| ATP2C2 | 064270 | 420010 | 1905 | N/A | |
| ATP2C2 | 064270 | 565927 | 1906 | N/A | |
| ATP2C2 | 064270 | 568160 | 1907 | N/A | |
| ATP2C2 | 064270 | 563340 | 1908 | N/A | |
| ATP2C2 | 064270 | 564099 | 1909 | N/A | |
| ATP2C2 | 064270 | 567892 | 1910 | N/A | |
| ATP2C2 | 064270 | 567222 | 1911 | N/A | |
| ATP2C2 | 064270 | 624933 | 1912 | N/A | |
| ATP2C2 | 064270 | 567629 | 1913 | N/A | |
| ATP2C2 | 064270 | 566874 | 1914 | N/A | |
| ATP6V0B | 117410 | 472505 | 1915 | 432994 | 24990 |
| ATP6V0B | 117410 | 472174 | 1916 | 431605 | 24991 |
| ATP6V0B | 117410 | 532642 | 1917 | 434729 | 24992 |
| ATP6V0B | 117410 | 236067 | 1918 | 236067 | 24993 |
| ATP6V0B | 117410 | 471859 | 1919 | 432754 | 24994 |
| ATP6V0B | 117410 | 472277 | 1920 | N/A | |
| ATP6V0B | 117410 | 461670 | 1921 | 435396 | 24995 |
| ATP6V0B | 117410 | 468183 | 1922 | N/A | |
| ATP6V0B | 117410 | 473485 | 1923 | N/A | |
| ATP6V0B | 117410 | 496131 | 1924 | N/A | |
| ATP6V0B | 117410 | 498208 | 1925 | 431375 | 24996 |
| ATP6V0B | 117410 | 532072 | 1926 | N/A | |
| ATP6V0B | 117410 | 498664 | 1927 | 434094 | 24997 |
| ATP8A1 | 124406 | 514372 | 1928 | 426495 | 24998 |
| ATP8A1 | 124406 | 381668 | 1929 | 371084 | 24999 |
| ATP8A1 | 124406 | 264449 | 1930 | 264449 | 25000 |
| ATP8A1 | 124406 | 511858 | 1931 | N/A | |
| ATP8A1 | 124406 | 506602 | 1932 | 421164 | 25001 |
| ATP8A1 | 124406 | 515872 | 1933 | 426935 | 25002 |
| ATP8A1 | 124406 | 506713 | 1934 | N/A | |
| ATP8A1 | 124406 | 504510 | 1935 | N/A | |
| ATP8A1 | 124406 | 504024 | 1936 | 427295 | 25003 |
| ATP8A1 | 124406 | 510289 | 1937 | 426636 | 25004 |
| ATP8B1 | 081923 | 283684 | 1938 | 283684 | 25005 |
| ATP8B1 | 081923 | 588255 | 1939 | 468266 | 25006 |
| ATP8B1 | 081923 | 589147 | 1940 | N/A | |
| ATP8B1 | 081923 | 591728 | 1941 | 467767 | 25007 |
| ATP8B1 | 081923 | 585322 | 1942 | 468751 | 25008 |
| ATRNL1 | 107518 | 616894 | 1943 | 483722 | 25009 |
| ATRNL1 | 107518 | 609571 | 1944 | 476902 | 25010 |
| ATRNL1 | 107518 | 526946 | 1945 | 431423 | 25011 |
| ATRNL1 | 107518 | 527407 | 1946 | 473412 | 25012 |
| ATRNL1 | 107518 | 355044 | 1947 | 347152 | 25013 |
| ATRNL1 | 107518 | 524503 | 1948 | N/A | |
| ATRNL1 | 107518 | 526313 | 1949 | 434118 | 25014 |
| ATRNL1 | 107518 | 534530 | 1950 | N/A | |
| ATRNL1 | 107518 | 424738 | 1951 | N/A | |
| ATRNL1 | 107518 | 449616 | 1952 | N/A | |
| ATXN1 | 124788 | 244769 | 1953 | 244769 | 25015 |
| ATXN1 | 124788 | 483591 | 1954 | N/A | |
| ATXN1 | 124788 | 473388 | 1955 | N/A | |

-continued

| Symbol | ENSG | ENST | SEQ ID | ENSP | SEQ ID |
|---|---|---|---|---|---|
| ATXN1 | 124788 | 495178 | 1956 | N/A | |
| ATXN1 | 124788 | 483954 | 1957 | N/A | |
| ATXN1 | 124788 | 467008 | 1958 | N/A | |
| ATXN1 | 124788 | 498374 | 1959 | N/A | |
| ATXN1 | 124788 | 492857 | 1960 | N/A | |
| ATXN1 | 124788 | 479680 | 1961 | N/A | |
| ATXN1 | 124788 | 436367 | 1962 | 416360 | 25016 |
| ATXN7L2 | 162650 | 463678 | 1963 | 474312 | 25017 |
| ATXN7L2 | 162650 | 369870 | 1964 | 358886 | 25018 |
| ATXN7L2 | 162650 | 497545 | 1965 | N/A | |
| ATXN7L2 | 162650 | 604728 | 1966 | N/A | |
| ATXN7L2 | 162650 | 369869 | 1967 | N/A | |
| ATXN7L2 | 162650 | 459635 | 1968 | N/A | |
| AVPI1 | 119986 | 370626 | 1969 | 359660 | 25019 |
| AXL | 167601 | 301178 | 1970 | 301178 | 25020 |
| AXL | 167601 | 359092 | 1971 | 351995 | 25021 |
| AXL | 167601 | 599659 | 1972 | N/A | |
| AXL | 167601 | 594880 | 1973 | N/A | |
| AXL | 167601 | 593513 | 1974 | 471497 | 25022 |
| AZGP1 | 160862 | 483612 | 1975 | N/A | |
| AZGP1 | 160862 | 292401 | 1976 | 292401 | 25023 |
| AZGP1 | 160862 | 419575 | 1977 | 389942 | 25024 |
| AZGP1 | 160862 | 411734 | 1978 | 396093 | 25025 |
| AZGP1 | 160862 | 477251 | 1979 | N/A | |
| AZGP1 | 160862 | 495765 | 1980 | N/A | |
| AZIN1 | 155096 | 337198 | 1981 | 337180 | 25026 |
| AZIN1 | 155096 | 347770 | 1982 | 321507 | 25027 |
| AZIN1 | 155096 | 518697 | 1983 | N/A | |
| AZIN1 | 155096 | 523071 | 1984 | N/A | |
| AZIN1 | 155096 | 521536 | 1985 | 475919 | 25028 |
| AZIN1 | 155096 | 522311 | 1986 | N/A | |
| AZIN1 | 155096 | 520402 | 1987 | 429449 | 25029 |
| AZIN1 | 155096 | 518353 | 1988 | 429215 | 25030 |
| AZIN1 | 155096 | 518940 | 1989 | N/A | |
| AZIN1 | 155096 | 517581 | 1990 | N/A | |
| B3GALT4 | 236802 | 430971 | 1991 | 414880 | 25031 |
| B3GALT4 | 235155 | 419471 | 1992 | 398660 | 25032 |
| B3GALT4 | 206285 | 383209 | 1993 | 372696 | 25033 |
| B3GALT4 | 226936 | 415322 | 1994 | 394876 | 25034 |
| B3GALT4 | 235863 | 451237 | 1995 | 390784 | 25035 |
| B3GALT4 | 235863 | 606990 | 1996 | N/A | |
| B3GAT2 | 112309 | 230053 | 1997 | 230053 | 25036 |
| B3GAT2 | 112309 | 615536 | 1998 | 481320 | 25037 |
| B3GLCT | 187676 | 343307 | 1999 | 343002 | 25038 |
| B3GLCT | 187676 | 461652 | 2000 | N/A | |
| B3GNT5 | 176597 | 326505 | 2001 | 316173 | 25039 |
| B3GNT5 | 176597 | 493370 | 2002 | N/A | |
| B3GNT5 | 176597 | 480551 | 2003 | N/A | |
| B3GNT5 | 176597 | 464191 | 2004 | 418785 | 25040 |
| B3GNT5 | 176597 | 460419 | 2005 | 420778 | 25041 |
| B3GNT5 | 176597 | 464923 | 2006 | 418477 | 25042 |
| B3GNT5 | 176597 | 496270 | 2007 | N/A | |
| B3GNT5 | 176597 | 465010 | 2008 | 417868 | 25043 |
| B3GNT5 | 176597 | 488301 | 2009 | N/A | |
| B3GNT5 | 176597 | 477699 | 2010 | N/A | |
| B3GNT5 | 176597 | 481531 | 2011 | 417301 | 25044 |
| B3GNT5 | 176597 | 462559 | 2012 | N/A | |
| B3GNT7 | 156966 | 287590 | 2013 | 287590 | 25045 |
| B3GNT7 | 156966 | 479618 | 2014 | N/A | |
| B4GALT6 | 118276 | 578114 | 2015 | N/A | |
| B4GALT6 | 118276 | 306851 | 2016 | 306459 | 25046 |
| B4GALT6 | 118276 | 237019 | 2017 | 237019 | 25047 |
| B4GALT6 | 118276 | 383131 | 2018 | 372613 | 25048 |
| B4GALT6 | 118276 | 579372 | 2019 | 463961 | 25049 |
| BACH2 | 112182 | 257749 | 2020 | 257749 | 25050 |
| BACH2 | 112182 | 343122 | 2021 | 345642 | 25051 |
| BACH2 | 112182 | 481150 | 2022 | N/A | |
| BACH2 | 112182 | 406998 | 2023 | 384145 | 25052 |
| BACH2 | 112182 | 453877 | 2024 | 397668 | 25053 |
| BACH2 | 112182 | 470301 | 2025 | N/A | |
| BACH2 | 112182 | 493201 | 2026 | N/A | |
| BACH2 | 112182 | 472023 | 2027 | N/A | |
| BACH2 | 112182 | 494747 | 2028 | N/A | |
| BACH2 | 112182 | 537989 | 2029 | 437473 | 25054 |
| BAD | 002330 | 394532 | 2030 | 378040 | 25055 |
| BAD | 002330 | 309032 | 2031 | 309103 | 25056 |

-continued

| Symbol | ENSG | ENST | SEQ ID | ENSP | SEQ ID |
|---|---|---|---|---|---|
| BAD | 002330 | 544785 | 2032 | 440575 | 25057 |
| BAD | 002330 | 394531 | 2033 | 378039 | 25058 |
| BAD | 002330 | 493798 | 2034 | 438975 | 25059 |
| BAD | 002330 | 492141 | 2035 | 439202 | 25060 |
| BAD | 002330 | 544271 | 2036 | N/A | |
| BAG3 | 151929 | 369085 | 2037 | 358081 | 25061 |
| BAG3 | 151929 | 450186 | 2038 | 410036 | 25062 |
| BAIAP2 | 175866 | 321280 | 2039 | 315685 | 25063 |
| BAIAP2 | 175866 | 576470 | 2040 | N/A | |
| BAIAP2 | 175866 | 575750 | 2041 | 460344 | 25064 |
| BAIAP2 | 175866 | 570913 | 2042 | N/A | |
| BAIAP2 | 175866 | 575989 | 2043 | 458494 | 25065 |
| BAIAP2 | 175866 | 572329 | 2044 | 460492 | 25066 |
| BAIAP2 | 175866 | 428708 | 2045 | 401022 | 25067 |
| BAIAP2 | 175866 | 575712 | 2046 | 458964 | 25068 |
| BAIAP2 | 175866 | 575245 | 2047 | 461144 | 25069 |
| BAIAP2 | 175866 | 435091 | 2048 | 413069 | 25070 |
| BAIAP2 | 175866 | 321300 | 2049 | 316338 | 25071 |
| BAIAP2 | 175866 | 573894 | 2050 | N/A | |
| BAIAP2 | 175866 | 571530 | 2051 | 458202 | 25072 |
| BAIAP2 | 175866 | 573017 | 2052 | N/A | |
| BAIAP2 | 175866 | 572918 | 2053 | 460131 | 25073 |
| BAIAP2 | 175866 | 575958 | 2054 | 458522 | 25074 |
| BAIAP2 | 175866 | 573659 | 2055 | 461736 | 25075 |
| BAIAP2 | 175866 | 572073 | 2056 | 459787 | 25076 |
| BAIAP2 | 175866 | 573677 | 2057 | 458735 | 25077 |
| BAIAP2 | 175866 | 574804 | 2058 | 459730 | 25078 |
| BAIAP2 | 175866 | 576364 | 2059 | N/A | |
| BAIAP2 | 175866 | 574688 | 2060 | N/A | |
| BAIAP2 | 175866 | 577097 | 2061 | N/A | |
| BAIAP2 | 175866 | 576225 | 2062 | N/A | |
| BAIAP2 | 175866 | 575841 | 2063 | 461101 | 25079 |
| BAIAP2 | 175866 | 574027 | 2064 | N/A | |
| BAIAP2 | 175866 | 576756 | 2065 | 458440 | 25080 |
| BAIAP2 | 175866 | 416299 | 2066 | 391837 | 25081 |
| BAIAP2 | 175866 | 572498 | 2067 | 460350 | 25082 |
| BAIAP2 | 175866 | 576995 | 2068 | N/A | |
| BAMBI | 095739 | 375533 | 2069 | 361683 | 25083 |
| BAMBI | 095739 | 497699 | 2070 | N/A | |
| BARHL1 | 125492 | 263610 | 2071 | 263610 | 25084 |
| BARHL1 | 125492 | 542090 | 2072 | 444704 | 25085 |
| BARHL2 | 143032 | 370445 | 2073 | 359474 | 25086 |
| BASP1 | 176788 | 606445 | 2074 | 476090 | 25087 |
| BASP1 | 176788 | 322611 | 2075 | 319281 | 25088 |
| BASP1 | 176788 | 616743 | 2076 | 482066 | 25089 |
| BBS2 | 125124 | 564123 | 2077 | 463176 | 25090 |
| BBS2 | 125124 | 564459 | 2078 | 463731 | 25091 |
| BBS2 | 125124 | 568104 | 2079 | 456289 | 25092 |
| BBS2 | 125124 | 565781 | 2080 | N/A | |
| BBS2 | 125124 | 245157 | 2081 | 245157 | 25093 |
| BBS2 | 125124 | 562813 | 2082 | N/A | |
| BBS2 | 125124 | 569192 | 2083 | N/A | |
| BBS2 | 125124 | 566495 | 2084 | N/A | |
| BBS2 | 125124 | 561877 | 2085 | 454986 | 25094 |
| BBS2 | 125124 | 566410 | 2086 | N/A | |
| BBS2 | 125124 | 566452 | 2087 | N/A | |
| BBS2 | 125124 | 566210 | 2088 | N/A | |
| BBS2 | 125124 | 562012 | 2089 | 455651 | 25095 |
| BBS2 | 125124 | 562059 | 2090 | N/A | |
| BBS2 | 125124 | 569342 | 2091 | N/A | |
| BBS2 | 125124 | 561951 | 2092 | N/A | |
| BBS2 | 125124 | 561853 | 2093 | N/A | |
| BBS2 | 125124 | 565859 | 2094 | N/A | |
| BBS2 | 125124 | 569941 | 2095 | 456741 | 25096 |
| BBS2 | 125124 | 566689 | 2096 | N/A | |
| BBS2 | 125124 | 565378 | 2097 | N/A | |
| BCAR1 | 050820 | 393422 | 2098 | 377074 | 25097 |
| BCAR1 | 050820 | 162330 | 2099 | 162330 | 25098 |
| BCAR1 | 050820 | 562556 | 2100 | 455166 | 25099 |
| BCAR1 | 050820 | 563038 | 2101 | N/A | |
| BCAR1 | 050820 | 566982 | 2102 | N/A | |
| BCAR1 | 050820 | 535626 | 2103 | 440370 | 25100 |
| BCAR1 | 050820 | 538440 | 2104 | 443841 | 25101 |
| BCAR1 | 050820 | 418647 | 2105 | 391669 | 25102 |
| BCAR1 | 050820 | 542031 | 2106 | 440415 | 25103 |
| BCAR1 | 050820 | 420641 | 2107 | 392708 | 25104 |

-continued

-continued

| Symbol | ENSG | ENST | SEQ ID | ENSP | SEQ ID |
|---|---|---|---|---|---|
| BCAR1 | 050820 | 393420 | 2108 | 377072 | 25105 |
| BCAR1 | 050820 | 569340 | 2109 | 454702 | 25106 |
| BCAR1 | 050820 | 564170 | 2110 | N/A | |
| BCAR1 | 050820 | 568864 | 2111 | 456625 | 25107 |
| BCAR1 | 050820 | 564028 | 2112 | 455810 | 25108 |
| BCAR1 | 050820 | 566465 | 2113 | 456929 | 25109 |
| BCAR1 | 050820 | 569006 | 2114 | 458088 | 25110 |
| BCAR1 | 050820 | 561970 | 2115 | 457457 | 25111 |
| BCAR1 | 050820 | 563323 | 2116 | 457097 | 25112 |
| BCAR1 | 050820 | 567215 | 2117 | 457231 | 25113 |
| BCAR1 | 050820 | 563700 | 2118 | N/A | |
| BCAR1 | 050820 | 546196 | 2119 | 442161 | 25114 |
| BCAS1 | 064787 | 448484 | 2120 | 396361 | 25115 |
| BCAS1 | 064787 | 371435 | 2121 | 360490 | 25116 |
| BCAS1 | 064787 | 395961 | 2122 | 379290 | 25117 |
| BCAS1 | 064787 | 422805 | 2123 | 399936 | 25118 |
| BCAS2 | 116752 | 369541 | 2124 | 358554 | 25119 |
| BCAS2 | 116752 | 485021 | 2125 | N/A | |
| BCHE | 114200 | 264381 | 2126 | 264381 | 25120 |
| BCHE | 114200 | 497011 | 2127 | 419505 | 25121 |
| BCHE | 114200 | 482958 | 2128 | 419804 | 25122 |
| BCHE | 114200 | 479451 | 2129 | 418325 | 25123 |
| BCHE | 114200 | 488954 | 2130 | 418504 | 25124 |
| BCL11A | 119866 | 356842 | 2131 | 349300 | 25125 |
| BCL11A | 119866 | 359629 | 2132 | 352648 | 25126 |
| BCL11A | 119866 | 489516 | 2133 | 488390 | 25127 |
| BCL11A | 119866 | 479026 | 2134 | 488636 | 25128 |
| BCL11A | 119866 | 631857 | 2135 | 488886 | 25129 |
| BCL11A | 119866 | 492272 | 2136 | N/A | |
| BCL11A | 119866 | 335712 | 2137 | 338774 | 25130 |
| BCL11A | 119866 | 477659 | 2138 | N/A | |
| BCL11A | 119866 | 358510 | 2139 | 351307 | 25131 |
| BCL11A | 119866 | 409351 | 2140 | 487844 | 25132 |
| BCL11A | 119866 | 489183 | 2141 | N/A | |
| BCL11B | 127152 | 357195 | 2142 | 349723 | 25133 |
| BCL11B | 127152 | 345514 | 2143 | 280435 | 25134 |
| BCL11B | 127152 | 443726 | 2144 | 387419 | 25135 |
| BCL11B | 127152 | 357195 | 2145 | 349723 | 25136 |
| BCL11B | 127152 | 345514 | 2146 | 280435 | 25137 |
| BCL11B | 127152 | 443726 | 2147 | 387419 | 25138 |
| BDNF | 176697 | 439476 | 2148 | 389345 | 25139 |
| BDNF | 176697 | 525528 | 2149 | 437138 | 25140 |
| BDNF | 176697 | 395986 | 2150 | 379309 | 25141 |
| BDNF | 176697 | 533131 | 2151 | 432727 | 25142 |
| BDNF | 176697 | 356660 | 2152 | 349084 | 25143 |
| BDNF | 176697 | 418212 | 2153 | 400502 | 25144 |
| BDNF | 176697 | 533246 | 2154 | 432376 | 25145 |
| BDNF | 176697 | 530861 | 2155 | 435564 | 25146 |
| BDNF | 176697 | 530786 | 2156 | 433003 | 25147 |
| BDNF | 176697 | 395983 | 2157 | 379307 | 25148 |
| BDNF | 176697 | 438929 | 2158 | 414303 | 25149 |
| BDNF | 176697 | 584049 | 2159 | N/A | |
| BDNF | 176697 | 532997 | 2160 | 435805 | 25150 |
| BDNF | 176697 | 395981 | 2161 | 379305 | 25151 |
| BDNF | 176697 | 395978 | 2162 | 379302 | 25152 |
| BDNF | 176697 | 525950 | 2163 | 432035 | 25153 |
| BDNF | 176697 | 314915 | 2164 | 320002 | 25154 |
| BDNF | 176697 | 395980 | 2165 | 379304 | 25155 |
| BDNF | 176697 | 420794 | 2166 | 389564 | 25156 |
| BEAN1 | 166546 | 536005 | 2167 | 442793 | 25157 |
| BEAN1 | 166546 | 562849 | 2168 | 456822 | 25158 |
| BEAN1 | 166546 | 299694 | 2169 | 299694 | 25159 |
| BEAN1 | 166546 | 561796 | 2170 | 455212 | 25160 |
| BEAN1 | 166546 | 569272 | 2171 | N/A | |
| BEAN1 | 166546 | 618932 | 2172 | 477843 | 25161 |
| BEAN1 | 166546 | 564819 | 2173 | 456430 | 25162 |
| BEAN1 | 166546 | 563075 | 2174 | N/A | |
| BEAN1 | 166546 | 562146 | 2175 | 462088 | 25163 |
| BEAN1 | 166546 | 566654 | 2176 | N/A | |
| BEAN1 | 166546 | 622872 | 2177 | 483700 | 25164 |
| BEGAIN | 183092 | 443071 | 2178 | 411124 | 25165 |
| BEGAIN | 183092 | 554747 | 2179 | N/A | |
| BEGAIN | 183092 | 554274 | 2180 | N/A | |
| BEGAIN | 183092 | 554140 | 2181 | 451125 | 25166 |
| BEGAIN | 183092 | 557378 | 2182 | 450722 | 25167 |
| BEGAIN | 183092 | 554356 | 2183 | 452607 | 25168 |

| Symbol | ENSG | ENST | SEQ ID | ENSP | SEQ ID |
|---|---|---|---|---|---|
| BEGAIN | 183092 | 556188 | 2184 | 452157 | 25169 |
| BEGAIN | 183092 | 553553 | 2185 | 451397 | 25170 |
| BEGAIN | 183092 | 556751 | 2186 | N/A | |
| BEGAIN | 183092 | 637716 | 2187 | 490571 | 25171 |
| BEGAIN | 183092 | 355173 | 2188 | 347301 | 25172 |
| BEGAIN | 183092 | 637646 | 2189 | 489826 | 25173 |
| BEST3 | 127325 | 547208 | 2190 | 449868 | 25174 |
| BEST3 | 127325 | 331471 | 2191 | 329064 | 25175 |
| BEST3 | 127325 | 488961 | 2192 | 433213 | 25176 |
| BEST3 | 127325 | 330891 | 2193 | 332413 | 25177 |
| BEST3 | 127325 | 553096 | 2194 | 449548 | 25178 |
| BEST3 | 127325 | 476098 | 2195 | 434713 | 25179 |
| BEST3 | 127325 | 552295 | 2196 | 447689 | 25180 |
| BEST3 | 127325 | 548658 | 2197 | 446575 | 25181 |
| BEST3 | 127325 | 266661 | 2198 | 266661 | 25182 |
| BEST3 | 127325 | 529843 | 2199 | N/A | |
| BEST3 | 127325 | 551160 | 2200 | 449377 | 25183 |
| BEST3 | 127325 | 533674 | 2201 | N/A | |
| BGN | 182492 | 331595 | 2202 | 327336 | 25184 |
| BGN | 182492 | 472615 | 2203 | N/A | |
| BGN | 182492 | 480756 | 2204 | N/A | |
| BGN | 182492 | 431891 | 2205 | 402525 | 25185 |
| BGN | 182492 | 492658 | 2206 | N/A | |
| BHLHE22 | 180828 | 321870 | 2207 | 318799 | 25186 |
| BHLHE40 | 134107 | 256495 | 2208 | 256495 | 25187 |
| BHLHE40 | 134107 | 467610 | 2209 | N/A | |
| BHLHE40 | 134107 | 460806 | 2210 | N/A | |
| BHLHE40-AS1 | 235831 | 620618 | 2211 | N/A | |
| BHLHE40-AS1 | 235831 | 615178 | 2212 | N/A | |
| BHLHE40-AS1 | 235831 | 615017 | 2213 | N/A | |
| BHLHE40-AS1 | 235831 | 441386 | 2214 | N/A | |
| BICD1 | 151746 | 551848 | 2215 | 448933 | 25188 |
| BICD1 | 151746 | 550207 | 2216 | 447663 | 25189 |
| BICD1 | 151746 | 548411 | 2217 | 446793 | 25190 |
| BICD1 | 151746 | 281474 | 2218 | 281474 | 25191 |
| BICD1 | 151746 | 395758 | 2219 | 379107 | 25192 |
| BICD1 | 151746 | 551086 | 2220 | 447238 | 25193 |
| BICD1 | 151746 | 547680 | 2221 | 475837 | 25194 |
| BICD1 | 151746 | 552160 | 2222 | 481877 | 25195 |
| BICD1 | 151746 | 552226 | 2223 | N/A | |
| BICD1 | 151746 | 614004 | 2224 | N/A | |
| BICD2 | 185963 | 356884 | 2225 | 349351 | 25196 |
| BICD2 | 185963 | 375512 | 2226 | 364662 | 25197 |
| BLM | 197299 | 355112 | 2227 | 347232 | 25198 |
| BLM | 197299 | 560509 | 2228 | 454158 | 25199 |
| BLM | 197299 | 559724 | 2229 | 453359 | 25200 |
| BLM | 197299 | 559282 | 2230 | N/A | |
| BLM | 197299 | 558599 | 2231 | N/A | |
| BLM | 197299 | 559426 | 2232 | N/A | |
| BLM | 197299 | 560136 | 2233 | N/A | |
| BLM | 197299 | 560559 | 2234 | N/A | |
| BLM | 197299 | 558825 | 2235 | N/A | |
| BLM | 197299 | 560821 | 2236 | N/A | |
| BLNK | 095585 | 224337 | 2237 | 224337 | 25201 |
| BLNK | 095585 | 371176 | 2238 | 360218 | 25202 |
| BLNK | 095585 | 485193 | 2239 | N/A | |
| BLNK | 095585 | 467799 | 2240 | 466331 | 25203 |
| BLNK | 095585 | 468252 | 2241 | N/A | |
| BLNK | 095585 | 472763 | 2242 | N/A | |
| BLNK | 095585 | 495266 | 2243 | 465741 | 25204 |
| BLNK | 095585 | 427367 | 2244 | 391924 | 25205 |
| BLNK | 095585 | 413476 | 2245 | 397487 | 25206 |
| BMP2K | 138756 | 389010 | 2246 | 373662 | 25207 |
| BMP2K | 138756 | 502871 | 2247 | 421768 | 25208 |
| BMP2K | 138756 | 505725 | 2248 | N/A | |
| BMP2K | 138756 | 515075 | 2249 | N/A | |
| BMP2K | 138756 | 502613 | 2250 | 424668 | 25209 |
| BMP2K | 138756 | 507670 | 2251 | N/A | |
| BMP2K | 138756 | 335016 | 2252 | 334836 | 25210 |
| BMP2K | 138756 | 628286 | 2253 | 487317 | 25211 |
| BMP3 | 152785 | 282701 | 2254 | 282701 | 25212 |
| BMPER | 164619 | 448280 | 2255 | 398835 | 25213 |
| BMPER | 164619 | 297161 | 2256 | 297161 | 25214 |
| BMPER | 164619 | 496609 | 2257 | N/A | |
| BMPER | 164619 | 436222 | 2258 | 399843 | 25215 |
| BMPER | 164619 | 444773 | 2259 | 409998 | 25216 |

-continued

| Symbol | ENSG | ENST | SEQ ID | ENSP | SEQ ID |
|---|---|---|---|---|---|
| BMPER | 164619 | 494786 | 2260 | N/A | |
| BMPER | 164619 | 476525 | 2261 | N/A | |
| BMS1P21 | 283101 | 634565 | 2262 | N/A | |
| BNC2 | 173068 | 380672 | 2263 | 370047 | 25217 |
| BNC2 | 173068 | 484726 | 2264 | 431516 | 25218 |
| BNC2 | 173068 | 411752 | 2265 | 392212 | 25219 |
| BNC2 | 173068 | 418777 | 2266 | 408370 | 25220 |
| BNC2 | 173068 | 380667 | 2267 | 370042 | 25221 |
| BNC2 | 173068 | 380666 | 2268 | 370041 | 25222 |
| BNC2 | 173068 | 603713 | 2269 | 474045 | 25223 |
| BNC2 | 173068 | 486514 | 2270 | 474647 | 25224 |
| BNC2 | 173068 | 603313 | 2271 | 473935 | 25225 |
| BNC2 | 173068 | 468187 | 2272 | 474468 | 25226 |
| BNC2 | 173068 | 471301 | 2273 | 474832 | 25227 |
| BNC2 | 173068 | 613349 | 2274 | 477717 | 25228 |
| BNC2 | 173068 | 617779 | 2275 | 482793 | 25229 |
| BNC2 | 173068 | 545497 | 2276 | 444640 | 25230 |
| BOC | 144857 | 464546 | 2277 | 417362 | 25231 |
| BOC | 144857 | 495514 | 2278 | 418663 | 25232 |
| BOC | 144857 | 498710 | 2279 | 419022 | 25233 |
| BOC | 144857 | 485230 | 2280 | 420154 | 25234 |
| BOC | 144857 | 462425 | 2281 | 418118 | 25235 |
| BOC | 144857 | 273395 | 2282 | 273395 | 25236 |
| BOC | 144857 | 494687 | 2283 | 418260 | 25237 |
| BOC | 144857 | 471963 | 2284 | N/A | |
| BOC | 144857 | 484034 | 2285 | 417337 | 25238 |
| BOC | 144857 | 477178 | 2286 | N/A | |
| BOC | 144857 | 466059 | 2287 | N/A | |
| BOC | 144857 | 479182 | 2288 | N/A | |
| BOC | 144857 | 497495 | 2289 | N/A | |
| BOC | 144857 | 463971 | 2290 | N/A | |
| BOC | 144857 | 488486 | 2291 | 420056 | 25239 |
| BOC | 144857 | 473008 | 2292 | 418182 | 25240 |
| BOC | 144857 | 355385 | 2293 | 347546 | 25241 |
| BRINP2 | 198797 | 361539 | 2294 | 354481 | 25242 |
| BRINP2 | 198797 | 478325 | 2295 | N/A | |
| BRINP2 | 198797 | 460161 | 2296 | N/A | |
| BRINP3 | 162670 | 367462 | 2297 | 356432 | 25243 |
| BRINP3 | 162670 | 463404 | 2298 | N/A | |
| BRINP3 | 162670 | 631494 | 2299 | 487601 | 25244 |
| BRINP3 | 162670 | 445957 | 2300 | 393441 | 25245 |
| BRINP3 | 162670 | 633243 | 2301 | N/A | |
| BSG | 172270 | 545507 | 2302 | 473664 | 25246 |
| BSG | 172270 | 346916 | 2303 | 344707 | 25247 |
| BSG | 172270 | 333511 | 2304 | 333769 | 25248 |
| BSG | 172270 | 576925 | 2305 | N/A | |
| BSG | 172270 | 573216 | 2306 | 458665 | 25249 |
| BSG | 172270 | 353555 | 2307 | 343809 | 25250 |
| BSG | 172270 | 572899 | 2308 | N/A | |
| BSG | 172270 | 590218 | 2309 | N/A | |
| BSG | 172270 | 613627 | 2310 | 484849 | 25251 |
| BSG | 172270 | 618006 | 2311 | 478958 | 25252 |
| BSG | 172270 | 614867 | 2312 | 484624 | 25253 |
| BSG | 172270 | 573784 | 2313 | 473393 | 25254 |
| BSG | 172270 | 574970 | 2314 | N/A | |
| BSG | 172270 | 576984 | 2315 | 473528 | 25255 |
| BSG | 172270 | 571735 | 2316 | N/A | |
| BSG | 172270 | 618112 | 2317 | N/A | |
| BSN | 164061 | 296452 | 2318 | 296452 | 25256 |
| BSN | 164061 | 467456 | 2319 | N/A | |
| BTAF1 | 095564 | 265990 | 2320 | 265990 | 25257 |
| BTAF1 | 095564 | 471217 | 2321 | N/A | |
| BTAF1 | 095564 | 476401 | 2322 | N/A | |
| BTAF1 | 095564 | 544642 | 2323 | 439924 | 25258 |
| BTBD1 | 064726 | 261721 | 2324 | 261721 | 25259 |
| BTBD1 | 064726 | 379403 | 2325 | 368713 | 25260 |
| BTBD1 | 064726 | 559652 | 2326 | 453104 | 25261 |
| BTBD1 | 064726 | 558344 | 2327 | N/A | |
| BTBD1 | 064726 | 560015 | 2328 | N/A | |
| BTBD11 | 151136 | 280758 | 2329 | 280758 | 25262 |
| BTBD11 | 151136 | 420571 | 2330 | 413889 | 25263 |
| BTBD11 | 151136 | 490090 | 2331 | 447319 | 25264 |
| BTBD11 | 151136 | 550706 | 2332 | 447606 | 25265 |
| BTBD11 | 151136 | 415943 | 2333 | 407416 | 25266 |
| BTBD11 | 151136 | 357167 | 2334 | 349690 | 25267 |
| BTBD11 | 151136 | 494235 | 2335 | 448322 | 25268 |

-continued

| Symbol | ENSG | ENST | SEQ ID | ENSP | SEQ ID |
|---|---|---|---|---|---|
| BTBD17 | 204347 | 375366 | 2336 | 364515 | 25269 |
| BTG1 | 133639 | 256015 | 2337 | 256015 | 25270 |
| BTG1 | 133639 | 552315 | 2338 | 447551 | 25271 |
| BTG2 | 159388 | 475157 | 2339 | 433553 | 25272 |
| BTG2 | 159388 | 290551 | 2340 | 290551 | 25273 |
| BTG2 | 159388 | 475157 | 2341 | 433553 | 25274 |
| BTG2 | 159388 | 290551 | 2342 | 290551 | 25275 |
| BTN1A1 | 124557 | 244513 | 2343 | 244513 | 25276 |
| BTN1A1 | 124557 | 613186 | 2344 | 484707 | 25277 |
| BUB1B | 156970 | 560120 | 2345 | N/A | |
| BUB1B | 156970 | 287598 | 2346 | 287598 | 25278 |
| BUB1B | 156970 | 559414 | 2347 | N/A | |
| BUB1B | 156970 | 558715 | 2348 | 453861 | 25279 |
| BUB1B | 156970 | 412359 | 2349 | 398470 | 25280 |
| BUB1B | 156970 | 559733 | 2350 | 453643 | 25281 |
| BUB1B | 156970 | 559461 | 2351 | N/A | |
| BUB1B | 156970 | 557848 | 2352 | N/A | |
| BUB1B | 156970 | 559772 | 2353 | N/A | |
| BUB1B | 156970 | 558972 | 2354 | N/A | |
| BUB1B | 156970 | 558151 | 2355 | N/A | |
| BZW1 | 082153 | 450637 | 2356 | 412072 | 25282 |
| BZW1 | 082153 | 452206 | 2357 | 390766 | 25283 |
| BZW1 | 082153 | 410110 | 2358 | 387086 | 25284 |
| BZW1 | 082153 | 409600 | 2359 | 386474 | 25285 |
| BZW1 | 082153 | 464483 | 2360 | N/A | |
| BZW1 | 082153 | 460660 | 2361 | N/A | |
| BZW1 | 082153 | 409226 | 2362 | 386837 | 25286 |
| BZW1 | 082153 | 452790 | 2363 | 394316 | 25287 |
| BZW1 | 082153 | 447069 | 2364 | 393587 | 25288 |
| BZW1 | 082153 | 419090 | 2365 | 407268 | 25289 |
| BZW1 | 082153 | 463310 | 2366 | N/A | |
| BZW1 | 082153 | 491576 | 2367 | N/A | |
| BZW1 | 082153 | 359893 | 2368 | 395673 | 25290 |
| FOS | 170345 | 303562 | 2369 | 306245 | 25291 |
| FOS | 170345 | 554617 | 2370 | 450519 | 25292 |
| FOS | 170345 | 556324 | 2371 | N/A | |
| FOS | 170345 | 554212 | 2372 | 452443 | 25293 |
| FOS | 170345 | 535987 | 2373 | 442268 | 25294 |
| FOS | 170345 | 555242 | 2374 | 452386 | 25295 |
| FOS | 170345 | 555686 | 2375 | 452590 | 25296 |
| FOS | 170345 | 555672 | 2376 | 452440 | 25297 |
| FOS | 170345 | 557139 | 2377 | 451786 | 25298 |
| FOS | 170345 | 555347 | 2378 | 450886 | 25299 |
| FOS | 170345 | 303562 | 2379 | 306245 | 25300 |
| FOS | 170345 | 554617 | 2380 | 450519 | 25301 |
| FOS | 170345 | 556324 | 2381 | N/A | |
| FOS | 170345 | 554212 | 2382 | 452443 | 25302 |
| FOS | 170345 | 535987 | 2383 | 442268 | 25303 |
| FOS | 170345 | 555242 | 2384 | 452386 | 25304 |
| FOS | 170345 | 555686 | 2385 | 452590 | 25305 |
| FOS | 170345 | 555672 | 2386 | 452440 | 25306 |
| FOS | 170345 | 557139 | 2387 | 451786 | 25307 |
| FOS | 170345 | 555347 | 2388 | 450886 | 25308 |
| C11orf87 | 185742 | 327419 | 2389 | 331581 | 25309 |
| C11orf87 | 185742 | 327419 | 2390 | 331581 | 25310 |
| C12orf49 | 111412 | 261318 | 2391 | 261318 | 25311 |
| C12orf49 | 111412 | 547630 | 2392 | 446478 | 25312 |
| C12orf49 | 111412 | 548356 | 2393 | 449151 | 25313 |
| C12orf49 | 111412 | 547606 | 2394 | 447722 | 25314 |
| ERG28 | 133935 | 256319 | 2395 | 256319 | 25315 |
| C14orf132 | 227051 | 555004 | 2396 | 490729 | 25316 |
| C14orf132 | 227051 | 553764 | 2397 | 489964 | 25317 |
| C14orf132 | 227051 | 556728 | 2398 | 490894 | 25318 |
| C14orf132 | 227051 | 553782 | 2399 | 490925 | 25319 |
| C14orf132 | 227051 | 555004 | 2400 | 490729 | 25320 |
| C14orf132 | 227051 | 553764 | 2401 | 489964 | 25321 |
| C14orf132 | 227051 | 556728 | 2402 | 490894 | 25322 |
| C14orf132 | 227051 | 553782 | 2403 | 490925 | 25323 |
| C14orf37 | 139971 | 556788 | 2404 | N/A | |
| C14orf37 | 139971 | 267485 | 2405 | 267485 | 25324 |
| C14orf37 | 139971 | 557175 | 2406 | N/A | |
| C14orf37 | 139971 | 334342 | 2407 | N/A | |
| C14orf37 | 139971 | 555101 | 2408 | 477692 | 25325 |
| C14orf37 | 139971 | 554218 | 2409 | N/A | |
| C1orf146 | 203910 | 370375 | 2410 | 359401 | 25326 |
| C1orf146 | 203910 | 370373 | 2411 | 359399 | 25327 |

-continued

-continued

| Symbol | ENSG | ENST | SEQ ID | ENSP | SEQ ID |
|---|---|---|---|---|---|
| C1orf21 | 116667 | 235307 | 2412 | 235307 | 25328 |
| C1orf21 | 116667 | 489143 | 2413 | N/A | |
| C1orf21 | 116667 | 367514 | 2414 | N/A | |
| C1orf21 | 116667 | 477517 | 2415 | N/A | |
| C1orf61 | 125462 | 608007 | 2416 | N/A | |
| C1orf61 | 125462 | 400991 | 2417 | 383776 | 25329 |
| C1orf61 | 125462 | 368242 | 2418 | 357225 | 25330 |
| C1orf61 | 125462 | 471156 | 2419 | N/A | |
| C1orf61 | 125462 | 497824 | 2420 | N/A | |
| C1orf61 | 125462 | 488498 | 2421 | N/A | |
| C1orf61 | 125462 | 465270 | 2422 | N/A | |
| C1orf61 | 125462 | 462458 | 2423 | N/A | |
| C1orf61 | 125462 | 486517 | 2424 | N/A | |
| C1orf61 | 125462 | 465570 | 2425 | N/A | |
| C1orf61 | 125462 | 310027 | 2426 | 310651 | 25331 |
| C1orf61 | 125462 | 368243 | 2427 | 357226 | 25332 |
| C1orf61 | 125462 | 498346 | 2428 | N/A | |
| C1orf61 | 125462 | 497822 | 2429 | N/A | |
| C1orf61 | 125462 | 492750 | 2430 | N/A | |
| C1orf61 | 125462 | 357975 | 2431 | 350661 | 25333 |
| C1orf61 | 125462 | 464238 | 2432 | N/A | |
| C1orf61 | 125462 | 482932 | 2433 | N/A | |
| C1orf61 | 125462 | 489918 | 2434 | N/A | |
| C1orf61 | 125462 | 484428 | 2435 | N/A | |
| C1orf61 | 125462 | 489877 | 2436 | N/A | |
| C1orf61 | 125462 | 476966 | 2437 | N/A | |
| C1orf61 | 125462 | 463309 | 2438 | N/A | |
| C1orf61 | 125462 | 464203 | 2439 | N/A | |
| C1orf61 | 125462 | 469813 | 2440 | N/A | |
| C1orf61 | 125462 | 495000 | 2441 | N/A | |
| C1orf61 | 125462 | 615748 | 2442 | 479346 | 25334 |
| STUM | 203685 | 366788 | 2443 | 355752 | 25335 |
| STUM | 203685 | 467495 | 2444 | N/A | |
| STUM | 203685 | 366789 | 2445 | 355753 | 25336 |
| C1QA | 173372 | 374642 | 2446 | 363773 | 25337 |
| C1QA | 173372 | 438241 | 2447 | 416841 | 25338 |
| C1QA | 173372 | 402322 | 2448 | 385564 | 25339 |
| C1QB | 173369 | 510260 | 2449 | 426317 | 25340 |
| C1QB | 173369 | 509305 | 2450 | 423689 | 25341 |
| C1QB | 173369 | 432749 | 2451 | 404606 | 25342 |
| C1QB | 173369 | 314933 | 2452 | 313967 | 25343 |
| C1QL1 | 131094 | 253407 | 2453 | 253407 | 25344 |
| C1QL2 | 144119 | 272520 | 2454 | 272520 | 25345 |
| C1QTNF4 | 172247 | 302514 | 2455 | 302274 | 25346 |
| C1QTNF4 | 172247 | 530097 | 2456 | 434548 | 25347 |
| C1RL | 139178 | 539803 | 2457 | 444157 | 25348 |
| CTRL | 139178 | 545280 | 2458 | 438286 | 25349 |
| C1RL | 139178 | 266542 | 2459 | 266542 | 25350 |
| C1RL | 139178 | 504702 | 2460 | N/A | |
| C1RL | 139178 | 544702 | 2461 | 441885 | 25351 |
| C1RL | 139178 | 534950 | 2462 | 439180 | 25352 |
| C1RL | 139178 | 543933 | 2463 | 437398 | 25353 |
| C1RL | 139178 | 537833 | 2464 | 438951 | 25354 |
| C1RL | 139178 | 534969 | 2465 | 437569 | 25355 |
| C1RL | 139178 | 545337 | 2466 | 442611 | 25356 |
| C1RL | 139178 | 543941 | 2467 | N/A | |
| C1RL | 139178 | 539927 | 2468 | N/A | |
| C2orf27A | 197927 | 624391 | 2469 | N/A | |
| C2orf27A | 197927 | 623058 | 2470 | N/A | |
| C2orf27A | 197927 | 463645 | 2471 | N/A | |
| C2orf27A | 197927 | 466372 | 2472 | N/A | |
| C2orf27A | 197927 | 481510 | 2473 | N/A | |
| C2orf69 | 178074 | 319974 | 2474 | 312770 | 25357 |
| C2orf69 | 178074 | 491721 | 2475 | N/A | |
| C2orf72 | 204128 | 373640 | 2476 | 362743 | 25358 |
| C2orf72 | 204128 | 477463 | 2477 | N/A | |
| C2orf72 | 204128 | 463834 | 2478 | N/A | |
| C2orf72 | 204128 | 373640 | 2479 | 362743 | 25359 |
| C2orf72 | 204128 | 477463 | 2480 | N/A | |
| C2orf2 | 204128 | 463834 | 2481 | N/A | |
| C2orf73 | 177994 | 486488 | 2482 | 417971 | 25360 |
| C2orf73 | 177994 | 405749 | 2483 | 385348 | 25361 |
| C2orf73 | 177994 | 398634 | 2484 | 381631 | 25362 |
| C2orf73 | 177994 | 317627 | 2485 | 325555 | 25363 |
| C2orf73 | 177994 | 447328 | 2486 | 389570 | 25364 |
| C2orf73 | 177994 | 414747 | 2487 | 403195 | 25365 |

| Symbol | ENSG | ENST | SEQ ID | ENSP | SEQ ID |
|---|---|---|---|---|---|
| C2orf73 | 177994 | 491538 | 2488 | N/A | |
| C2orf73 | 177994 | 615983 | 2489 | 481108 | 25366 |
| C3 | 125730 | 245907 | 2490 | 245907 | 25367 |
| C3 | 125730 | 601475 | 2491 | N/A | |
| C3 | 125730 | 599899 | 2492 | N/A | |
| C3 | 125730 | 602229 | 2493 | 469482 | 25368 |
| C3 | 125730 | 599668 | 2494 | N/A | |
| C3 | 125730 | 601008 | 2495 | 471384 | 25369 |
| C3 | 125730 | 596548 | 2496 | 469744 | 25370 |
| C3 | 125730 | 596179 | 2497 | N/A | |
| C3 | 125730 | 596238 | 2498 | N/A | |
| C3 | 125730 | 598805 | 2499 | N/A | |
| C3 | 125730 | 594005 | 2500 | N/A | |
| C3 | 125730 | 602053 | 2501 | N/A | |
| C3 | 125730 | 600763 | 2502 | N/A | |
| C3 | 125730 | 594270 | 2503 | N/A | |
| C3 | 125730 | 597442 | 2504 | N/A | |
| C3 | 125730 | 595577 | 2505 | N/A | |
| C3 | 125730 | 594936 | 2506 | N/A | |
| C3 | 125730 | 600744 | 2507 | 472044 | 25371 |
| C4orf22 | 197826 | 358105 | 2508 | 350818 | 25372 |
| C4orf22 | 197826 | 512931 | 2509 | N/A | |
| C4orf22 | 197826 | 514249 | 2510 | 426308 | 25373 |
| C4orf22 | 197826 | 502497 | 2511 | N/A | |
| C4orf22 | 197826 | 513920 | 2512 | 422569 | 25374 |
| C4orf22 | 197826 | 508675 | 2513 | 425786 | 25375 |
| C4orf22 | 197826 | 503883 | 2514 | N/A | |
| C4orf22 | 197826 | 508314 | 2515 | N/A | |
| C4orf22 | 197826 | 621014 | 2516 | 480723 | 25376 |
| C4orf33 | 151470 | 281146 | 2517 | 281146 | 25377 |
| C4orf33 | 151470 | 502887 | 2518 | 427406 | 25378 |
| C4orf33 | 151470 | 502360 | 2519 | N/A | |
| C4orf33 | 151470 | 508673 | 2520 | 427096 | 25379 |
| C4orf33 | 151470 | 508622 | 2521 | 427431 | 25380 |
| C4orf33 | 151470 | 425929 | 2522 | 401090 | 25381 |
| C6orf106 | 196821 | 374023 | 2523 | 363135 | 25382 |
| C6orf106 | 196821 | 374026 | 2524 | 363138 | 25383 |
| C6orf106 | 196821 | 374021 | 2525 | 363133 | 25384 |
| C8orf34 | 165084 | 518698 | 2526 | 427820 | 25385 |
| C8orf34 | 165084 | 349492 | 2527 | N/A | |
| C8orf34 | 165084 | 523686 | 2528 | 429102 | 25386 |
| C8orf34 | 165084 | 348340 | 2529 | 345255 | 25387 |
| C8orf34 | 165084 | 337103 | 2530 | 337174 | 25388 |
| C8orf34 | 165084 | 521406 | 2531 | 429081 | 25389 |
| C8orf34 | 165084 | 518515 | 2532 | N/A | |
| C8orf34 | 165084 | 325233 | 2533 | 319532 | 25390 |
| C8orf46 | 169085 | 482608 | 2534 | N/A | |
| C8orf46 | 169085 | 519702 | 2535 | N/A | |
| C8orf46 | 169085 | 498712 | 2536 | N/A | |
| C8orf46 | 169085 | 470796 | 2537 | N/A | |
| C8orf46 | 169085 | 490228 | 2538 | N/A | |
| C8orf46 | 169085 | 305454 | 2539 | 302260 | 25391 |
| C8orf46 | 169085 | 521495 | 2540 | 430501 | 25392 |
| C8orf46 | 169085 | 521813 | 2541 | N/A | |
| C8orf46 | 169085 | 460144 | 2542 | 430388 | 25393 |
| C8orf46 | 169085 | 450307 | 2543 | 473681 | 25394 |
| C8orf46 | 169085 | 484919 | 2544 | N/A | |
| C8orf46 | 169085 | 522977 | 2545 | 430141 | 25395 |
| C8orf46 | 169085 | 480005 | 2546 | 429883 | 25396 |
| C8orf46 | 169085 | 485639 | 2547 | N/A | |
| C8orf46 | 169085 | 488582 | 2548 | N/A | |
| C8orf46 | 169085 | 482608 | 2549 | N/A | |
| C8orf46 | 169085 | 519702 | 2550 | N/A | |
| C8orf46 | 169085 | 498712 | 2551 | N/A | |
| C8orf46 | 169085 | 470796 | 2552 | N/A | |
| C8orf46 | 169085 | 490228 | 2553 | N/A | |
| C8orf46 | 169085 | 305454 | 2554 | 302260 | 25397 |
| C8orf46 | 169085 | 521495 | 2555 | 430501 | 25398 |
| C8orf46 | 169085 | 521813 | 2556 | N/A | |
| C8orf46 | 169085 | 460144 | 2557 | 430388 | 25399 |
| C8orf46 | 169085 | 450307 | 2558 | 473681 | 25400 |
| C8orf46 | 169085 | 484919 | 2559 | N/A | |
| C8orf46 | 169085 | 522977 | 2560 | 430141 | 25401 |
| C8orf46 | 169085 | 480005 | 2561 | 429883 | 25402 |
| C8orf46 | 169085 | 485639 | 2562 | N/A | |
| C8orf46 | 169085 | 488582 | 2563 | N/A | |

| Symbol | ENSG | ENST | SEQ ID | ENSP | SEQ ID |
|---|---|---|---|---|---|
| C9orf135 | 204711 | 377197 | 2564 | 366402 | 25403 |
| C9orf135 | 204711 | 527647 | 2565 | 431855 | 25404 |
| C9orf135 | 204711 | 529446 | 2566 | 434032 | 25405 |
| C9orf135 | 204711 | 529131 | 2567 | 436701 | 25406 |
| C9orf135 | 204711 | 466872 | 2568 | N/A | |
| C9orf135 | 204711 | 495399 | 2569 | 433973 | 25407 |
| C9orf135 | 204711 | 480564 | 2570 | 433123 | 25408 |
| C9orf72 | 147894 | 380003 | 2571 | 369339 | 25409 |
| C9orf72 | 147894 | 488117 | 2572 | N/A | |
| C9orf72 | 147894 | 379997 | 2573 | 369333 | 25410 |
| C9orf72 | 147894 | 379995 | 2574 | 369331 | 25411 |
| C9orf72 | 147894 | 461679 | 2575 | N/A | |
| C9orf72 | 147894 | 619707 | 2576 | 482753 | 25412 |
| CA7 | 168748 | 338437 | 2577 | 345659 | 25413 |
| CA7 | 168748 | 548332 | 2578 | 447178 | 25414 |
| CA7 | 168748 | 394069 | 2579 | 377632 | 25415 |
| CA7 | 168748 | 338437 | 2580 | 345659 | 25416 |
| CA7 | 168748 | 548332 | 2581 | 447178 | 25417 |
| CA7 | 168748 | 394069 | 2582 | 377632 | 25418 |
| CAB39L | 102547 | 355854 | 2583 | 348113 | 25419 |
| CAB39L | 102547 | 409308 | 2584 | 386375 | 25420 |
| CAB39L | 102547 | 409130 | 2585 | 387245 | 25421 |
| CAB39L | 102547 | 425242 | 2586 | 416719 | 25422 |
| CAB39L | 102547 | 410043 | 2587 | 386328 | 25423 |
| CAB39L | 102547 | 457041 | 2588 | 409253 | 25424 |
| CAB39L | 102547 | 413278 | 2589 | 404028 | 25425 |
| CAB39L | 102547 | 409082 | 2590 | 386979 | 25426 |
| CAB39L | 102547 | 476943 | 2591 | N/A | |
| CAB39L | 102547 | 470410 | 2592 | N/A | |
| CAB39L | 102547 | 610540 | 2593 | 479669 | 25427 |
| CAB39L | 102547 | 347776 | 2594 | 261669 | 25428 |
| CABIN1 | 099991 | 454754 | 2595 | 394209 | 25429 |
| CABIN1 | 099991 | 263119 | 2596 | 263119 | 25430 |
| CABIN1 | 099991 | 405822 | 2597 | 384694 | 25431 |
| CABIN1 | 099991 | 445422 | 2598 | 412389 | 25432 |
| CABIN1 | 099991 | 398319 | 2599 | 381364 | 25433 |
| CABIN1 | 099991 | 474981 | 2600 | N/A | |
| CABIN1 | 099991 | 484593 | 2601 | N/A | |
| CABIN1 | 099991 | 496016 | 2602 | N/A | |
| CABIN1 | 099991 | 467937 | 2603 | N/A | |
| CABIN1 | 099991 | 337989 | 2604 | 336991 | 25434 |
| CABIN1 | 099991 | 495121 | 2605 | N/A | |
| CABIN1 | 099991 | 485008 | 2606 | N/A | |
| CABIN1 | 099991 | 459824 | 2607 | N/A | |
| CABIN1 | 099991 | 617531 | 2608 | 480560 | 25435 |
| CABIN1 | 281670 | 629653 | 2609 | N/A | |
| CABIN1 | 281670 | 626356 | 2610 | N/A | |
| CABIN1 | 281670 | 626232 | 2611 | N/A | |
| CABIN1 | 281670 | 627229 | 2612 | N/A | |
| CABIN1 | 281670 | 630829 | 2613 | N/A | |
| ABL1 | 097007 | 372348 | 2614 | 361423 | 25436 |
| ABL1 | 097007 | 393293 | 2615 | 376971 | 25437 |
| ABL1 | 097007 | 318560 | 2616 | 323315 | 25438 |
| CABLES1 | 134508 | 400473 | 2617 | 383321 | 25439 |
| CABLES1 | 134508 | 579963 | 2618 | 464435 | 25440 |
| CABLES1 | 134508 | 580153 | 2619 | 461994 | 25441 |
| CABLES1 | 134508 | 256925 | 2620 | 256925 | 25442 |
| CABLES1 | 134508 | 582882 | 2621 | 476575 | 25443 |
| CABLES1 | 134508 | 583220 | 2622 | N/A | |
| CABLES1 | 134508 | 580644 | 2623 | N/A | |
| CABLES1 | 134508 | 578052 | 2624 | N/A | |
| CABLES1 | 134508 | 585061 | 2625 | N/A | |
| CABLES1 | 134508 | 420687 | 2626 | 413851 | 25444 |
| CABP1 | 157782 | 316803 | 2627 | 317310 | 25445 |
| CABP1 | 157782 | 288616 | 2628 | 288616 | 25446 |
| CABP1 | 157782 | 351200 | 2629 | 288615 | 25447 |
| CABP1 | 157782 | 453000 | 2630 | 398959 | 25448 |
| CABP1 | 157782 | 498082 | 2631 | N/A | |
| CACHD1 | 158966 | 290039 | 2632 | 290039 | 25449 |
| CACHD1 | 158966 | 495994 | 2633 | N/A | |
| CACHD1 | 158966 | 470527 | 2634 | N/A | |
| CACHD1 | 158966 | 486580 | 2635 | N/A | |
| CACNA1A | 141837 | 360228 | 2636 | 353362 | 25450 |
| CACNA1A | 141837 | 637769 | 2637 | 489778 | 25451 |
| CACNA1A | 141837 | 635895 | 2638 | 490323 | 25452 |
| CACNA1A | 141837 | 638009 | 2639 | 489913 | 25453 |

| Symbol | ENSG | ENST | SEQ ID | ENSP | SEQ ID |
|---|---|---|---|---|---|
| CACNA1A | 141837 | 587525 | 2640 | 467729 | 25454 |
| CACNA1A | 141837 | 637736 | 2641 | 489861 | 25455 |
| CACNA1A | 141837 | 636389 | 2642 | 489992 | 25456 |
| CACNA1A | 141837 | 585802 | 2643 | 465598 | 25457 |
| CACNA1A | 141837 | 637432 | 2644 | 490617 | 25458 |
| CACNA1A | 141837 | 638029 | 2645 | 489829 | 25459 |
| CACNA1A | 141837 | 636012 | 2646 | 490223 | 25460 |
| CACNA1A | 141837 | 635727 | 2647 | 490001 | 25461 |
| CACNA1A | 141837 | 573710 | 2648 | 460092 | 25462 |
| CACNA1A | 141837 | 637276 | 2649 | 489777 | 25463 |
| CACNA1A | 141837 | 637927 | 2650 | 489715 | 25464 |
| CACNA1A | 141837 | 636473 | 2651 | 490173 | 25465 |
| CACNA1A | 141837 | 636549 | 2652 | 490578 | 25466 |
| CACNA1A | 141837 | 636610 | 2653 | N/A | |
| CACNA1A | 141837 | 636768 | 2654 | 490190 | 25467 |
| CACNA1A | 141837 | 637819 | 2655 | 490686 | 25468 |
| CACNA1A | 141837 | 636074 | 2656 | N/A | |
| CACNA1A | 141837 | 635988 | 2657 | N/A | |
| CACNA1A | 141837 | 638114 | 2658 | N/A | |
| CACNA1A | 141837 | 586190 | 2659 | N/A | |
| CACNA1A | 141837 | 636670 | 2660 | N/A | |
| CACNA1A | 141837 | 637832 | 2661 | N/A | |
| CACNA1A | 141837 | 637777 | 2662 | 490475 | 25469 |
| CACNA1A | 141837 | 574822 | 2663 | N/A | |
| CACNA1A | 141837 | 635742 | 2664 | N/A | |
| CACNA1A | 141837 | 637809 | 2665 | N/A | |
| CACNA1A | 141837 | 573891 | 2666 | 460276 | 25470 |
| CACNA1A | 141837 | 636058 | 2667 | 490075 | 25471 |
| CACNA1A | 141837 | 637297 | 2668 | 489692 | 25472 |
| CACNA1A | 141837 | 593267 | 2669 | N/A | |
| CACNA1A | 141837 | 637475 | 2670 | N/A | |
| CACNA1A | 141837 | 637004 | 2671 | N/A | |
| CACNA1A | 141837 | 637692 | 2672 | N/A | |
| CACNA1A | 141837 | 635917 | 2673 | N/A | |
| CACNA1A | 141837 | 636816 | 2674 | N/A | |
| CACNA1A | 141837 | 637168 | 2675 | N/A | |
| CACNA1A | 141837 | 636984 | 2676 | N/A | |
| CACNA1A | 141837 | 590205 | 2677 | N/A | |
| CACNA1A | 141837 | 637485 | 2678 | N/A | |
| CACNA1A | 141837 | 635786 | 2679 | N/A | |
| CACNA1A | 141837 | 637774 | 2680 | N/A | |
| CACNA1A | 141837 | 637966 | 2681 | N/A | |
| CACNA1A | 141837 | 637117 | 2682 | N/A | |
| CACNA1A | 141837 | 636974 | 2683 | N/A | |
| CACNA1A | 141837 | 636022 | 2684 | N/A | |
| CACNA1A | 141837 | 637625 | 2685 | N/A | |
| CACNA1A | 141837 | 593160 | 2686 | N/A | |
| CACNA1A | 141837 | 636966 | 2687 | N/A | |
| CACNA1A | 141837 | 637952 | 2688 | N/A | |
| CACNA1A | 141837 | 637981 | 2689 | N/A | |
| CACNA1A | 141837 | 574974 | 2690 | 459963 | 25473 |
| CACNA1A | 141837 | 637616 | 2691 | N/A | |
| CACNA1A | 141837 | 592864 | 2692 | 464729 | 25474 |
| CACNA1A | 141837 | 587451 | 2693 | N/A | |
| CACNA1A | 141837 | 614285 | 2694 | 479983 | 25475 |
| CACNA1B | 148408 | 277551 | 2695 | 277551 | 25476 |
| CACNA1B | 148408 | 371372 | 2696 | 360423 | 25477 |
| CACNA1B | 148408 | 371363 | 2697 | 360414 | 25478 |
| CACNA1B | 148408 | 371357 | 2698 | 360108 | 25479 |
| CACNA1B | 148408 | 413253 | 2699 | 413042 | 25480 |
| CACNA1B | 148408 | 277549 | 2700 | 277549 | 25481 |
| CACNA1B | 148408 | 371355 | 2701 | 360406 | 25482 |
| CACNA1D | 157388 | 637424 | 2702 | 489769 | 25483 |
| CACNA1D | 157388 | 350061 | 2703 | 288133 | 25484 |
| CACNA1D | 157388 | 636938 | 2704 | 490039 | 25485 |
| CACNA1D | 157388 | 288139 | 2705 | 288139 | 25486 |
| CACNA1D | 157388 | 636480 | 2706 | N/A | |
| CACNA1D | 157388 | 422281 | 2707 | 409174 | 25487 |
| CACNA1D | 157388 | 636570 | 2708 | 490183 | 25488 |
| CACNA1D | 157388 | 640483 | 2709 | 491921 | 25489 |
| CACNA1D | 157388 | 636627 | 2710 | 490889 | 25490 |
| CACNA1D | 157388 | 481085 | 2711 | 418045 | 25491 |
| CACNA1D | 157388 | 464429 | 2712 | N/A | |
| CACNA1D | 157388 | 481478 | 2713 | 418014 | 25492 |
| CACNA1D | 157388 | 498251 | 2714 | N/A | |
| CACNA1D | 157388 | 637301 | 2715 | 489962 | 25493 |

-continued

| Symbol | ENSG | ENST | SEQ ID | ENSP | SEQ ID |
|---|---|---|---|---|---|
| CACNA1D | 157388 | 637714 | 2716 | 490108 | 25494 |
| CACNA1D | 157388 | 636138 | 2717 | N/A | |
| CACNA1D | 157388 | 637078 | 2718 | N/A | |
| CACNA1D | 157388 | 636723 | 2719 | 490908 | 25495 |
| CACNA1D | 157388 | 638120 | 2720 | 489790 | 25496 |
| CACNA1D | 157388 | 638129 | 2721 | 490523 | 25497 |
| CACNA1D | 157388 | 636448 | 2722 | 490839 | 25498 |
| CACNA1D | 157388 | 637081 | 2723 | N/A | |
| CACNA1D | 157388 | 636595 | 2724 | N/A | |
| CACNA1D | 157388 | 636633 | 2725 | N/A | |
| CACNA1D | 157388 | 637589 | 2726 | N/A | |
| CACNA1D | 157388 | 636629 | 2727 | N/A | |
| CACNA1D | 157388 | 636999 | 2728 | N/A | |
| CACNA1D | 157388 | 637844 | 2729 | N/A | |
| CACNA1D | 157388 | 636581 | 2730 | N/A | |
| CACNA1D | 157388 | 636833 | 2731 | N/A | |
| CACNA1E | 198216 | 524607 | 2732 | 432038 | 25499 |
| CACNA1E | 198216 | 533229 | 2733 | N/A | |
| CACNA1E | 198216 | 367570 | 2734 | 356542 | 25500 |
| CACNA1E | 198216 | 621791 | 2735 | 481619 | 25501 |
| CACNA1E | 198216 | 360108 | 2736 | 353222 | 25502 |
| CACNA1E | 198216 | 367573 | 2737 | 356545 | 25503 |
| CACNA1E | 198216 | 357570 | 2738 | 350183 | 25504 |
| CACNA1E | 198216 | 367567 | 2739 | 356539 | 25505 |
| CACNA1E | 198216 | 621551 | 2740 | 483914 | 25506 |
| CACNA1E | 198216 | 358338 | 2741 | 351101 | 25507 |
| CACNA1G | 006283 | 360761 | 2742 | 353990 | 25508 |
| CACNA1G | 006283 | 352832 | 2743 | 339302 | 25509 |
| CACNA1G | 006283 | 442258 | 2744 | 409759 | 25510 |
| CACNA1G | 006283 | 416767 | 2745 | 392390 | 25511 |
| CACNA1G | 006283 | 502264 | 2746 | 425522 | 25512 |
| CACNA1G | 006283 | 512389 | 2747 | 426261 | 25513 |
| CACNA1G | 006283 | 513964 | 2748 | 425451 | 25514 |
| CACNA1G | 006283 | 514717 | 2749 | 422407 | 25515 |
| CACNA1G | 006283 | 510366 | 2750 | 426814 | 25516 |
| CACNA1G | 006283 | 503485 | 2751 | 427238 | 25517 |
| CACNA1G | 006283 | 507510 | 2752 | 423112 | 25518 |
| CACNA1G | 006283 | 511765 | 2753 | 427247 | 25519 |
| CACNA1G | 006283 | 507336 | 2754 | 420918 | 25520 |
| CACNA1G | 006283 | 506406 | 2755 | 426313 | 25521 |
| CACNA1G | 006283 | 504076 | 2756 | 425153 | 25522 |
| CACNA1G | 006283 | 513689 | 2757 | 426172 | 25523 |
| CACNA1G | 006283 | 507609 | 2758 | 423045 | 25524 |
| CACNA1G | 006283 | 503436 | 2759 | 427231 | 25525 |
| CACNA1G | 006283 | 510115 | 2760 | 427173 | 25526 |
| CACNA1G | 006283 | 515165 | 2761 | 426098 | 25527 |
| CACNA1G | 006283 | 514181 | 2762 | 425698 | 25528 |
| CACNA1G | 006283 | 515765 | 2763 | 426232 | 25529 |
| CACNA1G | 006283 | 514079 | 2764 | 423317 | 25530 |
| CACNA1G | 006283 | 507896 | 2765 | 421518 | 25531 |
| CACNA1G | 006283 | 511768 | 2766 | 424664 | 25532 |
| CACNA1G | 006283 | 505165 | 2767 | 422268 | 25533 |
| CACNA1G | 006283 | 503607 | 2768 | 426558 | 25534 |
| CACNA1G | 006283 | 515411 | 2769 | 423155 | 25535 |
| CACNA1G | 006283 | 429973 | 2770 | 414388 | 25536 |
| CACNA1G | 006283 | 359106 | 2771 | 352011 | 25537 |
| CACNA1G | 006283 | 358244 | 2772 | 350979 | 25538 |
| CACNA1G | 006283 | 570567 | 2773 | 459988 | 25539 |
| CACNA1G | 006283 | 506520 | 2774 | 427697 | 25540 |
| CACNA1G | 006283 | 354983 | 2775 | 347078 | 25541 |
| CACNA2D1 | 153956 | 356860 | 2776 | 349320 | 25542 |
| CACNA2D1 | 153956 | 469297 | 2777 | N/A | |
| CACNA2D1 | 153956 | 486539 | 2778 | N/A | |
| CACNA2D1 | 153956 | 443883 | 2779 | 409374 | 25543 |
| CACNA2D1 | 153956 | 466806 | 2780 | N/A | |
| CACNA2D1 | 153956 | 464354 | 2781 | N/A | |
| CACNA2D1 | 153956 | 475237 | 2782 | N/A | |
| CACNA2D1 | 153956 | 492734 | 2783 | N/A | |
| CACNA2D1 | 153956 | 423588 | 2784 | 405395 | 25544 |
| CACNA2D1 | 153956 | 461275 | 2785 | N/A | |
| CACNA2D1 | 153956 | 484706 | 2786 | N/A | |
| CACNA2D1 | 153956 | 356253 | 2787 | 348589 | 25545 |
| CACNA2D2 | 007402 | 423994 | 2788 | 407393 | 25546 |
| CACNA2D2 | 007402 | 429770 | 2789 | 404631 | 25547 |
| CACNA2D2 | 007402 | 266039 | 2790 | 266039 | 25548 |
| CACNA2D2 | 007402 | 360963 | 2791 | 354228 | 25549 |

-continued

| Symbol | ENSG | ENST | SEQ ID | ENSP | SEQ ID |
|---|---|---|---|---|---|
| CACNA2D2 | 007402 | 483620 | 2792 | N/A | |
| CACNA2D2 | 007402 | 424201 | 2793 | 390329 | 25550 |
| CACNA2D2 | 007402 | 479441 | 2794 | 418081 | 25551 |
| CACNA2D2 | 007402 | 487413 | 2795 | N/A | |
| CACNA2D3 | 157445 | 474759 | 2796 | 419101 | 25552 |
| CACNA2D3 | 157445 | 490478 | 2797 | 417279 | 25553 |
| CACNA2D3 | 157445 | 471363 | 2798 | 418228 | 25554 |
| CACNA2D3 | 157445 | 477024 | 2799 | 417318 | 25555 |
| CACNA2D3 | 157445 | 492460 | 2800 | 418028 | 25556 |
| CACNA2D3 | 157445 | 468658 | 2801 | 417455 | 25557 |
| CACNA2D3 | 157445 | 478466 | 2802 | N/A | |
| CACNA2D3 | 157445 | 478261 | 2803 | N/A | |
| CACNA2D3 | 157445 | 471865 | 2804 | N/A | |
| CACNA2D3 | 157445 | 415676 | 2805 | 389506 | 25558 |
| CACNA2D3 | 157445 | 620722 | 2806 | 478969 | 25559 |
| CACNA2D3 | 157445 | 288197 | 2807 | 288197 | 25560 |
| CACNB3 | 167535 | 547693 | 2808 | N/A | |
| CACNB3 | 167535 | 550391 | 2809 | 449389 | 25561 |
| CACNB3 | 167535 | 540990 | 2810 | 445495 | 25562 |
| CACNB3 | 167535 | 549226 | 2811 | N/A | |
| CACNB3 | 167535 | 548860 | 2812 | N/A | |
| CACNB3 | 167535 | 536187 | 2813 | 444160 | 25563 |
| CACNB3 | 167535 | 548874 | 2814 | 446611 | 25564 |
| CACNB3 | 167535 | 551716 | 2815 | N/A | |
| CACNB3 | 167535 | 550168 | 2816 | N/A | |
| CACNB3 | 167535 | 552465 | 2817 | N/A | |
| CACNB3 | 167535 | 550064 | 2818 | 448074 | 25565 |
| CACNB3 | 167535 | 552022 | 2819 | N/A | |
| CACNB3 | 167535 | 549971 | 2820 | N/A | |
| CACNB3 | 167535 | 547818 | 2821 | 448137 | 25566 |
| CACNB3 | 167535 | 547392 | 2822 | 446529 | 25567 |
| CACNB3 | 167535 | 301050 | 2823 | 301050 | 25568 |
| CACNB3 | 167535 | 548279 | 2824 | 449497 | 25569 |
| CACNB3 | 167535 | 550771 | 2825 | N/A | |
| CACNB3 | 167535 | 547230 | 2826 | 448304 | 25570 |
| CACNB3 | 167535 | 551544 | 2827 | 447462 | 25571 |
| CACNB3 | 167535 | 552812 | 2828 | N/A | |
| CACNB3 | 167535 | 550190 | 2829 | 447261 | 25572 |
| CACNB3 | 167535 | 550483 | 2830 | 448076 | 25573 |
| CACNB3 | 167535 | 552480 | 2831 | N/A | |
| CACNB4 | 182389 | 539935 | 2832 | 438949 | 25574 |
| CACNB4 | 182389 | 637547 | 2833 | 490124 | 25575 |
| CACNB4 | 182389 | 636901 | 2834 | 490145 | 25576 |
| CACNB4 | 182389 | 635738 | 2835 | 489881 | 25577 |
| CACNB4 | 182389 | 636130 | 2836 | 490607 | 25578 |
| CACNB4 | 182389 | 637217 | 2837 | 490250 | 25579 |
| CACNB4 | 182389 | 637309 | 2838 | 490127 | 25580 |
| CACNB4 | 182389 | 636350 | 2839 | 489621 | 25581 |
| CACNB4 | 182389 | 636598 | 2840 | 490247 | 25582 |
| CACNB4 | 182389 | 636831 | 2841 | N/A | |
| CACNB4 | 182389 | 636617 | 2842 | 490660 | 25583 |
| CACNB4 | 182389 | 635890 | 2843 | 489915 | 25584 |
| CACNB4 | 182389 | 638005 | 2844 | 489677 | 25585 |
| CACNB4 | 182389 | 636507 | 2845 | 490252 | 25586 |
| CACNB4 | 182389 | 637232 | 2846 | 490138 | 25587 |
| CACNB4 | 182389 | 635930 | 2847 | 489953 | 25588 |
| CACNB4 | 182389 | 636442 | 2848 | 489779 | 25589 |
| CACNB4 | 182389 | 636785 | 2849 | 489788 | 25590 |
| CACNB4 | 182389 | 638091 | 2850 | 489967 | 25591 |
| CACNB4 | 182389 | 636773 | 2851 | 489818 | 25592 |
| CACNB4 | 182389 | 637942 | 2852 | N/A | |
| CACNB4 | 182389 | 637132 | 2853 | 490651 | 25593 |
| CACNB4 | 182389 | 637762 | 2854 | 489876 | 25594 |
| CACNB4 | 182389 | 637550 | 2855 | 489943 | 25595 |
| CACNB4 | 182389 | 637312 | 2856 | 490144 | 25596 |
| CACNB4 | 182389 | 637436 | 2857 | 489746 | 25597 |
| CACNB4 | 182389 | 635803 | 2858 | N/A | |
| CACNB4 | 182389 | 636762 | 2859 | 490918 | 25598 |
| CACNB4 | 182389 | 534999 | 2860 | 443893 | 25599 |
| CACNB4 | 182389 | 637913 | 2861 | N/A | |
| CACNB4 | 182389 | 637284 | 2862 | 489787 | 25600 |
| CACNB4 | 182389 | 439467 | 2863 | 390161 | 25601 |
| CACNB4 | 182389 | 637319 | 2864 | N/A | |
| CACNB4 | 182389 | 637418 | 2865 | 489679 | 25602 |
| CACNB4 | 182389 | 397327 | 2866 | 380490 | 25603 |
| CACNB4 | 182389 | 637330 | 2867 | 490817 | 25604 |

-continued

| Symbol | ENSG | ENST | SEQ ID | ENSP | SEQ ID |
|---|---|---|---|---|---|
| CACNB4 | 182389 | 638010 | 2868 | 489883 | 25605 |
| CACNB4 | 182389 | 427385 | 2869 | 410978 | 25606 |
| CACNB4 | 182389 | 636721 | 2870 | 490795 | 25607 |
| CACNB4 | 182389 | 636664 | 2871 | 490572 | 25608 |
| CACNB4 | 182389 | 637779 | 2872 | 489732 | 25609 |
| CACNB4 | 182389 | 636380 | 2873 | 490488 | 25610 |
| CACNB4 | 182389 | 636108 | 2874 | 490176 | 25611 |
| CACNB4 | 182389 | 637535 | 2875 | 490891 | 25612 |
| CACNB4 | 182389 | 637491 | 2876 | 490510 | 25613 |
| CACNB4 | 182389 | 635904 | 2877 | 490430 | 25614 |
| CACNB4 | 182389 | 636810 | 2878 | N/A | |
| CACNB4 | 182389 | 637530 | 2879 | N/A | |
| CACNB4 | 182389 | 360283 | 2880 | 353425 | 25615 |
| CACNB4 | 182389 | 637514 | 2881 | 490304 | 25616 |
| CACNB4 | 182389 | 638150 | 2882 | 490501 | 25617 |
| CACNB4 | 182389 | 637956 | 2883 | 490298 | 25618 |
| CACNB4 | 182389 | 637007 | 2884 | 489772 | 25619 |
| CACNB4 | 182389 | 637828 | 2885 | 490443 | 25620 |
| CACNB4 | 182389 | 637765 | 2886 | N/A | |
| CACNB4 | 182389 | 201943 | 2887 | 201943 | 25621 |
| CACNB4 | 182389 | 637773 | 2888 | N/A | |
| CACNB4 | 182389 | 637216 | 2889 | 490910 | 25622 |
| CACNB4 | 182389 | 635731 | 2890 | N/A | |
| CACNB4 | 182389 | 636390 | 2891 | 490603 | 25623 |
| CACNB4 | 182389 | 636834 | 2892 | N/A | |
| CACNB4 | 182389 | 637622 | 2893 | N/A | |
| CACNB4 | 182389 | 636947 | 2894 | 490337 | 25624 |
| CACNB4 | 182389 | 637884 | 2895 | N/A | |
| CACNB4 | 182389 | 470066 | 2896 | N/A | |
| CACNB4 | 182389 | 636129 | 2897 | 489912 | 25625 |
| CACNB4 | 182389 | 638056 | 2898 | 490787 | 25626 |
| CACNB4 | 182389 | 434468 | 2899 | 399242 | 25627 |
| CACNB4 | 182389 | 635743 | 2900 | N/A | |
| CACNB4 | 182389 | 635835 | 2901 | N/A | |
| CACNB4 | 182389 | 475848 | 2902 | N/A | |
| CACNB4 | 182389 | 636496 | 2903 | 490249 | 25628 |
| CACNB4 | 182389 | 638083 | 2904 | N/A | |
| CACNB4 | 182389 | 637479 | 2905 | N/A | |
| CACNG3 | 006116 | 005284 | 2906 | 005284 | 25629 |
| CACNG4 | 075461 | 262138 | 2907 | 262138 | 25630 |
| CACNG5 | 075429 | 533854 | 2908 | 436836 | 25631 |
| CACNG5 | 075429 | 307139 | 2909 | 303092 | 25632 |
| CACNG8 | 142408 | 270458 | 2910 | 270458 | 25633 |
| CACNG8 | 142408 | 638874 | 2911 | 492637 | 25634 |
| CACYBP | 116161 | 613570 | 2912 | 479414 | 25635 |
| CACYBP | 116161 | 426793 | 2913 | 403674 | 25636 |
| CACYBP | 116161 | 461977 | 2914 | N/A | |
| CACYBP | 116161 | 367679 | 2915 | 356652 | 25637 |
| CACYBP | 116161 | 483307 | 2916 | N/A | |
| CACYBP | 116161 | 473925 | 2917 | N/A | |
| CACYBP | 116161 | 406752 | 2918 | 384139 | 25638 |
| CACYBP | 116161 | 405362 | 2919 | 385771 | 25639 |
| CACYBP | 116161 | 469173 | 2920 | N/A | |
| CADM3 | 162706 | 368124 | 2921 | 357106 | 25640 |
| CADM3 | 162706 | 368125 | 2922 | 357107 | 25641 |
| CADM3 | 162706 | 416746 | 2923 | 387802 | 25642 |
| CADPS | 163618 | 383710 | 2924 | 373215 | 25643 |
| CADPS | 163618 | 486172 | 2925 | N/A | |
| CADPS | 163618 | 473635 | 2926 | 418889 | 25644 |
| CADPS | 163618 | 357948 | 2927 | 350632 | 25645 |
| CADPS | 163618 | 474560 | 2928 | N/A | |
| CADPS | 163618 | 283269 | 2929 | 283269 | 25646 |
| CADPS | 163618 | 466621 | 2930 | 417568 | 25647 |
| CADPS | 163618 | 469292 | 2931 | N/A | |
| CADPS | 163618 | 462768 | 2932 | N/A | |
| CADPS | 163618 | 478408 | 2933 | N/A | |
| CADPS | 163618 | 478570 | 2934 | N/A | |
| CADPS | 163618 | 463002 | 2935 | N/A | |
| CADPS | 163618 | 491424 | 2936 | 418110 | 25648 |
| CADPS | 163618 | 468271 | 2937 | 417827 | 25649 |
| CADPS | 163618 | 478434 | 2938 | N/A | |
| CADPS | 163618 | 542833 | 2939 | 439528 | 25650 |
| CADPS | 163618 | 490424 | 2940 | N/A | |
| CADPS | 163618 | 490353 | 2941 | 418736 | 25651 |
| CADPS | 163618 | 613879 | 2942 | 482556 | 25652 |
| CADPS | 163618 | 612439 | 2943 | 484365 | 25653 |

-continued

| Symbol | ENSG | ENST | SEQ ID | ENSP | SEQ ID |
|---|---|---|---|---|---|
| CADPS2 | 081803 | 462699 | 2944 | 419418 | 25654 |
| CADPS2 | 081803 | 412584 | 2945 | 400401 | 25655 |
| CADPS2 | 081803 | 449022 | 2946 | 398481 | 25656 |
| CADPS2 | 081803 | 397721 | 2947 | 380833 | 25657 |
| CADPS2 | 081803 | 476131 | 2948 | N/A | |
| CADPS2 | 081803 | 334010 | 2949 | 333940 | 25658 |
| CADPS2 | 081803 | 615869 | 2950 | 484355 | 25659 |
| CADPS2 | 081803 | 313070 | 2951 | 325581 | 25660 |
| CALB1 | 104327 | 469032 | 2952 | N/A | |
| CALB1 | 104327 | 265431 | 2953 | 265431 | 25661 |
| CALB1 | 104327 | 518457 | 2954 | 429602 | 25662 |
| CALB1 | 104327 | 497376 | 2955 | N/A | |
| CALB1 | 104327 | 522070 | 2956 | N/A | |
| CALB1 | 104327 | 523716 | 2957 | 429246 | 25663 |
| CALB1 | 104327 | 520613 | 2958 | 430281 | 25664 |
| CALB1 | 104327 | 482702 | 2959 | N/A | |
| CALB1 | 104327 | 476853 | 2960 | N/A | |
| CALB1 | 104327 | 473670 | 2961 | N/A | |
| CALB1 | 104327 | 514406 | 2962 | 430192 | 25665 |
| CALB2 | 172137 | 302628 | 2963 | 307508 | 25666 |
| CALB2 | 172137 | 562305 | 2964 | 454639 | 25667 |
| CALB2 | 172137 | 490520 | 2965 | 454467 | 25668 |
| CALB2 | 172137 | 467817 | 2966 | N/A | |
| CALB2 | 172137 | 349553 | 2967 | 340294 | 25669 |
| CALB2 | 282830 | 635154 | 2968 | 489007 | 25670 |
| CALB2 | 282830 | 635371 | 2969 | 488916 | 25671 |
| CALB2 | 282830 | 635576 | 2970 | 489176 | 25672 |
| CALB2 | 282830 | 634959 | 2971 | 489458 | 25673 |
| CALB2 | 282830 | 634226 | 2972 | N/A | |
| CALCRL | 064989 | 392370 | 2973 | 376177 | 25674 |
| CALCRL | 064989 | 409998 | 2974 | 386972 | 25675 |
| CALCRL | 064989 | 410068 | 2975 | 387190 | 25676 |
| CALCRL | 064989 | 447403 | 2976 | 415626 | 25677 |
| CALCRL | 064989 | 410102 | 2977 | 386599 | 25678 |
| CALCRL | 064989 | 474212 | 2978 | N/A | |
| CALCRL | 064989 | 485973 | 2979 | N/A | |
| CALCRL | 064989 | 461244 | 2980 | N/A | |
| CALCRL | 064989 | 479784 | 2981 | N/A | |
| CALHM3 | 183128 | 369783 | 2982 | 358798 | 25679 |
| CALN1 | 183166 | 329008 | 2983 | 332498 | 25680 |
| CALN1 | 183166 | 395275 | 2984 | 378690 | 25681 |
| CALN1 | 183166 | 395276 | 2985 | 378691 | 25682 |
| CALN1 | 183166 | 431984 | 2986 | 410704 | 25683 |
| CALN1 | 183166 | 446128 | 2987 | 411806 | 25684 |
| CALN1 | 183166 | 405452 | 2988 | 384354 | 25685 |
| CALR | 179218 | 587486 | 2989 | N/A | |
| CALR | 179218 | 316448 | 2990 | 320866 | 25686 |
| CALR | 179218 | 590325 | 2991 | N/A | |
| CALR | 179218 | 588454 | 2992 | 465105 | 25687 |
| CALR | 179218 | 586760 | 2993 | 465918 | 25688 |
| CALR | 179218 | 586803 | 2994 | N/A | |
| CALR | 179218 | 586967 | 2995 | 466037 | 25689 |
| CALY | 130643 | 252939 | 2996 | 252939 | 25690 |
| CALY | 130643 | 467433 | 2997 | N/A | |
| CALY | 130643 | 467611 | 2998 | N/A | |
| CALY | 130643 | 368558 | 2999 | 357546 | 25691 |
| CALY | 130643 | 368555 | 3000 | 357543 | 25692 |
| CAMK1G | 008118 | 009105 | 3001 | 009105 | 25693 |
| CAMK1G | 008118 | 423146 | 3002 | 392173 | 25694 |
| CAMK1G | 008118 | 361322 | 3003 | 354861 | 25695 |
| CAMK1G | 008118 | 494990 | 3004 | N/A | |
| CAMK2A | 070808 | 348628 | 3005 | 261793 | 25696 |
| CAMK2A | 070808 | 351010 | 3006 | N/A | |
| CAMK2A | 070808 | 398376 | 3007 | 381412 | 25697 |
| CAMK2A | 070808 | 508662 | 3008 | N/A | |
| CAMK2A | 070808 | 515758 | 3009 | 427580 | 25698 |
| CAMK2A | 070808 | 510347 | 3010 | 426607 | 25699 |
| CAMK2A | 070808 | 507995 | 3011 | N/A | |
| CAMK2G | 148660 | 351293 | 3012 | 277853 | 25700 |
| CAMK2G | 148660 | 322635 | 3013 | 315599 | 25701 |
| CAMK2G | 148660 | 433289 | 3014 | 393784 | 25702 |
| CAMK2G | 148660 | 305762 | 3015 | 307082 | 25703 |
| CAMK2G | 148660 | 372765 | 3016 | 361851 | 25704 |
| CAMK2G | 148660 | 441192 | 3017 | 405561 | 25705 |
| CAMK2G | 148660 | 472912 | 3018 | N/A | |
| CAMK2G | 148660 | 474131 | 3019 | N/A | |

-continued

-continued

| Symbol | ENSG | ENST | SEQ ID | ENSP | SEQ ID |
|---|---|---|---|---|---|
| CAMK2G | 148660 | 477205 | 3020 | N/A | |
| CAMK2G | 148660 | 492020 | 3021 | N/A | |
| CAMK2G | 148660 | 477652 | 3022 | N/A | |
| CAMK2G | 148660 | 394762 | 3023 | 378243 | 25706 |
| CAMK2G | 148660 | 322680 | 3024 | 319060 | 25707 |
| CAMK2G | 148660 | 423381 | 3025 | 410298 | 25708 |
| CAMK4 | 152495 | 508074 | 3026 | 426940 | 25709 |
| CAMK4 | 152495 | 512453 | 3027 | 422634 | 25710 |
| CAMK4 | 152495 | 282356 | 3028 | 282356 | 25711 |
| CAMK4 | 152495 | 504544 | 3029 | 423761 | 25712 |
| CAMK4 | 152495 | 515231 | 3030 | 424912 | 25713 |
| CAMK4 | 152495 | 509408 | 3031 | N/A | |
| CAMK4 | 152495 | 514007 | 3032 | 421606 | 25714 |
| CAMK4 | 152495 | 501090 | 3033 | N/A | |
| CAMK4 | 152495 | 502916 | 3034 | N/A | |
| CAMK4 | 152495 | 505763 | 3035 | N/A | |
| CAMK4 | 152495 | 509645 | 3036 | N/A | |
| CAMK4 | 152495 | 510858 | 3037 | N/A | |
| CAMK4 | 152495 | 512890 | 3038 | N/A | |
| CAMKK2 | 110931 | 392474 | 3039 | 376266 | 25715 |
| CAMKK2 | 110931 | 347034 | 3040 | 321230 | 25716 |
| CAMKK2 | 110931 | 538733 | 3041 | 445944 | 25717 |
| CAMKK2 | 110931 | 337174 | 3042 | 336634 | 25718 |
| CAMKK2 | 110931 | 324774 | 3043 | 312741 | 25719 |
| CAMKK2 | 110931 | 545538 | 3044 | 441352 | 25720 |
| CAMKK2 | 110931 | 412367 | 3045 | 388368 | 25721 |
| CAMKK2 | 110931 | 404169 | 3046 | 384600 | 25722 |
| CAMKK2 | 110931 | 402834 | 3047 | 384591 | 25723 |
| CAMKK2 | 110931 | 446440 | 3048 | 388273 | 25724 |
| CAMKK2 | 110931 | 392473 | 3049 | 376265 | 25725 |
| CAMKK2 | 110931 | 535524 | 3050 | N/A | |
| CAMKK2 | 110931 | 542540 | 3051 | N/A | |
| CAMKK2 | 110931 | 539380 | 3052 | N/A | |
| CAMKK2 | 110931 | 543477 | 3053 | 444894 | 25726 |
| CAMKK2 | 110931 | 544485 | 3054 | 445400 | 25727 |
| CAMKV | 164076 | 475665 | 3055 | N/A | |
| CAMKV | 164076 | 296471 | 3056 | 296471 | 25728 |
| CAMKV | 164076 | 488336 | 3057 | 418809 | 25729 |
| CAMKV | 164076 | 463537 | 3058 | 417614 | 25730 |
| CAMKV | 164076 | 477224 | 3059 | 419195 | 25731 |
| CAMKV | 164076 | 487726 | 3060 | 420139 | 25732 |
| CAMKV | 164076 | 467248 | 3061 | 420053 | 25733 |
| CAMKV | 164076 | 466940 | 3062 | 420724 | 25734 |
| CAMKV | 164076 | 478149 | 3063 | N/A | |
| CAMKV | 164076 | 466535 | 3064 | 420766 | 25735 |
| CAMKV | 164076 | 483811 | 3065 | N/A | |
| CAMKV | 164076 | 480398 | 3066 | 420000 | 25736 |
| CAMKV | 164076 | 472895 | 3067 | N/A | |
| CAMKV | 164076 | 479704 | 3068 | N/A | |
| CAMKV | 164076 | 498324 | 3069 | N/A | |
| CAMKV | 164076 | 476105 | 3070 | N/A | |
| CAMKV | 164076 | 620470 | 3071 | 484045 | 25737 |
| CAP2 | 112186 | 229922 | 3072 | 229922 | 25738 |
| CAP2 | 112186 | 489374 | 3073 | 417705 | 25739 |
| CAP2 | 112186 | 378990 | 3074 | 368275 | 25740 |
| CAP2 | 112186 | 493172 | 3075 | 417208 | 25741 |
| CAP2 | 112186 | 479291 | 3076 | 420615 | 25742 |
| CAP2 | 112186 | 465994 | 3077 | 418604 | 25743 |
| CAP2 | 112186 | 476263 | 3078 | 419906 | 25744 |
| CAP2 | 112186 | 616440 | 3079 | 483435 | 25745 |
| CAP2 | 112186 | 611958 | 3080 | 482279 | 25746 |
| CAPN1 | 014216 | 528396 | 3081 | 435847 | 25747 |
| CAPN1 | 014216 | 529133 | 3082 | 432512 | 25748 |
| CAPN1 | 014216 | 533820 | 3083 | 435272 | 25749 |
| CAPN1 | 014216 | 527739 | 3084 | 433823 | 25750 |
| CAPN1 | 014216 | 526966 | 3085 | 431528 | 25751 |
| CAPN1 | 014216 | 533129 | 3086 | 431686 | 25752 |
| CAPN1 | 014216 | 524773 | 3087 | 434176 | 25753 |
| CAPN1 | 014216 | 530442 | 3088 | N/A | |
| CAPN1 | 014216 | 279247 | 3089 | 279247 | 25754 |
| CAPN1 | 014216 | 528739 | 3090 | N/A | |
| CAPN1 | 014216 | 532285 | 3091 | 436693 | 25755 |
| CAPN1 | 014216 | 527189 | 3092 | N/A | |
| CAPN1 | 014216 | 527469 | 3093 | N/A | |
| CAPN1 | 014216 | 534373 | 3094 | 431793 | 25756 |
| CAPN1 | 014216 | 526954 | 3095 | 436002 | 25757 |

| Symbol | ENSG | ENST | SEQ ID | ENSP | SEQ ID |
|---|---|---|---|---|---|
| CAPN1 | 014216 | 531068 | 3096 | 435092 | 25758 |
| CAPN1 | 014216 | 527699 | 3097 | 431172 | 25759 |
| CAPN1 | 014216 | 533909 | 3098 | 435198 | 25760 |
| CAPN1 | 014216 | 527323 | 3099 | 431984 | 25761 |
| CAPN1 | 014216 | 526468 | 3100 | 433366 | 25762 |
| CAPN1 | 014216 | 527897 | 3101 | N/A | |
| CAPN1 | 014216 | 533079 | 3102 | N/A | |
| CAPN1 | 014216 | 527887 | 3103 | N/A | |
| CAPN1 | 014216 | 530495 | 3104 | N/A | |
| CAPN1 | 014216 | 525013 | 3105 | N/A | |
| CAPN1 | 014216 | 528165 | 3106 | N/A | |
| CAPN1 | 014216 | 533704 | 3107 | N/A | |
| CAPN1 | 014216 | 530567 | 3108 | N/A | |
| CAPN3 | 092529 | 357568 | 3109 | 350181 | 25763 |
| CAPN3 | 092529 | 349748 | 3110 | 183936 | 25764 |
| CAPN3 | 092529 | 397163 | 3111 | 380349 | 25765 |
| CAPN3 | 092529 | 638141 | 3112 | N/A | |
| CAPN3 | 092529 | 397200 | 3113 | 380384 | 25766 |
| CAPN3 | 092529 | 569827 | 3114 | 454379 | 25767 |
| CAPN3 | 092529 | 567071 | 3115 | 456607 | 25768 |
| CAPN3 | 092529 | 337571 | 3116 | 336840 | 25769 |
| CAPN3 | 092529 | 569136 | 3117 | 455254 | 25770 |
| CAPN3 | 092529 | 561817 | 3118 | 456575 | 25771 |
| CAPN3 | 092529 | 565173 | 3119 | N/A | |
| CAPN3 | 092529 | 397204 | 3120 | 380387 | 25772 |
| CAPN3 | 092529 | 565559 | 3121 | 457878 | 25773 |
| CAPN3 | 092529 | 565274 | 3122 | 457759 | 25774 |
| CAPN3 | 092529 | 564503 | 3123 | 457898 | 25775 |
| CAPN3 | 092529 | 466222 | 3124 | N/A | |
| CAPN3 | 092529 | 562199 | 3125 | N/A | |
| CAPN3 | 092529 | 567817 | 3126 | 456514 | 25776 |
| CAPN3 | 092529 | 568153 | 3127 | 454937 | 25777 |
| CAPN3 | 092529 | 356316 | 3128 | 348667 | 25778 |
| CAPN3 | 092529 | 318023 | 3129 | 326281 | 25779 |
| CAPN5 | 149260 | 531028 | 3130 | 467244 | 25780 |
| CAPN5 | 149260 | 278559 | 3131 | 278559 | 25781 |
| CAPN5 | 149260 | 527066 | 3132 | 435894 | 25782 |
| CAPN5 | 149260 | 529629 | 3133 | 432332 | 25783 |
| CAPN5 | 149260 | 456580 | 3134 | 409996 | 25784 |
| CAPN5 | 149260 | 533889 | 3135 | N/A | |
| CAPN5 | 149260 | 527129 | 3136 | N/A | |
| CAPN9 | 135773 | 271971 | 3137 | 271971 | 25785 |
| CAPN9 | 135773 | 354537 | 3138 | 346538 | 25786 |
| CAPN9 | 135773 | 480004 | 3139 | N/A | |
| CAPN9 | 135773 | 366666 | 3140 | 355626 | 25787 |
| CAPZB | 077549 | 264203 | 3141 | 264203 | 25788 |
| CAPZB | 077549 | 375144 | 3142 | 364286 | 25789 |
| CAPZB | 077549 | 375142 | 3143 | 364284 | 25790 |
| CAPZB | 077549 | 433834 | 3144 | 401010 | 25791 |
| CAPZB | 077549 | 264202 | 3145 | 264202 | 25792 |
| CAPZB | 077549 | 459967 | 3146 | N/A | |
| CAPZB | 077549 | 457768 | 3147 | N/A | |
| CAPZB | 077549 | 489607 | 3148 | N/A | |
| CAPZB | 077549 | 482808 | 3149 | N/A | |
| CA12 | 074410 | 178638 | 3150 | 178638 | 25793 |
| CA12 | 074410 | 344366 | 3151 | 343088 | 25794 |
| CA12 | 074410 | 422263 | 3152 | 403028 | 25795 |
| CA12 | 074410 | 560666 | 3153 | N/A | |
| CA12 | 074410 | 558287 | 3154 | N/A | |
| CA12 | 074410 | 560293 | 3155 | N/A | |
| CA14 | 118298 | 369111 | 3156 | 358107 | 25796 |
| CA14 | 118298 | 582010 | 3157 | N/A | |
| CA14 | 118298 | 607652 | 3158 | N/A | |
| CA14 | 118298 | 483993 | 3159 | 475869 | 25797 |
| CA14 | 118298 | 607082 | 3160 | 475238 | 25798 |
| CA2 | 104267 | 285379 | 3161 | 285379 | 25799 |
| CA2 | 104267 | 520127 | 3162 | 428443 | 25800 |
| CA2 | 104267 | 520996 | 3163 | N/A | |
| CA2 | 104267 | 518231 | 3164 | N/A | |
| CA2 | 104267 | 522742 | 3165 | 428947 | 25801 |
| CA4 | 167434 | 300900 | 3166 | 300900 | 25802 |
| CA4 | 167434 | 585705 | 3167 | N/A | |
| CA4 | 167434 | 591725 | 3168 | 466964 | 25803 |
| CA4 | 167434 | 586876 | 3169 | 467465 | 25804 |
| CA4 | 167434 | 590203 | 3170 | 465837 | 25805 |
| CA4 | 167434 | 587265 | 3171 | 464757 | 25806 |

-continued

-continued

| Symbol | ENSG | ENST | SEQ ID | ENSP | SEQ ID | Symbol | ENSG | ENST | SEQ ID | ENSP | SEQ ID |
|---|---|---|---|---|---|---|---|---|---|---|---|
| CA8 | 178538 | 317995 | 3172 | 314407 | 25807 | CAV1 | 105974 | 341049 | 3248 | 339191 | 25855 |
| CA8 | 178538 | 524872 | 3173 | N/A | | CAV1 | 105974 | 393470 | 3249 | 377113 | 25856 |
| CA8 | 178538 | 528666 | 3174 | N/A | | CAV1 | 105974 | 451122 | 3250 | 409541 | 25857 |
| CA8 | 178538 | 529918 | 3175 | N/A | | CAV1 | 105974 | 489856 | 3251 | N/A | |
| CARMIL1 | 079691 | 461945 | 3176 | 489403 | 25808 | CAV1 | 105974 | 405348 | 3252 | 384348 | 25858 |
| CARMIL1 | 079691 | 329474 | 3177 | 331983 | 25809 | CAV1 | 105974 | 456473 | 3253 | 389033 | 25859 |
| CARMIL1 | 079691 | 497227 | 3178 | N/A | | CAV1 | 105974 | 393468 | 3254 | 377111 | 25860 |
| CARMIL1 | 079691 | 635618 | 3179 | 489114 | 25810 | CAV1 | 105974 | 393467 | 3255 | 377110 | 25861 |
| CARMIL1 | 079691 | 476458 | 3180 | N/A | | CAV1 | 105974 | 614113 | 3256 | 479447 | 25862 |
| CARNS1 | 172508 | 525907 | 3181 | N/A | | CAV2 | 105971 | 490906 | 3257 | N/A | |
| CARNS1 | 172508 | 529925 | 3182 | N/A | | CAV2 | 105971 | 460222 | 3258 | N/A | |
| CARNS1 | 172508 | 531040 | 3183 | 431670 | 25811 | CAV2 | 105971 | 477018 | 3259 | N/A | |
| CARNS1 | 172508 | 531958 | 3184 | N/A | | CAV2 | 105971 | 467035 | 3260 | N/A | |
| CARNS1 | 172508 | 307823 | 3185 | 308268 | 25812 | CAV2 | 105971 | 484871 | 3261 | N/A | |
| CARNS1 | 172508 | 531388 | 3186 | N/A | | CAV2 | 105971 | 485561 | 3262 | N/A | |
| CARNS1 | 172508 | 445895 | 3187 | 389009 | 25813 | CAV2 | 105971 | 472470 | 3263 | N/A | |
| CASP12 | 204403 | 613512 | 3188 | 482745 | 25814 | CAV2 | 105971 | 498493 | 3264 | N/A | |
| CASP12 | 204403 | 458137 | 3189 | 421408 | 25815 | CAV2 | 105971 | 478226 | 3265 | N/A | |
| CASP12 | 204403 | 375726 | 3190 | 424038 | 25816 | CAV2 | 105971 | 462876 | 3266 | N/A | |
| CASP12 | 204403 | 447913 | 3191 | 426427 | 25817 | CAV2 | 105971 | 465451 | 3267 | N/A | |
| CASP12 | 204403 | 446862 | 3192 | 425652 | 25818 | CAV2 | 105971 | 222693 | 3268 | 222693 | 25863 |
| CASP12 | 204403 | 441710 | 3193 | 423970 | 25819 | CAV2 | 105971 | 343213 | 3269 | 345679 | 25864 |
| CASP12 | 204403 | 433738 | 3194 | 427437 | 25820 | CAV2 | 105971 | 393480 | 3270 | 377120 | 25865 |
| CASP12 | 204403 | 448103 | 3195 | 423899 | 25821 | CAV2 | 105971 | 495841 | 3271 | N/A | |
| CASP12 | 204403 | 417998 | 3196 | 424963 | 25822 | CBFA2T3 | 129993 | 327483 | 3272 | 332122 | 25866 |
| CASP12 | 204403 | 494737 | 3197 | 421815 | 25823 | CBFA2T3 | 129993 | 268679 | 3273 | 268679 | 25867 |
| CASP12 | 204403 | 508062 | 3198 | 426566 | 25824 | CBFA2T3 | 129993 | 563856 | 3274 | N/A | |
| CASP12 | 204403 | 422698 | 3199 | 427128 | 25825 | CBFA2T3 | 129993 | 563920 | 3275 | N/A | |
| CASP3 | 164305 | 393585 | 3200 | 377210 | 25826 | CBFA2T3 | 129993 | 566868 | 3276 | 464125 | 25868 |
| CASP3 | 164305 | 308394 | 3201 | 311032 | 25827 | CBFA2T3 | 129993 | 569464 | 3277 | 454851 | 25869 |
| CASP3 | 164305 | 523916 | 3202 | 428929 | 25828 | CBFA2T3 | 129993 | 569443 | 3278 | 457410 | 25870 |
| CASP3 | 164305 | 517513 | 3203 | 428372 | 25829 | CBFA2T3 | 129993 | 562719 | 3279 | 456717 | 25871 |
| CASP3 | 164305 | 393588 | 3204 | 377213 | 25830 | CBFA2T3 | 129993 | 563640 | 3280 | 454872 | 25872 |
| CASP3 | 164305 | 447121 | 3205 | 407142 | 25831 | CBFA2T3 | 129993 | 564416 | 3281 | 454609 | 25873 |
| CASP4 | 196954 | 525116 | 3206 | N/A | | CBFA2T3 | 129993 | 570046 | 3282 | 456102 | 25874 |
| CASP4 | 196954 | 444739 | 3207 | 388566 | 25832 | CBFB | 067955 | 561924 | 3283 | 462273 | 25875 |
| CASP4 | 196954 | 393150 | 3208 | 376857 | 25833 | CBFB | 067955 | 290858 | 3284 | 290858 | 25876 |
| CASP4 | 196954 | 533252 | 3209 | 432879 | 25834 | CBFB | 067955 | 564034 | 3285 | 456637 | 25877 |
| CASP4 | 196954 | 529565 | 3210 | N/A | | CBFB | 067955 | 412916 | 3286 | 415151 | 25878 |
| CASP4 | 196954 | 530309 | 3211 | N/A | | CBFB | 067955 | 565389 | 3287 | 462932 | 25879 |
| CASP4 | 196954 | 533730 | 3212 | N/A | | CBFB | 067955 | 563939 | 3288 | 462148 | 25880 |
| CASP4 | 196954 | 534356 | 3213 | N/A | | CBFB | 067955 | 567947 | 3289 | N/A | |
| CASP4 | 196954 | 529183 | 3214 | N/A | | CBFB | 067955 | 566281 | 3290 | N/A | |
| CASP4 | 196954 | 524843 | 3215 | N/A | | CBFB | 067955 | 568858 | 3291 | N/A | |
| CASP4 | 196954 | 531333 | 3216 | N/A | | CBLB | 114423 | 394030 | 3292 | 377598 | 25881 |
| CASP4 | 196954 | 417440 | 3217 | 401673 | 25835 | CBLB | 114423 | 264122 | 3293 | 264122 | 25882 |
| CASP4 | 196954 | 531546 | 3218 | N/A | | CBLB | 114423 | 476370 | 3294 | N/A | |
| CASP9 | 132906 | 546424 | 3219 | 449584 | 25836 | CBLB | 114423 | 407712 | 3295 | 384170 | 25883 |
| CASP9 | 132906 | 333868 | 3220 | 330237 | 25837 | CBLB | 114423 | 403724 | 3296 | 384816 | 25884 |
| CASP9 | 132906 | 348549 | 3221 | 255256 | 25838 | CBLB | 114423 | 405772 | 3297 | 384938 | 25885 |
| CASP9 | 132906 | 400777 | 3222 | 383588 | 25839 | CBLB | 114423 | 438603 | 3298 | 409750 | 25886 |
| CASP9 | 132906 | 424908 | 3223 | 408691 | 25840 | CBLB | 114423 | 447441 | 3299 | 400949 | 25887 |
| CASP9 | 132906 | 375890 | 3224 | 365051 | 25841 | CBLB | 114423 | 443752 | 3300 | 393906 | 25888 |
| CASP9 | 132906 | 474305 | 3225 | 449216 | 25842 | CBLN1 | 102924 | 219197 | 3301 | 219197 | 25889 |
| CASP9 | 132906 | 447522 | 3226 | 396540 | 25843 | CBLN1 | 102924 | 564786 | 3302 | 455718 | 25890 |
| CASP9 | 132906 | 440484 | 3227 | 411304 | 25844 | CBLN1 | 102924 | 536749 | 3303 | 444651 | 25891 |
| CASP9 | 132906 | 546969 | 3228 | N/A | | CBLN2 | 141668 | 585159 | 3304 | 463771 | 25892 |
| CASP9 | 132906 | 469637 | 3229 | 480785 | 25845 | CBLN2 | 141668 | 269503 | 3305 | 269503 | 25893 |
| CASQ2 | 118729 | 261448 | 3230 | 261448 | 25846 | CBLN2 | 141668 | 581425 | 3306 | N/A | |
| CASQ2 | 118729 | 488931 | 3231 | N/A | | CBLN2 | 141668 | 584764 | 3307 | 464490 | 25894 |
| CATSPERG | 099338 | 410018 | 3232 | 387057 | 25847 | CBLN2 | 141668 | 583651 | 3308 | N/A | |
| CATSPERG | 099338 | 409235 | 3233 | 386962 | 25848 | CBLN2 | 141668 | 581073 | 3309 | 462632 | 25895 |
| CATSPERG | 099338 | 312265 | 3234 | 311314 | 25849 | CBLN2 | 141668 | 580889 | 3310 | N/A | |
| CATSPERG | 099338 | 471517 | 3235 | 468028 | 25850 | CBLN2 | 141668 | 583570 | 3311 | N/A | |
| CATSPERG | 099338 | 475343 | 3236 | 467947 | 25851 | CBLN2 | 141668 | 582667 | 3312 | N/A | |
| CATSPERG | 099338 | 409410 | 3237 | 386950 | 25852 | CBLN3 | 139899 | 267406 | 3313 | 267406 | 25896 |
| CATSPERG | 099338 | 477793 | 3238 | N/A | | CBLN3 | 139899 | 555436 | 3314 | 450935 | 25897 |
| CATSPERG | 099338 | 466060 | 3239 | N/A | | CBS | 160200 | 461686 | 3315 | N/A | |
| CATSPERG | 099338 | 412458 | 3240 | 395093 | 25853 | CBS | 160200 | 398158 | 3316 | 381225 | 25898 |
| CATSPERG | 099338 | 475646 | 3241 | N/A | | CBS | 160200 | 398165 | 3317 | 381231 | 25899 |
| CATSPERG | 099338 | 488473 | 3242 | N/A | | CBS | 160200 | 359624 | 3318 | 352643 | 25900 |
| CATSPERG | 099338 | 467739 | 3243 | N/A | | CBS | 160200 | 352178 | 3319 | 344460 | 25901 |
| CATSPERG | 099338 | 489693 | 3244 | 470225 | 25854 | CBS | 160200 | 451248 | 3320 | 402823 | 25902 |
| CATSPERG | 099338 | 470292 | 3245 | N/A | | CBS | 160200 | 462349 | 3321 | N/A | |
| CATSPERG | 099338 | 585424 | 3246 | N/A | | CBS | 160200 | 491776 | 3322 | N/A | |
| CATSPERG | 099338 | 492088 | 3247 | N/A | | CBS | 160200 | 458223 | 3323 | 408014 | 25903 |

-continued

-continued

| Symbol | ENSG | ENST | SEQ ID | ENSP | SEQ ID |
|---|---|---|---|---|---|
| CBS | 160200 | 430013 | 3324 | 405929 | 25904 |
| CBS | 160200 | 496485 | 3325 | N/A | |
| CBS | 160200 | 486098 | 3326 | N/A | |
| CBS | 160200 | 441030 | 3327 | 388235 | 25905 |
| CBS | 160200 | 470912 | 3328 | N/A | |
| CBS | 160200 | 465732 | 3329 | N/A | |
| CBS | 160200 | 488526 | 3330 | N/A | |
| CBS | 160200 | 478709 | 3331 | N/A | |
| CBWD6 | 215126 | 382436 | 3332 | 484049 | 25906 |
| CBWD6 | 215126 | 611553 | 3333 | N/A | |
| CBWD6 | 215126 | 494538 | 3334 | 484231 | 25907 |
| CBWD6 | 215126 | 617917 | 3335 | N/A | |
| CBWD6 | 215126 | 613125 | 3336 | N/A | |
| CBWD6 | 215126 | 610358 | 3337 | N/A | |
| CBWD6 | 215126 | 622791 | 3338 | N/A | |
| CBWD6 | 215126 | 486387 | 3339 | 480837 | 25908 |
| CBWD6 | 215126 | 617722 | 3340 | N/A | |
| CBWD6 | 215126 | 457288 | 3341 | N/A | |
| CBWD6 | 215126 | 467791 | 3342 | 480830 | 25909 |
| CBWD6 | 215126 | 490294 | 3343 | N/A | |
| CBWD6 | 215126 | 610377 | 3344 | N/A | |
| CBWD6 | 215126 | 620776 | 3345 | 478412 | 25910 |
| CBWD6 | 215126 | 613716 | 3346 | 482804 | 25911 |
| CBWD6 | 215126 | 617933 | 3347 | 481300 | 25912 |
| CBWD6 | 215126 | 377391 | 3348 | 366608 | 25913 |
| CBWD6 | 215126 | 456520 | 3349 | 401079 | 25914 |
| CCBE1 | 183287 | 439986 | 3350 | 404464 | 25915 |
| CCBE1 | 183287 | 589116 | 3351 | N/A | |
| CCBE1 | 183287 | 589419 | 3352 | 467710 | 25916 |
| CCBE1 | 183287 | 398179 | 3353 | 381241 | 25917 |
| CCDC13 | 244607 | 479631 | 3354 | N/A | |
| CCDC13 | 244607 | 496027 | 3355 | N/A | |
| CCDC13 | 244607 | 310232 | 3356 | 309836 | 25918 |
| CCDC13 | 244607 | 466031 | 3357 | N/A | |
| CCDC13 | 244607 | 472921 | 3358 | N/A | |
| CCDC13 | 244607 | 482100 | 3359 | N/A | |
| CCDC13 | 244607 | 479576 | 3360 | N/A | |
| CCDC13 | 244607 | 492806 | 3361 | N/A | |
| CCDC13 | 244607 | 435327 | 3362 | N/A | |
| CCDC146 | 135205 | 415750 | 3363 | 388649 | 25919 |
| CCDC146 | 135205 | 285871 | 3364 | 285871 | 25920 |
| CCDC146 | 135205 | 461882 | 3365 | N/A | |
| CCDC146 | 135205 | 415740 | 3366 | N/A | |
| CCDC146 | 135205 | 461259 | 3367 | N/A | |
| CCDC146 | 135205 | 474733 | 3368 | N/A | |
| CCDC146 | 135205 | 464021 | 3369 | N/A | |
| CCDC146 | 135205 | 478101 | 3370 | N/A | |
| CCDC146 | 135205 | 488998 | 3371 | N/A | |
| CCDC152 | 198865 | 361970 | 3372 | 354888 | 25921 |
| CCDC152 | 198865 | 388827 | 3373 | 373479 | 25922 |
| CCDC155 | 161609 | 447857 | 3374 | 404220 | 25923 |
| CCDC155 | 161609 | 600895 | 3375 | N/A | |
| CCDC155 | 161609 | 598730 | 3376 | 469367 | 25924 |
| CCDC155 | 161609 | 596771 | 3377 | N/A | |
| CCDC155 | 161609 | 596862 | 3378 | N/A | |
| CCDC155 | 161609 | 597993 | 3379 | 470765 | 25925 |
| CCDC155 | 161609 | 593725 | 3380 | N/A | |
| CCDC155 | 161609 | 594905 | 3381 | 468838 | 25926 |
| CCDC155 | 161609 | 595828 | 3382 | 471777 | 25927 |
| CCDC155 | 161609 | 594043 | 3383 | 469435 | 25928 |
| CCDC155 | 161609 | 600570 | 3384 | 470819 | 25929 |
| CCDC155 | 161609 | 596130 | 3385 | N/A | |
| CCDC155 | 161609 | 593631 | 3386 | N/A | |
| CCDC155 | 161609 | 593362 | 3387 | N/A | |
| CCDC155 | 161609 | 596419 | 3388 | N/A | |
| CCDC175 | 151838 | 553317 | 3389 | N/A | |
| CCDC175 | 151838 | 537690 | 3390 | 453940 | 25930 |
| CCDC175 | 151838 | 556936 | 3391 | N/A | |
| CCDC175 | 151838 | 556996 | 3392 | N/A | |
| CCDC175 | 151838 | 281581 | 3393 | 452964 | 25931 |
| CCDC180 | 197816 | 472746 | 3394 | N/A | |
| CCDC180 | 197816 | 494917 | 3395 | N/A | |
| CCDC180 | 197816 | 460482 | 3396 | N/A | |
| CCDC180 | 197816 | 529487 | 3397 | 434727 | 25932 |
| CCDC180 | 197816 | 528678 | 3398 | N/A | |
| CCDC180 | 197816 | 530011 | 3399 | N/A | |
| CCDC180 | 197816 | 471314 | 3400 | N/A | |
| CCDC180 | 197816 | 527182 | 3401 | N/A | |
| CCDC180 | 197816 | 483504 | 3402 | N/A | |
| CCDC180 | 197816 | 526038 | 3403 | N/A | |
| CCDC180 | 197816 | 534189 | 3404 | N/A | |
| CCDC180 | 197816 | 530551 | 3405 | N/A | |
| CCDC180 | 197816 | 487976 | 3406 | N/A | |
| CCDC61 | 104983 | 596161 | 3407 | N/A | |
| CCDC61 | 104983 | 595358 | 3408 | 471454 | 25933 |
| CCDC61 | 104983 | 594672 | 3409 | 469909 | 25934 |
| CCDC61 | 104983 | 596687 | 3410 | 469524 | 25935 |
| CCDC61 | 104983 | 599044 | 3411 | N/A | |
| CCDC61 | 104983 | 594087 | 3412 | 469466 | 25936 |
| CCDC61 | 104983 | 601763 | 3413 | N/A | |
| CCDC61 | 104983 | 536603 | 3414 | 444279 | 25937 |
| CCDC80 | 091986 | 206423 | 3415 | 206423 | 25938 |
| CCDC80 | 091986 | 439685 | 3416 | 411814 | 25939 |
| CCDC80 | 091986 | 479368 | 3417 | 418188 | 25940 |
| CCDC80 | 091986 | 461431 | 3418 | 420123 | 25941 |
| CCDC80 | 091986 | 475181 | 3419 | N/A | |
| CCDC80 | 091986 | 469554 | 3420 | N/A | |
| CCDC80 | 091986 | 473959 | 3421 | N/A | |
| CCDC80 | 091986 | 480275 | 3422 | N/A | |
| CCDC85A | 055813 | 407595 | 3423 | 384040 | 25942 |
| CCDC88A | 115355 | 336838 | 3424 | 338728 | 25943 |
| CCDC88A | 115355 | 263630 | 3425 | 263630 | 25944 |
| CCDC88A | 115355 | 444458 | 3426 | 413401 | 25945 |
| CCDC88A | 115355 | 412148 | 3427 | 390012 | 25946 |
| CCDC88A | 115355 | 426576 | 3428 | 405080 | 25947 |
| CCDC88A | 115355 | 456975 | 3429 | 415267 | 25948 |
| CCDC88A | 115355 | 474059 | 3430 | N/A | |
| CCDC88A | 115355 | 476903 | 3431 | N/A | |
| CCDC88A | 115355 | 468534 | 3432 | N/A | |
| CCDC88A | 115355 | 430086 | 3433 | 399237 | 25949 |
| CCDC88A | 115355 | 471947 | 3434 | N/A | |
| CCDC88A | 115355 | 413716 | 3435 | 404431 | 25950 |
| CCDC88A | 115355 | 621814 | 3436 | 480931 | 25951 |
| CCDC88A | 115355 | 436346 | 3437 | 410608 | 25952 |
| CCK | 187094 | 334681 | 3438 | 335657 | 25953 |
| CCK | 187094 | 396169 | 3439 | 379472 | 25954 |
| CCK | 187094 | 434608 | 3440 | 409124 | 25955 |
| CCK | 187094 | 484359 | 3441 | N/A | |
| CCKBR | 110148 | 334619 | 3442 | 335544 | 25956 |
| CCKBR | 110148 | 532715 | 3443 | 432079 | 25957 |
| CCKBR | 110148 | 525014 | 3444 | 437001 | 25958 |
| CCKBR | 110148 | 531712 | 3445 | 435675 | 25959 |
| CCKBR | 110148 | 525462 | 3446 | 435534 | 25960 |
| CCKBR | 110148 | 532396 | 3447 | N/A | |
| CCM2L | 101331 | 262659 | 3448 | 262659 | 25961 |
| CCM2L | 101331 | 452892 | 3449 | 392448 | 25962 |
| CCND1 | 110092 | 227507 | 3450 | 227507 | 25963 |
| CCND1 | 110092 | 539241 | 3451 | N/A | |
| CCND1 | 110092 | 536559 | 3452 | 438482 | 25964 |
| CCND1 | 110092 | 535993 | 3453 | N/A | |
| CCND1 | 110092 | 545484 | 3454 | N/A | |
| CCND1 | 110092 | 542367 | 3455 | N/A | |
| CCND2 | 118971 | 261254 | 3456 | 261254 | 25965 |
| CCND2 | 118971 | 536537 | 3457 | 442807 | 25966 |
| CCND2 | 118971 | 536795 | 3458 | N/A | |
| CCND2 | 118971 | 541542 | 3459 | N/A | |
| CCNH | 134480 | 505587 | 3460 | N/A | |
| CCNH | 134480 | 510921 | 3461 | N/A | |
| CCNH | 134480 | 508855 | 3462 | 426454 | 25967 |
| CCNH | 134480 | 256897 | 3463 | 256897 | 25968 |
| CCNH | 134480 | 504878 | 3464 | 426075 | 25969 |
| CCNH | 134480 | 511207 | 3465 | N/A | |
| CCNH | 134480 | 504115 | 3466 | N/A | |
| CCNH | 134480 | 513499 | 3467 | N/A | |
| CCNH | 134480 | 510020 | 3468 | N/A | |
| CCNH | 134480 | 505230 | 3469 | N/A | |
| CD101 | 134256 | 369470 | 3470 | 358482 | 25970 |
| CD101 | 134256 | 467588 | 3471 | N/A | |
| CD101 | 134256 | 460180 | 3472 | N/A | |
| CD101 | 134256 | 256652 | 3473 | 256652 | 25971 |
| CD27 | 139193 | 266557 | 3474 | 266557 | 25972 |
| CD27 | 139193 | 541233 | 3475 | N/A | |

-continued

| Symbol | ENSG | ENST | SEQ ID | ENSP | SEQ ID |
|---|---|---|---|---|---|
| CD33 | 105383 | 436584 | 3476 | 403331 | 25973 |
| CD33 | 105383 | 421133 | 3477 | 410126 | 25974 |
| CD33 | 105383 | 391796 | 3478 | 375673 | 25975 |
| CD33 | 105383 | 262262 | 3479 | 262262 | 25976 |
| CD33 | 105383 | 601785 | 3480 | N/A | |
| CD33 | 105383 | 598473 | 3481 | N/A | |
| CD33 | 105383 | 600557 | 3482 | N/A | |
| CD70 | 125726 | 423145 | 3483 | 395294 | 25977 |
| CD70 | 125726 | 245903 | 3484 | 245903 | 25978 |
| CD70 | 125726 | 597430 | 3485 | 470805 | 25979 |
| CD74 | 019582 | 377795 | 3486 | 367026 | 25980 |
| CD74 | 019582 | 353334 | 3487 | 230685 | 25981 |
| CD74 | 019582 | 518797 | 3488 | 430614 | 25982 |
| CD74 | 019582 | 524315 | 3489 | 429024 | 25983 |
| CD74 | 019582 | 009530 | 3490 | 009530 | 25984 |
| CD74 | 019582 | 523208 | 3491 | 430654 | 25985 |
| CD74 | 019582 | 517752 | 3492 | N/A | |
| CD74 | 019582 | 522246 | 3493 | 429641 | 25986 |
| CD74 | 019582 | 523813 | 3494 | 429478 | 25987 |
| CD74 | 019582 | 523836 | 3495 | N/A | |
| CD74 | 019582 | 517791 | 3496 | N/A | |
| CD74 | 019582 | 522153 | 3497 | N/A | |
| CD82 | 085117 | 526958 | 3498 | 435682 | 25988 |
| CD82 | 085117 | 227155 | 3499 | 227155 | 25989 |
| CD82 | 085117 | 342935 | 3500 | 339686 | 25990 |
| CD82 | 085117 | 532544 | 3501 | 431767 | 25991 |
| CD82 | 085117 | 529277 | 3502 | N/A | |
| CD82 | 085117 | 525210 | 3503 | 435661 | 25992 |
| CD82 | 085117 | 525898 | 3504 | N/A | |
| CD82 | 085117 | 527737 | 3505 | 433151 | 25993 |
| CD82 | 085117 | 524704 | 3506 | 436403 | 25994 |
| CD82 | 085117 | 525813 | 3507 | 433804 | 25995 |
| CD82 | 085117 | 529853 | 3508 | N/A | |
| CD82 | 085117 | 530601 | 3509 | 433788 | 25996 |
| CD82 | 085117 | 530931 | 3510 | N/A | |
| CD82 | 085117 | 524750 | 3511 | 433036 | 25997 |
| CD83 | 112149 | 379153 | 3512 | 368450 | 25998 |
| CD83 | 112149 | 612003 | 3513 | 480760 | 25999 |
| CD9 | 010278 | 382518 | 3514 | 371958 | 26000 |
| CD9 | 010278 | 543916 | 3515 | N/A | |
| CD9 | 010278 | 536586 | 3516 | 440985 | 26001 |
| CD9 | 010278 | 382519 | 3517 | 371959 | 26002 |
| CD9 | 010278 | 546073 | 3518 | N/A | |
| CD9 | 010278 | 538834 | 3519 | N/A | |
| CD9 | 010278 | 538418 | 3520 | N/A | |
| CD9 | 010278 | 009180 | 3521 | 009180 | 26003 |
| CD9 | 010278 | 382515 | 3522 | 371955 | 26004 |
| CD9 | 010278 | 481267 | 3523 | N/A | |
| CD9 | 010278 | 540891 | 3524 | N/A | |
| CD9 | 010278 | 610354 | 3525 | 478288 | 26005 |
| CDADC1 | 102543 | 251108 | 3526 | 251108 | 26006 |
| CDADC1 | 102543 | 496952 | 3527 | N/A | |
| CDADC1 | 102543 | 496061 | 3528 | 434135 | 26007 |
| CDADC1 | 102543 | 466868 | 3529 | N/A | |
| CDADC1 | 102543 | 484126 | 3530 | 434986 | 26008 |
| CDADC1 | 102543 | 429346 | 3531 | 389571 | 26009 |
| CDC14B | 081377 | 474602 | 3532 | 417897 | 26010 |
| CDC14B | 081377 | 412285 | 3533 | 413940 | 26011 |
| CDC14B | 081377 | 375241 | 3534 | 364389 | 26012 |
| CDC14B | 081377 | 375240 | 3535 | 364388 | 26013 |
| CDC14B | 081377 | 375242 | 3536 | 364390 | 26014 |
| CDC14B | 081377 | 463569 | 3537 | 420572 | 26015 |
| CDC14B | 081377 | 481149 | 3538 | N/A | |
| CDC14B | 081377 | 452280 | 3539 | 396951 | 26016 |
| CDC14B | 081377 | 415608 | 3540 | 400480 | 26017 |
| CDC14B | 081377 | 480920 | 3541 | N/A | |
| CDC14B | 081377 | 496750 | 3542 | N/A | |
| CDC14B | 081377 | 463547 | 3543 | N/A | |
| CDC14B | 081377 | 484948 | 3544 | N/A | |
| CDC42EP1 | 128283 | 249014 | 3545 | 249014 | 26018 |
| CDC42EP1 | 128283 | 430687 | 3546 | 411682 | 26019 |
| CDC42EP1 | 128283 | 415670 | 3547 | 405006 | 26020 |
| CDC42EP1 | 128283 | 434728 | 3548 | 403710 | 26021 |
| CDC42EP3 | 163171 | 295324 | 3549 | 295324 | 26022 |
| CDC42EP3 | 163171 | 457889 | 3550 | 403298 | 26023 |
| CDC42EP3 | 163171 | 453555 | 3551 | 398062 | 26024 |

| Symbol | ENSG | ENST | SEQ ID | ENSP | SEQ ID |
|---|---|---|---|---|---|
| CDC42EP3 | 163171 | 422687 | 3552 | 409147 | 26025 |
| CDC42EP3 | 163171 | 494083 | 3553 | N/A | |
| CDC42EP3 | 163171 | 611976 | 3554 | 480549 | 26026 |
| CDC42EP4 | 179604 | 335793 | 3555 | 338258 | 26027 |
| CDC42EP4 | 179604 | 439510 | 3556 | 404270 | 26028 |
| CDC42EP4 | 179604 | 581014 | 3557 | 464104 | 26029 |
| CDC42EP4 | 179604 | 580315 | 3558 | 462231 | 26030 |
| CDC42EP4 | 179604 | 579611 | 3559 | 463877 | 26031 |
| CDC42EP4 | 179604 | 581045 | 3560 | N/A | |
| CDC42EP4 | 179604 | 582303 | 3561 | N/A | |
| CDC42EP4 | 179604 | 578516 | 3562 | N/A | |
| CDC42EP4 | 179604 | 630622 | 3563 | 485861 | 26032 |
| CDH1 | 039068 | 261769 | 3564 | 261769 | 26033 |
| CDH1 | 039068 | 566612 | 3565 | 454782 | 26034 |
| CDH1 | 039068 | 422392 | 3566 | 414946 | 26035 |
| CDH1 | 039068 | 566510 | 3567 | 458139 | 26036 |
| CDH1 | 039068 | 562836 | 3568 | N/A | |
| CDH1 | 039068 | 564676 | 3569 | N/A | |
| CDH1 | 039068 | 564745 | 3570 | N/A | |
| CDH1 | 039068 | 561751 | 3571 | 463170 | 26037 |
| CDH1 | 039068 | 567320 | 3572 | N/A | |
| CDH1 | 039068 | 565810 | 3573 | N/A | |
| CDH1 | 039068 | 562118 | 3574 | N/A | |
| CDH1 | 039068 | 612417 | 3575 | 478360 | 26038 |
| CDH1 | 039068 | 621016 | 3576 | 480664 | 26039 |
| CDH1 | 039068 | 611625 | 3577 | 481063 | 26010 |
| CDH10 | 010731 | 264463 | 3578 | 264463 | 26041 |
| CDH10 | 010731 | 502921 | 3579 | N/A | |
| CDH10 | 010731 | 510477 | 3580 | 425653 | 26042 |
| CDH10 | 010731 | 503958 | 3581 | N/A | |
| CDH11 | 140937 | 394156 | 3582 | 377711 | 26043 |
| CDH11 | 140937 | 268603 | 3583 | 268603 | 26044 |
| CDH11 | 140937 | 566827 | 3584 | 457812 | 26045 |
| CDH11 | 140937 | 569095 | 3585 | N/A | |
| CDH11 | 140937 | 619158 | 3586 | 484650 | 26046 |
| CDH11 | 140937 | 569128 | 3587 | N/A | |
| CDH11 | 140937 | 567934 | 3588 | 455779 | 26047 |
| CDH11 | 140937 | 569624 | 3589 | N/A | |
| CDH11 | 140937 | 562998 | 3590 | 455420 | 26048 |
| CDH11 | 140937 | 564317 | 3591 | 456772 | 26049 |
| CDH11 | 140937 | 562712 | 3592 | 455120 | 26050 |
| CDH11 | 140937 | 562882 | 3593 | 455697 | 26051 |
| CDH11 | 140937 | 562325 | 3594 | 456110 | 26052 |
| CDH11 | 140937 | 568340 | 3595 | N/A | |
| CDH11 | 140937 | 565210 | 3596 | N/A | |
| CDH11 | 140937 | 563492 | 3597 | N/A | |
| CDH11 | 140937 | 563255 | 3598 | N/A | |
| CDH11 | 140937 | 564770 | 3599 | N/A | |
| CDH11 | 140937 | 569783 | 3600 | N/A | |
| CDH13 | 140945 | 539548 | 3601 | 442225 | 26053 |
| CDH13 | 140945 | 566333 | 3602 | N/A | |
| CDH13 | 140945 | 569455 | 3603 | N/A | |
| CDH13 | 140945 | 567445 | 3604 | 456297 | 26054 |
| CDH13 | 140945 | 569454 | 3605 | N/A | |
| CDH13 | 140945 | 562307 | 3606 | N/A | |
| CDH13 | 140945 | 567109 | 3607 | 479395 | 26055 |
| CDH13 | 140945 | 268613 | 3608 | 268613 | 26056 |
| CDH13 | 140945 | 569144 | 3609 | 457914 | 26057 |
| CDH13 | 140945 | 562601 | 3610 | 455781 | 26058 |
| CDH13 | 140945 | 568710 | 3611 | 457149 | 26059 |
| CDH13 | 140945 | 565636 | 3612 | 456491 | 26060 |
| CDH13 | 140945 | 431540 | 3613 | 408632 | 26061 |
| CDH13 | 140945 | 428848 | 3614 | 394557 | 26062 |
| CDH15 | 129910 | 521087 | 3615 | N/A | |
| CDH15 | 129910 | 524089 | 3616 | N/A | |
| CDH15 | 129910 | 289746 | 3617 | 289746 | 26063 |
| CDH19 | 071991 | 262150 | 3618 | 262150 | 26064 |
| CDH19 | 071991 | 579658 | 3619 | 463085 | 26065 |
| CDH19 | 071991 | 540086 | 3620 | 439593 | 26066 |
| CDH19 | 071991 | 454642 | 3621 | 401998 | 26067 |
| CDH19 | 071991 | 580157 | 3622 | 464477 | 26068 |
| CDH2 | 170558 | 269141 | 3623 | 269141 | 26069 |
| CDH2 | 170558 | 399380 | 3624 | 382312 | 26070 |
| CDH2 | 170558 | 418492 | 3625 | 411360 | 26071 |
| CDH2 | 170558 | 430882 | 3626 | 412120 | 26072 |
| CDH2 | 170558 | 413878 | 3627 | 414269 | 26073 |

-continued

| Symbol | ENSG | ENST | SEQ ID | ENSP | SEQ ID |
|---|---|---|---|---|---|
| CDH23 | 107736 | 224721 | 3628 | 224721 | 26074 |
| CDH23 | 107736 | 461841 | 3629 | 473454 | 26075 |
| CDH23 | 107736 | 299366 | 3630 | 299366 | 26076 |
| CDH23 | 107736 | 616684 | 3631 | 482036 | 26077 |
| CDH23 | 107736 | 466757 | 3632 | 473539 | 26078 |
| CDH23 | 107736 | 470494 | 3633 | 480146 | 26079 |
| CDH23 | 107736 | 442677 | 3634 | 388894 | 26080 |
| CDH23 | 107736 | 398792 | 3635 | N/A | |
| CDH23 | 107736 | 475158 | 3636 | N/A | |
| CDH23 | 107736 | 619887 | 3637 | 478374 | 26081 |
| CDH23 | 107736 | 398788 | 3638 | 381768 | 26082 |
| CDH23 | 107736 | 622827 | 3639 | 483211 | 26083 |
| CDH23 | 107736 | 398842 | 3640 | 381822 | 26084 |
| CDH23 | 107736 | 398809 | 3641 | 381789 | 26085 |
| CDH26 | 124215 | 348616 | 3642 | 339390 | 26086 |
| CDH26 | 124215 | 477058 | 3643 | N/A | |
| CDH26 | 124215 | 370991 | 3644 | 360030 | 26087 |
| CDH26 | 124215 | 497614 | 3645 | N/A | |
| CDH26 | 124215 | 244049 | 3646 | 244049 | 26088 |
| CDH26 | 124215 | 350849 | 3647 | 310845 | 26089 |
| CDH26 | 124215 | 456106 | 3648 | 407939 | 26090 |
| CDH4 | 280641 | 629889 | 3649 | 486680 | 26091 |
| CDH4 | 280641 | 628489 | 3650 | 487355 | 26092 |
| CDH4 | 280641 | 625686 | 3651 | 486568 | 26093 |
| CDH4 | 179242 | 614565 | 3652 | 484928 | 26094 |
| CDH4 | 179242 | 611855 | 3653 | 480844 | 26095 |
| CDH4 | 179242 | 543233 | 3654 | 443301 | 26096 |
| CDH7 | 081138 | 323011 | 3655 | 319166 | 26097 |
| CDH7 | 081138 | 536984 | 3656 | 443030 | 26098 |
| CDH7 | 081138 | 397968 | 3657 | 381058 | 26099 |
| CDH7 | 081138 | 581601 | 3658 | N/A | |
| CDH8 | 150394 | 577730 | 3659 | 462018 | 26100 |
| CDH8 | 150394 | 585315 | 3660 | 463266 | 26101 |
| CDH8 | 150394 | 577390 | 3661 | 462701 | 26102 |
| CDH8 | 150394 | 299345 | 3662 | 299345 | 26103 |
| CDH8 | 150394 | 583483 | 3663 | N/A | |
| CDH8 | 150394 | 580044 | 3664 | N/A | |
| CDH8 | 150394 | 577536 | 3665 | N/A | |
| CDH8 | 150394 | 584337 | 3666 | 463511 | 26104 |
| CDH8 | 150394 | 582242 | 3667 | N/A | |
| CDH8 | 150394 | 583382 | 3668 | 462976 | 26105 |
| CDH8 | 150394 | 584966 | 3669 | N/A | |
| CDH8 | 150394 | 577228 | 3670 | N/A | |
| CDH8 | 150394 | 584506 | 3671 | 462847 | 26106 |
| CDH8 | 150394 | 582980 | 3672 | N/A | |
| CDHR1 | 148600 | 623527 | 3673 | 485478 | 26107 |
| CDHR1 | 148600 | 332904 | 3674 | 331063 | 26108 |
| CDHR1 | 148600 | 372117 | 3675 | 361189 | 26109 |
| CDHR1 | 148600 | 624091 | 3676 | 485460 | 26110 |
| CDHR1 | 148600 | 622973 | 3677 | 485151 | 26111 |
| CDHR1 | 148600 | 459673 | 3678 | N/A | |
| CDHR1 | 148600 | 623399 | 3679 | 485245 | 26112 |
| CDK14 | 058091 | 449528 | 3680 | 393616 | 26113 |
| CDK14 | 058091 | 484035 | 3681 | N/A | |
| CDK14 | 058091 | 446224 | 3682 | 410770 | 26114 |
| CDK14 | 058091 | 430760 | 3683 | 394570 | 26115 |
| CDK14 | 058091 | 456689 | 3684 | 406848 | 26116 |
| CDK14 | 058091 | 380050 | 3685 | 369390 | 26117 |
| CDK14 | 058091 | 496279 | 3686 | N/A | |
| CDK14 | 058091 | 446790 | 3687 | 401603 | 26118 |
| CDK14 | 058091 | 265741 | 3688 | 265741 | 26119 |
| CDK14 | 058091 | 406263 | 3689 | 385034 | 26120 |
| CDK14 | 058091 | 431029 | 3690 | 387794 | 26121 |
| CDK14 | 058091 | 478540 | 3691 | N/A | |
| CDK14 | 058091 | 487145 | 3692 | N/A | |
| CDK14 | 058091 | 460493 | 3693 | N/A | |
| CDK14 | 058091 | 436577 | 3694 | 398936 | 26122 |
| CDK15 | 138395 | 451080 | 3695 | 389831 | 26123 |
| CDK15 | 138395 | 410091 | 3696 | 386901 | 26124 |
| CDK15 | 138395 | 493754 | 3697 | N/A | |
| CDK15 | 138395 | 260967 | 3698 | 260967 | 26125 |
| CDK15 | 138395 | 488419 | 3699 | N/A | |
| CDK15 | 138395 | 450471 | 3700 | 406472 | 26126 |
| CDK15 | 138395 | 434439 | 3701 | 412775 | 26127 |
| CDK15 | 138395 | 460149 | 3702 | N/A | |
| CDK15 | 138395 | 466337 | 3703 | N/A | |

-continued

| Symbol | ENSG | ENST | SEQ ID | ENSP | SEQ ID |
|---|---|---|---|---|---|
| CDK16 | 102225 | 517997 | 3704 | N/A | |
| CDK16 | 102225 | 517479 | 3705 | N/A | |
| CDK16 | 102225 | 457458 | 3706 | 405798 | 26128 |
| CDK16 | 102225 | 522883 | 3707 | 431085 | 26129 |
| CDK16 | 102225 | 520295 | 3708 | 430966 | 26130 |
| CDK16 | 102225 | 357227 | 3709 | 349762 | 26131 |
| CDK16 | 102225 | 519758 | 3710 | 429259 | 26132 |
| CDK16 | 102225 | 520893 | 3711 | 428351 | 26133 |
| CDK16 | 102225 | 517426 | 3712 | 429985 | 26134 |
| CDK16 | 102225 | 522234 | 3713 | N/A | |
| CDK16 | 102225 | 518391 | 3714 | 429044 | 26135 |
| CDK16 | 102225 | 428400 | 3715 | N/A | |
| CDK16 | 102225 | 518022 | 3716 | 429751 | 26136 |
| CDK16 | 102225 | 523034 | 3717 | 430486 | 26137 |
| CDK16 | 102225 | 523344 | 3718 | 428349 | 26138 |
| CDK16 | 102225 | 523699 | 3719 | N/A | |
| CDK16 | 102225 | 523543 | 3720 | N/A | |
| CDK16 | 102225 | 493213 | 3721 | N/A | |
| CDK16 | 102225 | 520141 | 3722 | 430988 | 26139 |
| CDK16 | 102225 | 462827 | 3723 | 430824 | 26140 |
| CDK16 | 102225 | 462483 | 3724 | N/A | |
| CDK16 | 102225 | 276052 | 3725 | 276052 | 26141 |
| CDK16 | 102225 | 622098 | 3726 | 482886 | 26142 |
| CDK18 | 117266 | 429964 | 3727 | 399082 | 26143 |
| CDK18 | 117266 | 512922 | 3728 | 422470 | 26144 |
| CDK18 | 117266 | 501648 | 3729 | 425036 | 26145 |
| CDK18 | 117266 | 506784 | 3730 | 423665 | 26146 |
| CDK18 | 117266 | 360066 | 3731 | 353176 | 26147 |
| CDK18 | 117266 | 507067 | 3732 | N/A | |
| CDK18 | 117266 | 462976 | 3733 | 422842 | 26148 |
| CDK18 | 117266 | 478560 | 3734 | 423408 | 26149 |
| CDK18 | 117266 | 443813 | 3735 | 397831 | 26150 |
| CDK18 | 117266 | 506215 | 3736 | 426368 | 26151 |
| CDK18 | 117266 | 419301 | 3737 | 391324 | 26152 |
| CDK18 | 117266 | 507240 | 3738 | N/A | |
| CDK18 | 117266 | 515494 | 3739 | 425177 | 26153 |
| CDK18 | 117266 | 476153 | 3740 | N/A | |
| CDK18 | 117266 | 505932 | 3741 | N/A | |
| CDK18 | 117266 | 489617 | 3742 | N/A | |
| CDK18 | 117266 | 506489 | 3743 | N/A | |
| CDK18 | 117266 | 468954 | 3744 | N/A | |
| CDK18 | 117266 | 504162 | 3745 | N/A | |
| CDK18 | 117266 | 512008 | 3746 | N/A | |
| CDK18 | 117266 | 484080 | 3747 | N/A | |
| CDK18 | 117266 | 515514 | 3748 | N/A | |
| CDK18 | 117266 | 459862 | 3749 | N/A | |
| CDK2 | 123374 | 266970 | 3750 | 266970 | 26154 |
| CDK2 | 123374 | 556464 | 3751 | N/A | |
| CDK2 | 123374 | 555408 | 3752 | 450983 | 26155 |
| CDK2 | 123374 | 553376 | 3753 | 452514 | 26156 |
| CDK2 | 123374 | 440311 | 3754 | 393605 | 26157 |
| CDK2 | 123374 | 555357 | 3755 | 452138 | 26158 |
| CDK2 | 123374 | 354056 | 3756 | 243067 | 26159 |
| CDK2 | 123374 | 554619 | 3757 | N/A | |
| CDK2 | 123374 | 556276 | 3758 | N/A | |
| CDK2 | 123374 | 556656 | 3759 | N/A | |
| CDK2 | 123374 | 556146 | 3760 | N/A | |
| CDK2 | 123374 | 554545 | 3761 | N/A | |
| CDK5R2 | 171450 | 302625 | 3762 | 304250 | 26160 |
| CDK5RAP2 | 136861 | 349780 | 3763 | 343818 | 26161 |
| CDK5RAP2 | 136861 | 360190 | 3764 | 353317 | 26162 |
| CDK5RAP2 | 136861 | 495406 | 3765 | N/A | |
| CDK5RAP2 | 136861 | 474262 | 3766 | N/A | |
| CDK5RAP2 | 136861 | 473282 | 3767 | 419265 | 26163 |
| CDK5RAP2 | 136861 | 480112 | 3768 | 418418 | 26164 |
| CDK5RAP2 | 136861 | 416449 | 3769 | 400395 | 26165 |
| CDK5RAP2 | 136861 | 433194 | 3770 | N/A | |
| CDK5RAP2 | 136861 | 480467 | 3771 | N/A | |
| CDK5RAP2 | 136861 | 484546 | 3772 | N/A | |
| CDK5RAP2 | 136861 | 425647 | 3773 | 409941 | 26166 |
| CDK5RAP2 | 136861 | 483412 | 3774 | N/A | |
| CDK5RAP2 | 136861 | 468989 | 3775 | N/A | |
| CDK5RAP2 | 136861 | 479584 | 3776 | N/A | |
| CDK5RAP2 | 136861 | 482047 | 3777 | 419640 | 26167 |
| CDK5RAP2 | 136861 | 472883 | 3778 | N/A | |
| CDK5RAP2 | 136861 | 481266 | 3779 | 417925 | 26168 |

| Symbol | ENSG | ENST | SEQ ID | ENSP | SEQ ID |
|---|---|---|---|---|---|
| CDK5RAP2 | 136861 | 491334 | 3780 | N/A | |
| CDK5RAP2 | 136861 | 360822 | 3781 | 354065 | 26169 |
| CDKL1 | 100490 | 395834 | 3782 | 379176 | 26170 |
| CDKL1 | 100490 | 525911 | 3783 | 431449 | 26171 |
| CDKL1 | 100490 | 534267 | 3784 | 435044 | 26172 |
| CDKL1 | 100490 | 216378 | 3785 | 216378 | 26173 |
| CDKL1 | 100490 | 356146 | 3786 | N/A | |
| CDKL1 | 100490 | 542671 | 3787 | N/A | |
| CDKL1 | 100490 | 529347 | 3788 | N/A | |
| CDKL1 | 100490 | 528197 | 3789 | N/A | |
| CDKL1 | 100490 | 531052 | 3790 | N/A | |
| CDKL1 | 100490 | 530553 | 3791 | N/A | |
| CDKL1 | 100490 | 534566 | 3792 | N/A | |
| CDKN1A | 124762 | 459970 | 3793 | N/A | |
| CDKN1A | 124762 | 244741 | 3794 | 244741 | 26174 |
| CDKN1A | 124762 | 373711 | 3795 | 362815 | 26175 |
| CDKN1A | 124762 | 478800 | 3796 | N/A | |
| CDKN1A | 124762 | 462537 | 3797 | N/A | |
| CDKN1A | 124762 | 405375 | 3798 | 384849 | 26176 |
| CDKN1A | 124762 | 615513 | 3799 | 482768 | 26177 |
| CDKN1A | 124762 | 448526 | 3800 | 409259 | 26178 |
| CDO1 | 129596 | 250535 | 3801 | 250535 | 26179 |
| CDO1 | 129596 | 502631 | 3802 | N/A | |
| CDO1 | 129596 | 504877 | 3803 | N/A | |
| CDO1 | 129596 | 504613 | 3804 | N/A | |
| CDYL | 153046 | 328908 | 3805 | 330512 | 26180 |
| CDYL | 153046 | 491864 | 3806 | N/A | |
| CDYL | 153046 | 440139 | 3807 | 394740 | 26181 |
| CDYL | 153046 | 483019 | 3808 | N/A | |
| CDYL | 153046 | 397588 | 3809 | 380718 | 26182 |
| CDYL | 153046 | 472453 | 3810 | N/A | |
| CDYL | 153046 | 449732 | 3811 | 394076 | 26183 |
| CDYL | 153046 | 343762 | 3812 | 340908 | 26184 |
| CDYL | 153046 | 469671 | 3813 | N/A | |
| CDYL2 | 166446 | 570137 | 3814 | 476295 | 26185 |
| CDYL2 | 166446 | 562812 | 3815 | 454546 | 26186 |
| CDYL2 | 166446 | 563890 | 3816 | 455111 | 26187 |
| CDYL2 | 166446 | 566173 | 3817 | 456934 | 26188 |
| CDYL2 | 166446 | 561616 | 3818 | N/A | |
| CDYL2 | 166446 | 567924 | 3819 | N/A | |
| CDYL2 | 166446 | 562753 | 3820 | N/A | |
| CEBPB | 172216 | 303004 | 3821 | 305422 | 26189 |
| CEMIP | 103888 | 220244 | 3822 | 220244 | 26190 |
| CEMIP | 103888 | 394685 | 3823 | 378177 | 26191 |
| CEMIP | 103888 | 356249 | 3824 | 348583 | 26192 |
| CEMIP | 103888 | 560027 | 3825 | 453066 | 26193 |
| CEMIP | 103888 | 495041 | 3826 | 431426 | 26194 |
| CEMIP | 103888 | 559966 | 3827 | N/A | |
| CEP126 | 110318 | 263468 | 3828 | 263468 | 26195 |
| CEP126 | 110318 | 532529 | 3829 | 433643 | 26196 |
| CEP126 | 110318 | 532077 | 3830 | 437014 | 26197 |
| CEP76 | 101624 | 590143 | 3831 | 464760 | 26198 |
| CEP76 | 101624 | 262127 | 3832 | 262127 | 26199 |
| CEP76 | 101624 | 423709 | 3833 | 403074 | 26200 |
| CEP76 | 101624 | 589490 | 3834 | N/A | |
| CEP76 | 101624 | 587666 | 3835 | 464911 | 26201 |
| CEP76 | 101624 | 593250 | 3836 | 466689 | 26202 |
| CEP76 | 101624 | 591034 | 3837 | 467361 | 26203 |
| CEP76 | 101624 | 585751 | 3838 | 467224 | 26204 |
| CEP76 | 101624 | 592660 | 3839 | N/A | |
| CEP76 | 101624 | 589875 | 3840 | N/A | |
| CEP76 | 101624 | 587929 | 3841 | 466833 | 26205 |
| CEP76 | 101624 | 586887 | 3842 | N/A | |
| CEPT1 | 134255 | 498239 | 3843 | N/A | |
| CEPT1 | 134255 | 480324 | 3844 | N/A | |
| CEPT1 | 134255 | 476865 | 3845 | N/A | |
| CEPT1 | 134255 | 357172 | 3846 | 349696 | 26206 |
| CEPT1 | 134255 | 460443 | 3847 | N/A | |
| CEPT1 | 134255 | 478042 | 3848 | N/A | |
| CEPT1 | 134255 | 473474 | 3849 | N/A | |
| CEPT1 | 134255 | 467362 | 3850 | N/A | |
| CEPT1 | 134255 | 483427 | 3851 | N/A | |
| CEPT1 | 134255 | 545121 | 3852 | 441980 | 26207 |
| CEPT1 | 134255 | 615636 | 3853 | 477632 | 26208 |
| CERCAM | 167123 | 420034 | 3854 | 402508 | 26209 |
| CERCAM | 167123 | 372842 | 3855 | 361933 | 26210 |

| Symbol | ENSG | ENST | SEQ ID | ENSP | SEQ ID |
|---|---|---|---|---|---|
| CERCAM | 167123 | 447915 | 3856 | 402928 | 26211 |
| CERCAM | 167123 | 420512 | 3857 | 416676 | 26212 |
| CERCAM | 167123 | 372838 | 3858 | 361929 | 26213 |
| CERCAM | 167123 | 493788 | 3859 | N/A | |
| CERCAM | 167123 | 411852 | 3860 | 403766 | 26214 |
| CERCAM | 167123 | 483737 | 3861 | N/A | |
| CERCAM | 167123 | 463535 | 3862 | N/A | |
| CERCAM | 167123 | 483893 | 3863 | N/A | |
| CERCAM | 167123 | 487001 | 3864 | N/A | |
| CERCAM | 167123 | 472858 | 3865 | N/A | |
| CERCAM | 167123 | 613052 | 3866 | 478713 | 26215 |
| CERCAM | 167123 | 612334 | 3867 | 481729 | 26216 |
| CERKL | 188452 | 410087 | 3868 | 386725 | 26217 |
| CERKL | 188452 | 409440 | 3869 | 387080 | 26218 |
| CERKL | 188452 | 374969 | 3870 | 364108 | 26219 |
| CERKL | 188452 | 452174 | 3871 | 409198 | 26220 |
| CERKL | 188452 | 339098 | 3872 | 341159 | 26221 |
| CERKL | 188452 | 374970 | 3873 | 364109 | 26222 |
| CERKL | 188452 | 374967 | 3874 | 364106 | 26223 |
| CERKL | 188452 | 494398 | 3875 | N/A | |
| CERKL | 188452 | 421817 | 3876 | 411466 | 26224 |
| CERKL | 188452 | 479558 | 3877 | N/A | |
| CERKL | 188452 | 466715 | 3878 | N/A | |
| CERKL | 188452 | 460319 | 3879 | N/A | |
| CERKL | 188452 | 476070 | 3880 | N/A | |
| CERKL | 188452 | 497337 | 3881 | N/A | |
| CERS4 | 090661 | 561008 | 3882 | 453796 | 26225 |
| CERS4 | 090661 | 558268 | 3883 | 453388 | 26226 |
| CERS4 | 090661 | 558331 | 3884 | 452753 | 26227 |
| CERS4 | 090661 | 561053 | 3885 | 452910 | 26228 |
| CERS4 | 090661 | 559490 | 3886 | N/A | |
| CERS4 | 090661 | 251363 | 3887 | 251363 | 26229 |
| CERS4 | 090661 | 559450 | 3888 | 453509 | 26230 |
| CERS4 | 090661 | 559336 | 3889 | 453815 | 26231 |
| CERS4 | 090661 | 600912 | 3890 | N/A | |
| CERS4 | 090661 | 595722 | 3891 | N/A | |
| CERS4 | 090661 | 558501 | 3892 | N/A | |
| CERS4 | 090661 | 560412 | 3893 | 452920 | 26232 |
| CERS4 | 090661 | 558877 | 3894 | 454122 | 26233 |
| CERS4 | 090661 | 557925 | 3895 | N/A | |
| CERS4 | 090661 | 558302 | 3896 | N/A | |
| CERS4 | 090661 | 599275 | 3897 | N/A | |
| CFAP161 | 156206 | 560091 | 3898 | 453414 | 26234 |
| CFAP161 | 156206 | 561216 | 3899 | 454135 | 26235 |
| CFAP161 | 156206 | 286732 | 3900 | 286732 | 26236 |
| CFAP20 | 070761 | 262498 | 3901 | 262498 | 26237 |
| CFAP20 | 070761 | 562622 | 3902 | N/A | |
| CFAP20 | 070761 | 564150 | 3903 | N/A | |
| CFAP20 | 070761 | 562443 | 3904 | N/A | |
| CFAP20 | 070761 | 565880 | 3905 | 455220 | 26238 |
| CFAP20 | 070761 | 567092 | 3906 | N/A | |
| CFAP20 | 070761 | 567660 | 3907 | N/A | |
| CFAP221 | 163075 | 295220 | 3908 | 295220 | 26239 |
| CFAP221 | 163075 | 463985 | 3909 | 470662 | 26240 |
| CFAP221 | 163075 | 413057 | 3910 | 391760 | 26241 |
| CFAP221 | 163075 | 442513 | 3911 | 409912 | 26242 |
| CFAP221 | 163075 | 594033 | 3912 | 470784 | 26243 |
| CFAP221 | 163075 | 413369 | 3913 | 393222 | 26244 |
| CFAP221 | 163075 | 598644 | 3914 | 472563 | 26245 |
| CFAP221 | 163075 | 594371 | 3915 | 470283 | 26246 |
| CFAP221 | 163075 | 488358 | 3916 | N/A | |
| CFAP221 | 163075 | 475569 | 3917 | N/A | |
| CFAP221 | 163075 | 594141 | 3918 | 472069 | 26247 |
| CFAP221 | 163075 | 597189 | 3919 | N/A | |
| CFAP221 | 163075 | 599827 | 3920 | 471092 | 26248 |
| CFAP221 | 163075 | 443972 | 3921 | 413299 | 26249 |
| CFAP221 | 163075 | 600951 | 3922 | 471998 | 26250 |
| CFAP221 | 163075 | 434869 | 3923 | 399793 | 26251 |
| CFAP221 | 163075 | 464578 | 3924 | N/A | |
| CFAP43 | 197748 | 457071 | 3925 | 394274 | 26252 |
| CFAP43 | 197748 | 434629 | 3926 | 391364 | 26253 |
| CFAP43 | 197748 | 479392 | 3927 | N/A | |
| CFAP43 | 197748 | 278064 | 3928 | 278064 | 26254 |
| CFAP43 | 197748 | 369720 | 3929 | 358734 | 26255 |
| CFAP43 | 197748 | 369719 | 3930 | 358733 | 26256 |
| CFAP43 | 197748 | 357060 | 3931 | 349568 | 26257 |

-continued

-continued

| Symbol | ENSG | ENST | SEQ ID | ENSP | SEQ ID |
|---|---|---|---|---|---|
| CFAP46 | 171811 | 368586 | 3932 | 357575 | 26258 |
| CFAP46 | 171811 | 639072 | 3933 | 491877 | 26259 |
| CFAP46 | 171811 | 448925 | 3934 | 417039 | 26260 |
| CFAP46 | 171811 | 476633 | 3935 | N/A | |
| CFAP46 | 171811 | 417862 | 3936 | N/A | |
| CFAP46 | 171811 | 486104 | 3937 | N/A | |
| CFAP46 | 171811 | 466834 | 3938 | N/A | |
| CFAP46 | 171811 | 368585 | 3939 | 357574 | 26261 |
| CFAP46 | 171811 | 475340 | 3940 | N/A | |
| CFAP53 | 172361 | 398545 | 3941 | 381553 | 26262 |
| CFAP70 | 156042 | 462684 | 3942 | N/A | |
| CFAP70 | 156042 | 495161 | 3943 | N/A | |
| CFAP70 | 156042 | 433268 | 3944 | 409527 | 26263 |
| CFAP70 | 156042 | 493787 | 3945 | N/A | |
| CFAP70 | 156042 | 340329 | 3946 | 343650 | 26264 |
| CFAP70 | 156042 | 355577 | 3947 | 347781 | 26265 |
| CFAP70 | 156042 | 310715 | 3948 | 310829 | 26266 |
| CFAP70 | 156042 | 394865 | 3949 | 378334 | 26267 |
| CFAP74 | 142609 | 493964 | 3950 | 417061 | 26268 |
| CFAP74 | 142609 | 464311 | 3951 | N/A | |
| CFAP74 | 142609 | 412120 | 3952 | N/A | |
| CFAP74 | 142609 | 493316 | 3953 | N/A | |
| CFAP74 | 142609 | 270720 | 3954 | N/A | |
| CFAP74 | 142609 | 468610 | 3955 | N/A | |
| CFAP74 | 142609 | 461752 | 3956 | N/A | |
| CFAP74 | 142609 | 378592 | 3957 | N/A | |
| CFAP74 | 142609 | 378590 | 3958 | 367853 | 26269 |
| CGN | 143375 | 505188 | 3959 | 425532 | 26270 |
| CGN | 143375 | 502442 | 3960 | 422299 | 26271 |
| CGN | 143375 | 427934 | 3961 | 410836 | 26272 |
| CGN | 143375 | 271636 | 3962 | 271636 | 26273 |
| CGN | 143375 | 416743 | 3963 | 390686 | 26274 |
| CGN | 143375 | 464886 | 3964 | N/A | |
| CGN | 143375 | 473377 | 3965 | N/A | |
| CGN | 143375 | 467998 | 3966 | N/A | |
| CGNL1 | 128849 | 281282 | 3967 | 281282 | 26275 |
| CGNL1 | 128849 | 557813 | 3968 | N/A | |
| CGNL1 | 128849 | 559194 | 3969 | N/A | |
| CHAC1 | 128965 | 444189 | 3970 | 395466 | 26276 |
| CHAC1 | 128965 | 446533 | 3971 | 398105 | 26277 |
| CHAC1 | 128965 | 617961 | 3972 | 481816 | 26278 |
| CHAC1 | 128965 | 487220 | 3973 | 452707 | 26279 |
| CHAC1 | 128965 | 617768 | 3974 | 484644 | 26280 |
| CHD7 | 171316 | 423902 | 3975 | 392028 | 26281 |
| CHD7 | 171316 | 526846 | 3976 | 436492 | 26282 |
| CHD7 | 171316 | 524602 | 3977 | 437061 | 26283 |
| CHD7 | 171316 | 525508 | 3978 | 436027 | 26284 |
| CHD7 | 171316 | 527825 | 3979 | 432627 | 26285 |
| CHD7 | 171316 | 527900 | 3980 | 433336 | 26286 |
| CHD7 | 171316 | 527921 | 3981 | N/A | |
| CHD7 | 171316 | 529472 | 3982 | N/A | |
| CHD7 | 171316 | 531695 | 3983 | N/A | |
| CHD7 | 171316 | 618450 | 3984 | N/A | |
| CHD7 | 171316 | 532149 | 3985 | N/A | |
| CHD7 | 171316 | 528280 | 3986 | N/A | |
| CHDH | 016391 | 315251 | 3987 | 319851 | 26287 |
| CHDH | 016391 | 481668 | 3988 | 418273 | 26288 |
| CHDH | 016391 | 467802 | 3989 | 419863 | 26289 |
| CHGB | 089199 | 378961 | 3990 | 368244 | 26290 |
| CHGB | 089199 | 455042 | 3991 | 416643 | 26291 |
| CHGB | 089199 | 488832 | 3992 | N/A | |
| CHID1 | 177830 | 532909 | 3993 | 433879 | 26292 |
| CHID1 | 177830 | 529539 | 3994 | 431169 | 26293 |
| CHID1 | 177830 | 323578 | 3995 | 325055 | 26294 |
| CHID1 | 177830 | 534207 | 3996 | 431356 | 26295 |
| CHID1 | 177830 | 429789 | 3997 | 416034 | 26296 |
| CHID1 | 177830 | 528581 | 3998 | 435503 | 26297 |
| CHID1 | 177830 | 436108 | 3999 | 388156 | 26298 |
| CHID1 | 177830 | 524538 | 4000 | N/A | |
| CHID1 | 177830 | 528521 | 4001 | 435336 | 26299 |
| CHID1 | 177830 | 526714 | 4002 | N/A | |
| CHID1 | 177830 | 528534 | 4003 | N/A | |
| CHID1 | 177830 | 524832 | 4004 | N/A | |
| CHID1 | 177830 | 531010 | 4005 | N/A | |
| CHID1 | 177830 | 531859 | 4006 | 434651 | 26300 |
| CHID1 | 177830 | 534254 | 4007 | 432697 | 26301 |

| Symbol | ENSG | ENST | SEQ ID | ENSP | SEQ ID |
|---|---|---|---|---|---|
| CHID1 | 177830 | 528426 | 4008 | 432431 | 26302 |
| CHID1 | 177830 | 533056 | 4009 | 436017 | 26303 |
| CHID1 | 177830 | 533059 | 4010 | 435731 | 26304 |
| CHID1 | 177830 | 530939 | 4011 | 436752 | 26305 |
| CHID1 | 177830 | 525225 | 4012 | 433570 | 26306 |
| CHID1 | 177830 | 525840 | 4013 | 435607 | 26307 |
| CHID1 | 177830 | 528154 | 4014 | 431766 | 26308 |
| CHID1 | 177830 | 454838 | 4015 | 398722 | 26309 |
| CHID1 | 177830 | 449825 | 4016 | 391255 | 26310 |
| CHL1 | 134121 | 256509 | 4017 | 256509 | 26311 |
| CHL1 | 134121 | 481167 | 4018 | N/A | |
| CHL1 | 134121 | 397491 | 4019 | 380628 | 26312 |
| CHL1 | 134121 | 427688 | 4020 | 403311 | 26313 |
| CHL1 | 134121 | 421198 | 4021 | 413628 | 26314 |
| CHL1 | 134121 | 489224 | 4022 | N/A | |
| CHL1 | 134121 | 453040 | 4023 | 413109 | 26315 |
| CHL1 | 134121 | 435603 | 4024 | 397445 | 26316 |
| CHL1 | 134121 | 486881 | 4025 | N/A | |
| CHL1 | 134121 | 449294 | 4026 | 390440 | 26317 |
| CHL1 | 134121 | 461289 | 4027 | N/A | |
| CHL1 | 134121 | 471332 | 4028 | N/A | |
| CHL1 | 134121 | 470880 | 4029 | N/A | |
| CHL1 | 134121 | 470005 | 4030 | N/A | |
| CHL1 | 134121 | 445697 | 4031 | 395239 | 26318 |
| CHL1 | 134121 | 620033 | 4032 | 483512 | 26319 |
| CHN2 | 106069 | 582692 | 4033 | N/A | |
| CHN2 | 106069 | 578605 | 4034 | N/A | |
| CHN2 | 106069 | 606897 | 4035 | N/A | |
| CHN2 | 106069 | 443025 | 4036 | N/A | |
| CHN2 | 106069 | 588769 | 4037 | N/A | |
| CHN2 | 106069 | 423511 | 4038 | 462650 | 26320 |
| CHN2 | 106069 | 439384 | 4039 | 409843 | 26321 |
| CHN2 | 106069 | 461824 | 4040 | N/A | |
| CHN2 | 106069 | 474070 | 4041 | 441183 | 26322 |
| CHN2 | 106069 | 470261 | 4042 | N/A | |
| CHN2 | 106069 | 222792 | 4043 | 222792 | 26323 |
| CHN2 | 106069 | 409350 | 4044 | 386968 | 26324 |
| CHN2 | 106069 | 409964 | 4045 | N/A | |
| CHN2 | 106069 | 409922 | 4046 | N/A | |
| CHN2 | 106069 | 412536 | 4047 | N/A | |
| CHN2 | 106069 | 478128 | 4048 | N/A | |
| CHN2 | 106069 | 482820 | 4049 | N/A | |
| CHN2 | 106069 | 483081 | 4050 | N/A | |
| CHN2 | 106069 | 491856 | 4051 | N/A | |
| CHN2 | 106069 | 446446 | 4052 | 396867 | 26325 |
| CHN2 | 106069 | 412711 | 4053 | 486515 | 26326 |
| CHN2 | 106069 | 467441 | 4054 | N/A | |
| CHN2 | 106069 | 493906 | 4055 | N/A | |
| CHN2 | 106069 | 410098 | 4056 | N/A | |
| CHN2 | 106069 | 433720 | 4057 | 398326 | 26327 |
| CHN2 | 106069 | 439711 | 4058 | 387425 | 26328 |
| CHN2 | 106069 | 421775 | 4059 | 394284 | 26329 |
| CHN2 | 106069 | 424025 | 4060 | 406337 | 26330 |
| CHN2 | 106069 | 409041 | 4061 | 386849 | 26331 |
| CHN2 | 106069 | 495789 | 4062 | 438587 | 26332 |
| CHODL | 154645 | 400128 | 4063 | 382993 | 26333 |
| CHODL | 154645 | 400131 | 4064 | 382996 | 26334 |
| CHODL | 154645 | 400135 | 4065 | 383001 | 26335 |
| CHODL | 154645 | 400127 | 4066 | 382992 | 26336 |
| CHODL | 154645 | 299295 | 4067 | 299295 | 26337 |
| CHODL | 154645 | 543733 | 4068 | 443566 | 26338 |
| CHODL | 154645 | 338326 | 4069 | 339975 | 26339 |
| CHORDC1 | 110172 | 320585 | 4070 | 319255 | 26340 |
| CHORDC1 | 110172 | 529987 | 4071 | 433719 | 26341 |
| CHORDC1 | 110172 | 533724 | 4072 | N/A | |
| CHORDC1 | 110172 | 457199 | 4073 | 401080 | 26342 |
| CHORDC1 | 110172 | 529726 | 4074 | 436632 | 26343 |
| CHORDC1 | 110172 | 525317 | 4075 | 436945 | 26344 |
| CHORDC1 | 110172 | 533772 | 4076 | 434040 | 26345 |
| CHORDC1 | 110172 | 530765 | 4077 | 431929 | 26346 |
| CHORDC1 | 110172 | 533062 | 4078 | 433440 | 26347 |
| CHORDC1 | 110172 | 529402 | 4079 | 432019 | 26348 |
| CHORDC1 | 110172 | 533739 | 4080 | N/A | |
| CHRD | 090539 | 356534 | 4081 | 348930 | 26349 |
| CHRD | 090539 | 204604 | 4082 | 204604 | 26350 |
| CHRD | 090539 | 448472 | 4083 | 408624 | 26351 |

-continued

-continued

| Symbol | ENSG | ENST | SEQ ID | ENSP | SEQ ID |
|---|---|---|---|---|---|
| CHRD | 090539 | 420973 | 4084 | 392794 | 26352 |
| CHRD | 090539 | 460627 | 4085 | N/A | |
| CHRD | 090539 | 450923 | 4086 | 408972 | 26353 |
| CHRD | 090539 | 348986 | 4087 | 334036 | 26354 |
| CHRD | 090539 | 470150 | 4088 | N/A | |
| CHRD | 090539 | 496527 | 4089 | N/A | |
| CHRD | 090539 | 459711 | 4090 | N/A | |
| CHRD | 090539 | 485883 | 4091 | N/A | |
| CHRD | 090539 | 482805 | 4092 | N/A | |
| CHRD | 090539 | 486066 | 4093 | N/A | |
| CHRD | 090539 | 461684 | 4094 | N/A | |
| CHRD | 090539 | 482014 | 4095 | N/A | |
| CHRD | 090539 | 461120 | 4096 | N/A | |
| CHRD | 090539 | 464833 | 4097 | N/A | |
| CHRM1 | 168539 | 306960 | 4098 | 306490 | 26355 |
| CHRM1 | 168539 | 543973 | 4099 | 441188 | 26356 |
| CHRM1 | 168539 | 536524 | 4100 | 444482 | 26357 |
| CHRM3 | 133019 | 468573 | 4101 | N/A | |
| CHRM3 | 133019 | 492335 | 4102 | N/A | |
| CHRM3 | 133019 | 481779 | 4103 | N/A | |
| CHRM3 | 133019 | 255380 | 4104 | 255380 | 26358 |
| CHRM3 | 133019 | 487470 | 4105 | N/A | |
| CHRM3 | 133019 | 448020 | 4106 | 404764 | 26359 |
| CHRM3 | 133019 | 615928 | 4107 | 482377 | 26360 |
| CHRNA3 | 080644 | 559002 | 4108 | N/A | |
| CHRNA3 | 080644 | 559658 | 4109 | 452896 | 26361 |
| CHRNA3 | 080644 | 348639 | 4110 | 267951 | 26362 |
| CHRNA3 | 080644 | 326828 | 4111 | 315602 | 26363 |
| CHRNA3 | 080644 | 558903 | 4112 | N/A | |
| CHRNA3 | 080644 | 561128 | 4113 | N/A | |
| CHRNA3 | 080644 | 559080 | 4114 | 453993 | 26364 |
| CHRNA3 | 080644 | 559941 | 4115 | N/A | |
| CHST1 | 175264 | 308064 | 4116 | 309270 | 26365 |
| CHST1 | 175264 | 533673 | 4117 | N/A | |
| CHST1 | 175264 | 531322 | 4118 | N/A | |
| CHST10 | 115526 | 264249 | 4119 | 264249 | 26366 |
| CHST10 | 115526 | 409701 | 4120 | 387309 | 26367 |
| CHST10 | 115526 | 484382 | 4121 | N/A | |
| CHST10 | 115526 | 409046 | 4122 | 387121 | 26368 |
| CHST10 | 115526 | 420858 | 4123 | 405922 | 26369 |
| CHST10 | 115526 | 448989 | 4124 | 387977 | 26370 |
| CHST10 | 115526 | 421474 | 4125 | 407525 | 26371 |
| CHST10 | 115526 | 418201 | 4126 | 416831 | 26372 |
| CHST10 | 115526 | 435960 | 4127 | 395643 | 26373 |
| CHST10 | 115526 | 485085 | 4128 | N/A | |
| CHST10 | 115526 | 487860 | 4129 | N/A | |
| CHST10 | 115526 | 466583 | 4130 | N/A | |
| CHST11 | 171310 | 550711 | 4131 | N/A | |
| CHST11 | 171310 | 547956 | 4132 | 449093 | 26374 |
| CHST11 | 171310 | 549260 | 4133 | 450004 | 26375 |
| CHST11 | 171310 | 303694 | 4134 | 305725 | 26376 |
| CHST11 | 171310 | 546689 | 4135 | 448678 | 26377 |
| CHST11 | 171310 | 549016 | 4136 | 449095 | 26378 |
| CHST12 | 136213 | 258711 | 4137 | 258711 | 26379 |
| CHST12 | 136213 | 432336 | 4138 | 411207 | 26380 |
| CHST12 | 136213 | 313156 | 4139 | N/A | |
| CHST12 | 136213 | 618655 | 4140 | 481912 | 26381 |
| CHST15 | 182022 | 346248 | 4141 | 333947 | 26382 |
| CHST15 | 182022 | 628426 | 4142 | 485905 | 26383 |
| CHST15 | 182022 | 476765 | 4143 | N/A | |
| CHST15 | 182022 | 462406 | 4144 | 487014 | 26384 |
| CHST15 | 182022 | 435907 | 4145 | 402394 | 26385 |
| CHST5 | 135702 | 336257 | 4146 | 338783 | 26386 |
| CHST5 | 135702 | 565039 | 4147 | 454375 | 26387 |
| CHST8 | 124302 | 591231 | 4148 | 467012 | 26388 |
| CHST8 | 124302 | 438847 | 4149 | 393879 | 26389 |
| CHST8 | 124302 | 604556 | 4150 | N/A | |
| CHST8 | 124302 | 262622 | 4151 | 262622 | 26390 |
| CHST8 | 124302 | 434302 | 4152 | 392604 | 26391 |
| CHST9 | 154080 | 618847 | 4153 | 480991 | 26392 |
| CHST9 | 154080 | 581714 | 4154 | 462852 | 26393 |
| CHST9 | 154080 | 580774 | 4155 | 464655 | 26394 |
| CHSY1 | 131873 | 254190 | 4156 | 254190 | 26395 |
| CHSY1 | 131873 | 543813 | 4157 | N/A | |
| CHSY1 | 131873 | 560766 | 4158 | N/A | |
| CHSY1 | 131873 | 561414 | 4159 | N/A | |

| Symbol | ENSG | ENST | SEQ ID | ENSP | SEQ ID |
|---|---|---|---|---|---|
| CHSY1 | 131873 | 561143 | 4160 | N/A | |
| CHSY1 | 131873 | 559384 | 4161 | N/A | |
| CHSY3 | 198108 | 305031 | 4162 | 302629 | 26396 |
| CHSY3 | 198108 | 507545 | 4163 | N/A | |
| CHTF18 | 127586 | 464728 | 4164 | N/A | |
| CHTF18 | 127586 | 262315 | 4165 | 262315 | 26397 |
| CHTF18 | 127586 | 570058 | 4166 | N/A | |
| CHTF18 | 127586 | 563545 | 4167 | 456998 | 26398 |
| CHTF18 | 127586 | 479976 | 4168 | N/A | |
| CHTF18 | 127586 | 455171 | 4169 | 406252 | 26399 |
| CHTF18 | 127586 | 440239 | 4170 | 399111 | 26400 |
| CHTF18 | 127586 | 471202 | 4171 | N/A | |
| CHTF18 | 127586 | 491530 | 4172 | N/A | |
| CHTF18 | 127586 | 426047 | 4173 | 412015 | 26401 |
| CHTF18 | 127586 | 484349 | 4174 | N/A | |
| CHTF18 | 127586 | 569270 | 4175 | 454679 | 26402 |
| CHTF18 | 127586 | 567620 | 4176 | N/A | |
| CHTF18 | 127586 | 565787 | 4177 | N/A | |
| CHTF18 | 127586 | 461268 | 4178 | N/A | |
| CHTF18 | 127586 | 493715 | 4179 | N/A | |
| CHTF18 | 127586 | 498439 | 4180 | N/A | |
| CHTF18 | 127586 | 564940 | 4181 | N/A | |
| CHTF18 | 127586 | 631357 | 4182 | 486314 | 26403 |
| CHTF18 | 127586 | 317063 | 4183 | 313029 | 26404 |
| CIPC | 198894 | 361786 | 4184 | 355319 | 26405 |
| CIPC | 198894 | 555437 | 4185 | 451997 | 26406 |
| CIPC | 198894 | 556863 | 4186 | N/A | |
| CIPC | 198894 | 555611 | 4187 | 450972 | 26407 |
| CIPC | 198894 | 554658 | 4188 | 451522 | 26408 |
| CIPC | 198894 | 557115 | 4189 | 452589 | 26409 |
| CIPC | 198894 | 554447 | 4190 | 452380 | 26410 |
| CIPC | 198894 | 555200 | 4191 | 451493 | 26411 |
| CIT | 122966 | 392521 | 4192 | 376306 | 26412 |
| CIT | 122966 | 261833 | 4193 | 261833 | 26413 |
| CIT | 122966 | 545913 | 4194 | N/A | |
| CIT | 122966 | 392520 | 4195 | 376305 | 26414 |
| CIT | 122966 | 537607 | 4196 | N/A | |
| CIT | 122966 | 544872 | 4197 | N/A | |
| CIT | 122966 | 469414 | 4198 | N/A | |
| CIT | 122966 | 538073 | 4199 | N/A | |
| CIT | 122966 | 543324 | 4200 | N/A | |
| CIT | 122966 | 544800 | 4201 | N/A | |
| CIT | 122966 | 543239 | 4202 | N/A | |
| CIT | 122966 | 536008 | 4203 | N/A | |
| CIT | 122966 | 544588 | 4204 | N/A | |
| CIT | 122966 | 536325 | 4205 | 443199 | 26415 |
| CIT | 122966 | 546026 | 4206 | 446105 | 26416 |
| CIT | 122966 | 541841 | 4207 | N/A | |
| CIT | 122966 | 488203 | 4208 | N/A | |
| CIT | 122966 | 539413 | 4209 | N/A | |
| CIT | 122966 | 612548 | 4210 | 482318 | 26417 |
| CKMT1B | 237289 | 453782 | 4211 | 413999 | 26418 |
| CKMT1B | 237289 | 437924 | 4212 | 391990 | 26419 |
| CKMT1B | 237289 | 475589 | 4213 | N/A | |
| CKMT1B | 237289 | 481666 | 4214 | N/A | |
| CKMT1B | 237289 | 449946 | 4215 | 416467 | 26420 |
| CKMT1B | 237289 | 417289 | 4216 | 396707 | 26421 |
| CKMT1B | 237289 | 441322 | 4217 | 413255 | 26422 |
| CKMT1B | 237289 | 495545 | 4218 | N/A | |
| CKMT1B | 237289 | 498538 | 4219 | N/A | |
| CKMT1B | 237289 | 453733 | 4220 | 411531 | 26423 |
| CKMT1B | 237289 | 437534 | 4221 | 416717 | 26424 |
| CKMT1B | 237289 | 428981 | 4222 | 399467 | 26425 |
| CKMT1B | 237289 | 411560 | 4223 | N/A | |
| CKMT1B | 237289 | 300283 | 4224 | 300283 | 26426 |
| CKMT1B | 237289 | 627381 | 4225 | 486477 | 26427 |
| CLASRP | 104859 | 221455 | 4226 | 221455 | 26428 |
| CLASRP | 104859 | 391953 | 4227 | 375815 | 26429 |
| CLASRP | 104859 | 592056 | 4228 | N/A | |
| CLASRP | 104859 | 591410 | 4229 | 465750 | 26430 |
| CLASRP | 104859 | 391952 | 4230 | 375814 | 26431 |
| CLASRP | 104859 | 588247 | 4231 | N/A | |
| CLASRP | 104859 | 588936 | 4232 | 465562 | 26432 |
| CLASRP | 104859 | 544944 | 4233 | 438702 | 26433 |
| CLASRP | 104859 | 587112 | 4234 | 466371 | 26434 |
| CLASRP | 104859 | 588016 | 4235 | N/A | |

-continued

| Symbol | ENSG | ENST | SEQ ID | ENSP | SEQ ID |
|---|---|---|---|---|---|
| CLASRP | 104859 | 585432 | 4236 | N/A | |
| CLASRP | 104859 | 585615 | 4237 | N/A | |
| CLASRP | 104859 | 591904 | 4238 | 467177 | 26435 |
| CLASRP | 104859 | 587472 | 4239 | N/A | |
| CLASRP | 104859 | 592876 | 4240 | N/A | |
| CLASRP | 104859 | 588070 | 4241 | N/A | |
| CLCN1 | 188037 | 343257 | 4242 | 339867 | 26436 |
| CLCN1 | 188037 | 432192 | 4243 | 395949 | 26437 |
| CLCN1 | 188037 | 455478 | 4244 | 400027 | 26438 |
| CLCN1 | 188037 | 495612 | 4245 | N/A | |
| CLCN3 | 109572 | 511092 | 4246 | 425160 | 26439 |
| CLCN3 | 109572 | 513761 | 4247 | 424603 | 26440 |
| CLCN3 | 109572 | 347613 | 4248 | 261514 | 26441 |
| CLCN3 | 109572 | 360642 | 4249 | 353857 | 26442 |
| CLCN3 | 109572 | 512813 | 4250 | 425823 | 26443 |
| CLCN3 | 109572 | 506924 | 4251 | N/A | |
| CLCN3 | 109572 | 507875 | 4252 | 425323 | 26444 |
| CLCN3 | 109572 | 502998 | 4253 | N/A | |
| CLCN3 | 109572 | 515420 | 4254 | 422678 | 26445 |
| CLCN3 | 109572 | 613795 | 4255 | 478336 | 26446 |
| CLCN3 | 109572 | 504131 | 4256 | 424540 | 26447 |
| CLCN5 | 171365 | 376088 | 4257 | 365256 | 26448 |
| CLCN5 | 171365 | 376091 | 4258 | 365259 | 26449 |
| CLCN5 | 171365 | 482218 | 4259 | 476732 | 26450 |
| CLCN5 | 171365 | 376108 | 4260 | 365276 | 26451 |
| CLCN5 | 171365 | 307367 | 4261 | 304257 | 26452 |
| CLDN1 | 163347 | 295522 | 4262 | 295522 | 26453 |
| CLDN1 | 163347 | 490800 | 4263 | N/A | |
| CLDN11 | 013297 | 064724 | 4264 | 064724 | 26454 |
| CLDN11 | 013297 | 486975 | 4265 | 417434 | 26455 |
| CLDN11 | 013297 | 486429 | 4266 | N/A | |
| CLDN11 | 013297 | 489485 | 4267 | N/A | |
| CLDN11 | 013297 | 468358 | 4268 | N/A | |
| CLDN11 | 013297 | 471373 | 4269 | N/A | |
| CLDN11 | 013297 | 477531 | 4270 | N/A | |
| CLDN11 | 013297 | 488989 | 4271 | N/A | |
| CLDN11 | 013297 | 480067 | 4272 | N/A | |
| CLEC2L | 236279 | 422142 | 4273 | 390661 | 26456 |
| CLEC2L | 236279 | 521281 | 4274 | 428508 | 26457 |
| CLEC2L | 236279 | 520413 | 4275 | N/A | |
| CLEC7A | 172243 | 353231 | 4276 | 266456 | 26458 |
| CLEC7A | 172243 | 534609 | 4277 | N/A | |
| CLEC7A | 172243 | 529761 | 4278 | 432876 | 26459 |
| CLEC7A | 172243 | 298523 | 4279 | 298523 | 26460 |
| CLEC7A | 172243 | 396484 | 4280 | 379743 | 26461 |
| CLEC7A | 172243 | 304084 | 4281 | 302569 | 26462 |
| CLEC7A | 172243 | 465100 | 4282 | 436923 | 26463 |
| CLEC7A | 172243 | 349926 | 4283 | 344723 | 26464 |
| CLEC7A | 172243 | 533022 | 4284 | 431461 | 26465 |
| CLEC7A | 172243 | 531192 | 4285 | 434392 | 26466 |
| CLEC7A | 172243 | 528799 | 4286 | N/A | |
| CLEC7A | 172243 | 310002 | 4287 | 312089 | 26467 |
| CLEC7A | 172243 | 525605 | 4288 | 434954 | 26468 |
| CLIC5 | 112782 | 185206 | 4289 | 185206 | 26469 |
| CLIC5 | 112782 | 487396 | 4290 | N/A | |
| CLIC5 | 112782 | 339561 | 4291 | 344165 | 26470 |
| CLIC5 | 112782 | 484572 | 4292 | N/A | |
| CLIC5 | 112782 | 486570 | 4293 | N/A | |
| CLIC5 | 112782 | 476852 | 4294 | N/A | |
| CLIC5 | 112782 | 464137 | 4295 | N/A | |
| CLIC5 | 112782 | 544153 | 4296 | 439195 | 26471 |
| CLIC6 | 159212 | 360731 | 4297 | 353959 | 26472 |
| CLIC6 | 159212 | 349499 | 4298 | 290332 | 26473 |
| CLK1 | 013441 | 321356 | 4299 | 326830 | 26474 |
| CLK1 | 013441 | 461981 | 4300 | N/A | |
| CLK1 | 013441 | 464454 | 4301 | N/A | |
| CLK1 | 013441 | 432425 | 4302 | 400487 | 26475 |
| CLK1 | 013441 | 473565 | 4303 | N/A | |
| CLK1 | 013441 | 472679 | 4304 | N/A | |
| CLK1 | 013441 | 409769 | 4305 | 386358 | 26476 |
| CLK1 | 013441 | 409403 | 4306 | 386875 | 26477 |
| CLK1 | 013441 | 434813 | 4307 | 394734 | 26478 |
| CLK1 | 013441 | 461326 | 4308 | N/A | |
| CLK1 | 013441 | 496205 | 4309 | N/A | |
| CLK1 | 013441 | 492793 | 4310 | N/A | |
| CLK1 | 013441 | 481641 | 4311 | N/A | |

-continued

| Symbol | ENSG | ENST | SEQ ID | ENSP | SEQ ID |
|---|---|---|---|---|---|
| CLK1 | 013441 | 482590 | 4312 | N/A | |
| CLK1 | 013441 | 621181 | 4313 | 479484 | 26479 |
| CLMN | 165959 | 298912 | 4314 | 298912 | 26480 |
| CLMN | 165959 | 557215 | 4315 | N/A | |
| CLMN | 165959 | 557696 | 4316 | N/A | |
| CLMN | 165959 | 556454 | 4317 | N/A | |
| CLMN | 165959 | 556441 | 4318 | 452305 | 26481 |
| CLMN | 165959 | 556416 | 4319 | N/A | |
| CLMN | 165959 | 555336 | 4320 | 451705 | 26482 |
| CLMN | 165959 | 555615 | 4321 | 452525 | 26483 |
| CLMN | 165959 | 553733 | 4322 | 451189 | 26484 |
| CLMP | 166250 | 448775 | 4323 | 405577 | 26485 |
| CLMP | 166250 | 530371 | 4324 | N/A | |
| CLMP | 166250 | 527977 | 4325 | N/A | |
| CLMP | 166250 | 529128 | 4326 | N/A | |
| CLSTN2 | 158258 | 458420 | 4327 | 402460 | 26486 |
| CLSTN2 | 158258 | 511524 | 4328 | N/A | |
| CLSTN3 | 139182 | 541953 | 4329 | 443959 | 26487 |
| CLSTN3 | 139182 | 266546 | 4330 | 266546 | 26488 |
| CLSTN3 | 139182 | 541667 | 4331 | N/A | |
| CLSTN3 | 139182 | 545663 | 4332 | 442612 | 26489 |
| CLSTN3 | 139182 | 535452 | 4333 | 443468 | 26490 |
| CLSTN3 | 139182 | 534830 | 4334 | 443490 | 26491 |
| CLSTN3 | 139182 | 539982 | 4335 | 442801 | 26492 |
| CLSTN3 | 139182 | 537408 | 4336 | 440679 | 26493 |
| CLSTN3 | 139182 | 538933 | 4337 | N/A | |
| CLSTN3 | 139182 | 540931 | 4338 | N/A | |
| CLSTN3 | 139182 | 535668 | 4339 | N/A | |
| CLSTN3 | 139182 | 544584 | 4340 | N/A | |
| CLSTN3 | 139182 | 541770 | 4341 | N/A | |
| CLSTN3 | 139182 | 542663 | 4342 | N/A | |
| CLSTN3 | 139182 | 331148 | 4343 | N/A | |
| CLSTN3 | 139182 | 535313 | 4344 | N/A | |
| CLVS2 | 146352 | 275162 | 4345 | 275162 | 26494 |
| CLVS2 | 146352 | 368438 | 4346 | 357423 | 26495 |
| NAT8 | 144035 | 272425 | 4347 | 272425 | 26496 |
| CMTM5 | 166091 | 359320 | 4348 | 352270 | 26497 |
| CMTM5 | 166091 | 339180 | 4349 | 344819 | 26498 |
| CMTM5 | 166091 | 342473 | 4350 | 344160 | 26499 |
| CMTM5 | 166091 | 397227 | 4351 | 380404 | 26500 |
| CMTM5 | 166091 | 553750 | 4352 | N/A | |
| CMTM5 | 166091 | 555731 | 4353 | 451514 | 26501 |
| CMTM5 | 166091 | 382809 | 4354 | 372259 | 26502 |
| CMTM5 | 166091 | 555487 | 4355 | N/A | |
| CMTM8 | 170293 | 458535 | 4356 | 412934 | 26503 |
| CMTM8 | 170293 | 307526 | 4357 | 307741 | 26504 |
| CNDP1 | 150656 | 358821 | 4358 | 351682 | 26505 |
| CNDP1 | 150656 | 585164 | 4359 | N/A | |
| CNDP1 | 150656 | 582365 | 4360 | 462096 | 26506 |
| CNDP1 | 150656 | 584316 | 4361 | 463807 | 26507 |
| CNDP1 | 150656 | 584004 | 4362 | N/A | |
| CNDP1 | 150656 | 578498 | 4363 | N/A | |
| CNDP1 | 150656 | 582461 | 4364 | N/A | |
| CNIH3 | 143786 | 471578 | 4365 | N/A | |
| CNIH3 | 143786 | 483512 | 4366 | N/A | |
| CNIH3 | 143786 | 498126 | 4367 | N/A | |
| CNIH3 | 143786 | 496372 | 4368 | N/A | |
| CNIH3 | 143786 | 470602 | 4369 | N/A | |
| CNIH3 | 143786 | 498382 | 4370 | N/A | |
| CNIH3 | 143786 | 478120 | 4371 | N/A | |
| CNIH3 | 143786 | 481095 | 4372 | N/A | |
| CNIH3 | 143786 | 470788 | 4373 | N/A | |
| CNIH3 | 143786 | 489556 | 4374 | N/A | |
| CNIH3 | 143786 | 496277 | 4375 | N/A | |
| CNIH3 | 143786 | 492470 | 4376 | N/A | |
| CNIH3 | 143786 | 479227 | 4377 | N/A | |
| CNIH3 | 143786 | 272133 | 4378 | 272133 | 26508 |
| CNKSR3 | 153721 | 607772 | 4379 | 475915 | 26509 |
| CNKSR3 | 153721 | 433165 | 4380 | N/A | |
| CNKSR3 | 153721 | 479339 | 4381 | 418975 | 26510 |
| CNKSR3 | 153721 | 424998 | 4382 | 393225 | 26511 |
| CNKSR3 | 153721 | 454664 | 4383 | N/A | |
| CNP | 173786 | 393892 | 4384 | 377470 | 26512 |
| CNP | 173786 | 472031 | 4385 | 467641 | 26513 |
| CNP | 173786 | 591945 | 4386 | N/A | |
| CNP | 173786 | 592446 | 4387 | N/A | |

-continued

-continued

| Symbol | ENSG | ENST | SEQ ID | ENSP | SEQ ID |
|---|---|---|---|---|---|
| CNP | 173786 | 587679 | 4388 | 468198 | 26514 |
| CNP | 173786 | 393888 | 4389 | 377466 | 26515 |
| CNP | 173786 | 441615 | 4390 | 413104 | 26516 |
| CNP | 173786 | 589772 | 4391 | 466807 | 26517 |
| CNP | 173786 | 585452 | 4392 | 468471 | 26518 |
| CNP | 173786 | 592861 | 4393 | N/A | |
| CNP | 173786 | 592105 | 4394 | N/A | |
| CNP | 173786 | 486438 | 4395 | N/A | |
| CNPY1 | 146910 | 406197 | 4396 | 384514 | 26519 |
| CNPY1 | 146910 | 321736 | 4397 | 317439 | 26520 |
| CNPY1 | 146910 | 636446 | 4398 | 490477 | 26521 |
| CNPY1 | 146910 | 636372 | 4399 | 490060 | 26522 |
| CNR1 | 118432 | 369501 | 4400 | 358513 | 26523 |
| CNR1 | 118432 | 369499 | 4401 | 358511 | 26524 |
| CNR1 | 118432 | 549890 | 4402 | 446819 | 26525 |
| CNR1 | 118432 | 362094 | 4403 | 355418 | 26526 |
| CNR1 | 118432 | 468898 | 4404 | 420188 | 26527 |
| CNR1 | 118432 | 428600 | 4405 | 412192 | 26528 |
| CNR1 | 118432 | 551417 | 4406 | 446702 | 26529 |
| CNTFR | 122756 | 351266 | 4407 | 242338 | 26530 |
| CNTFR | 122756 | 378980 | 4408 | 368265 | 26531 |
| CNTFR | 122756 | 417345 | 4409 | 388082 | 26532 |
| CNTFR | 122756 | 610543 | 4410 | 480451 | 26533 |
| CNTN2 | 184144 | 640352 | 4411 | 491080 | 26534 |
| CNTN2 | 184144 | 638378 | 4412 | 492617 | 26535 |
| CNTN2 | 184144 | 331830 | 4413 | 330633 | 26536 |
| CNTN2 | 184144 | 636809 | 4414 | N/A | |
| CNTN2 | 184144 | 640428 | 4415 | 491474 | 26537 |
| CNTN2 | 184144 | 532366 | 4416 | 491665 | 26538 |
| CNTN2 | 184144 | 639302 | 4417 | 491671 | 26539 |
| CNTN2 | 184144 | 639971 | 4418 | 491959 | 26540 |
| CNTN2 | 184144 | 640326 | 4419 | 492495 | 26541 |
| CNTN2 | 184144 | 639015 | 4420 | N/A | |
| CNTN2 | 184144 | 530117 | 4421 | N/A | |
| CNTN2 | 184144 | 638928 | 4422 | N/A | |
| CNTN2 | 184144 | 639023 | 4423 | N/A | |
| CNTN2 | 184144 | 481872 | 4424 | N/A | |
| CNTN2 | 184144 | 636312 | 4425 | 489754 | 26542 |
| CNTN2 | 184144 | 639831 | 4426 | N/A | |
| CNTN2 | 184144 | 639503 | 4427 | N/A | |
| CNTN2 | 184144 | 639122 | 4428 | 491982 | 26543 |
| CNTN2 | 184144 | 530594 | 4429 | N/A | |
| CNTN2 | 184144 | 638449 | 4430 | N/A | |
| CNTN2 | 184144 | 638980 | 4431 | N/A | |
| CNTN2 | 184144 | 639156 | 4432 | N/A | |
| CNTN2 | 184144 | 527340 | 4433 | N/A | |
| CNTN2 | 184144 | 525433 | 4434 | N/A | |
| CNTN2 | 184144 | 639843 | 4435 | 491680 | 26544 |
| CNTN2 | 184144 | 636641 | 4436 | N/A | |
| CNTN2 | 184144 | 638577 | 4437 | 492457 | 26545 |
| CNTN2 | 184144 | 638715 | 4438 | N/A | |
| CNTN2 | 184144 | 639788 | 4439 | N/A | |
| CNTN2 | 184144 | 638050 | 4440 | N/A | |
| CNTN2 | 184144 | 639354 | 4441 | N/A | |
| CNTN2 | 184144 | 640227 | 4442 | N/A | |
| CNTN2 | 184144 | 640714 | 4443 | N/A | |
| CNTN3 | 113805 | 263665 | 4444 | 263665 | 26546 |
| CNTN3 | 113805 | 477856 | 4445 | N/A | |
| CNTN4 | 144619 | 422330 | 4446 | 408594 | 26547 |
| CNTN4 | 144619 | 427741 | 4447 | 396719 | 26548 |
| CNTN4 | 144619 | 455083 | 4448 | 390560 | 26549 |
| CNTN4 | 144619 | 418658 | 4449 | 396010 | 26550 |
| CNTN4 | 144619 | 490876 | 4450 | N/A | |
| CNTN4 | 144619 | 397461 | 4451 | 380602 | 26551 |
| CNTN4 | 144619 | 438282 | 4452 | N/A | |
| CNTN4 | 144619 | 430505 | 4453 | N/A | |
| CNTN4 | 144619 | 434053 | 4454 | 404085 | 26552 |
| CNTN4 | 144619 | 480113 | 4455 | N/A | |
| CNTN4 | 144619 | 473058 | 4456 | N/A | |
| CNTN4 | 144619 | 473173 | 4457 | N/A | |
| CNTN4 | 144619 | 397459 | 4458 | 380600 | 26553 |
| CNTN4 | 144619 | 473845 | 4459 | 422120 | 26554 |
| CNTN4 | 144619 | 475817 | 4460 | N/A | |
| CNTN4 | 144619 | 484686 | 4461 | N/A | |
| CNTN4 | 144619 | 427331 | 4462 | 413642 | 26555 |
| CNTN5 | 149972 | 525047 | 4463 | N/A | |

| Symbol | ENSG | ENST | SEQ ID | ENSP | SEQ ID |
|---|---|---|---|---|---|
| CNTN5 | 149972 | 528727 | 4464 | N/A | |
| CNTN5 | 149972 | 527185 | 4465 | 433575 | 26556 |
| CNTN5 | 149972 | 528682 | 4466 | 436185 | 26557 |
| CNTN5 | 149972 | 524871 | 4467 | 435637 | 26558 |
| CNTN5 | 149972 | 418526 | 4468 | 393229 | 26559 |
| CNTN5 | 149972 | 530458 | 4469 | N/A | |
| CNTN5 | 149972 | 525236 | 4470 | N/A | |
| CNTN5 | 149972 | 527682 | 4471 | N/A | |
| CNTN5 | 149972 | 524560 | 4472 | N/A | |
| CNTN5 | 149972 | 619298 | 4473 | 478120 | 26560 |
| CNTN5 | 149972 | 279463 | 4474 | 279463 | 26561 |
| CNTNAP4 | 152910 | 611870 | 4475 | 479811 | 26562 |
| CNTNAP4 | 152910 | 622250 | 4476 | 477698 | 26563 |
| CNTNAP4 | 152910 | 471618 | 4477 | N/A | |
| CNTNAP4 | 152910 | 463177 | 4478 | N/A | |
| CNTNAP4 | 152910 | 478060 | 4479 | 418741 | 26564 |
| CNTNAP4 | 152910 | 476707 | 4480 | 417628 | 26565 |
| CNTNAP4 | 152910 | 619533 | 4481 | N/A | |
| CNTNAP4 | 152910 | 377504 | 4482 | 439733 | 26566 |
| CNTNAP4 | 152910 | 307431 | 4483 | 306893 | 26567 |
| CNTNAP5 | 155052 | 423939 | 4484 | N/A | |
| CNTNAP5 | 155052 | 431078 | 4485 | 399013 | 26568 |
| CNTNAP5 | 155052 | 470921 | 4486 | N/A | |
| COBL | 106078 | 431948 | 4487 | 413498 | 26569 |
| COBL | 106078 | 445054 | 4488 | 401204 | 26570 |
| COBL | 106078 | 265136 | 4489 | 265136 | 26571 |
| COBL | 106078 | 462395 | 4490 | N/A | |
| COBL | 106078 | 452534 | 4491 | 405059 | 26572 |
| COBL | 106078 | 395540 | 4492 | 378910 | 26573 |
| COBL | 106078 | 441453 | 4493 | 399500 | 26574 |
| COBL | 106078 | 632460 | 4494 | 488001 | 26575 |
| COBL | 106078 | 449281 | 4495 | 391864 | 26576 |
| COBL | 106078 | 395542 | 4496 | 378912 | 26577 |
| COL11A1 | 060718 | 370096 | 4497 | 359114 | 26578 |
| COL11A1 | 060718 | 635193 | 4498 | 489428 | 26579 |
| COL11A1 | 060718 | 639098 | 4499 | N/A | |
| COL11A1 | 060718 | 470170 | 4500 | N/A | |
| COL11A1 | 060718 | 512756 | 4501 | 426533 | 26580 |
| COL11A1 | 060718 | 465209 | 4502 | N/A | |
| COL11A1 | 060718 | 461720 | 4503 | N/A | |
| COL11A1 | 060718 | 475980 | 4504 | N/A | |
| COL11A1 | 060718 | 427239 | 4505 | 408640 | 26581 |
| COL11A1 | 060718 | 447608 | 4506 | 410177 | 26582 |
| COL11A1 | 060718 | 353414 | 4507 | 302551 | 26583 |
| COL11A1 | 060718 | 358392 | 4508 | 351163 | 26584 |
| COL11A2 | 223699 | 425729 | 4509 | 408123 | 26585 |
| COL11A2 | 223699 | 496849 | 4510 | N/A | |
| COL11A2 | 223699 | 452044 | 4511 | 416619 | 26586 |
| COL11A2 | 223699 | 435763 | 4512 | 396587 | 26587 |
| COL11A2 | 223699 | 552134 | 4513 | 449320 | 26588 |
| COL11A2 | 223699 | 551413 | 4514 | 448715 | 26589 |
| COL11A2 | 235708 | 447349 | 4515 | 388309 | 26590 |
| COL11A2 | 235708 | 496392 | 4516 | N/A | |
| COL11A2 | 235708 | 452730 | 4517 | 388775 | 26591 |
| COL11A2 | 235708 | 447741 | 4518 | 400813 | 26592 |
| COL11A2 | 235708 | 552473 | 4519 | 446870 | 26593 |
| COL11A2 | 235708 | 549885 | 4520 | 448931 | 26594 |
| COL11A2 | 206290 | 383219 | 4521 | 372706 | 26595 |
| COL11A2 | 206290 | 420405 | 4522 | 394196 | 26596 |
| COL11A2 | 206290 | 383088 | 4523 | 372566 | 26597 |
| COL11A2 | 206290 | 433947 | 4524 | 388108 | 26598 |
| COL11A2 | 206290 | 549836 | 4525 | 448701 | 26599 |
| COL11A2 | 206290 | 549491 | 4526 | 450084 | 26600 |
| COL11A2 | 232541 | 443138 | 4527 | 404513 | 26601 |
| COL11A2 | 232541 | 447855 | 4528 | 415296 | 26602 |
| COL11A2 | 232541 | 434780 | 4529 | 408523 | 26603 |
| COL11A2 | 232541 | 486982 | 4530 | N/A | |
| COL11A2 | 227801 | 383087 | 4531 | 372565 | 26604 |
| COL11A2 | 227801 | 443125 | 4532 | 402987 | 26605 |
| COL11A2 | 227801 | 451040 | 4533 | 398170 | 26606 |
| COL11A2 | 227801 | 439039 | 4534 | 410284 | 26607 |
| COL11A2 | 227801 | 549811 | 4535 | 449275 | 26608 |
| COL11A2 | 227801 | 551542 | 4536 | 447864 | 26609 |
| COL11A2 | 204248 | 374708 | 4537 | 363840 | 26610 |
| COL11A2 | 204248 | 477772 | 4538 | N/A | |
| COL11A2 | 204248 | 457788 | 4539 | 405520 | 26611 |

-continued

-continued

| Symbol | ENSG | ENST | SEQ ID | ENSP | SEQ ID |
|---|---|---|---|---|---|
| COL11A2 | 204248 | 395194 | 4540 | 378620 | 26612 |
| COL11A2 | 204248 | 341947 | 4541 | 339915 | 26613 |
| COL11A2 | 204248 | 361917 | 4542 | 355123 | 26614 |
| COL11A2 | 230930 | 448717 | 4543 | 408627 | 26615 |
| COL11A2 | 230930 | 494246 | 4544 | N/A | |
| COL11A2 | 230930 | 438711 | 4545 | 398256 | 26616 |
| COL11A2 | 230930 | 452937 | 4546 | 406347 | 26617 |
| COL11A2 | 230930 | 551758 | 4547 | 447062 | 26618 |
| COL11A2 | 230930 | 550998 | 4548 | 450046 | 26619 |
| COL12A1 | 111799 | 425443 | 4549 | 399812 | 26620 |
| COL12A1 | 111799 | 322507 | 4550 | 325146 | 26621 |
| COL12A1 | 111799 | 345356 | 4551 | 305147 | 26622 |
| COL12A1 | 111799 | 416123 | 4552 | 412864 | 26623 |
| COL12A1 | 111799 | 483888 | 4553 | 421216 | 26624 |
| COL12A1 | 111799 | 511023 | 4554 | N/A | |
| COL12A1 | 111799 | 493109 | 4555 | 423423 | 26625 |
| COL12A1 | 111799 | 419671 | 4556 | 393217 | 26626 |
| COL12A1 | 111799 | 474564 | 4557 | N/A | |
| COLI2AI | 111799 | 486533 | 4558 | N/A | |
| COL12A1 | 111799 | 615798 | 4559 | 483232 | 26627 |
| COL13A1 | 197467 | 479733 | 4560 | 430089 | 26628 |
| COL13A1 | 197467 | 398978 | 4561 | 381949 | 26629 |
| COL13A1 | 197467 | 354547 | 4562 | 346553 | 26630 |
| COL13A1 | 197467 | 357811 | 4563 | 350463 | 26631 |
| COL13A1 | 197467 | 520267 | 4564 | 428057 | 26632 |
| COL13A1 | 197467 | 517713 | 4565 | 430061 | 26633 |
| COL13A1 | 197467 | 522165 | 4566 | 428342 | 26634 |
| COL13A1 | 197467 | 520133 | 4567 | 430173 | 26635 |
| COL13A1 | 197467 | 484990 | 4568 | N/A | |
| COL13A1 | 197467 | 398975 | 4569 | 381947 | 26636 |
| COL13A1 | 197467 | 456019 | 4570 | 388774 | 26637 |
| COL13A1 | 197467 | 518052 | 4571 | N/A | |
| COL13A1 | 197467 | 478219 | 4572 | N/A | |
| COL13A1 | 197467 | 398969 | 4573 | 381941 | 26638 |
| COL15A1 | 204291 | 467052 | 4574 | N/A | |
| COL15A1 | 204291 | 471477 | 4575 | N/A | |
| COL15A1 | 204291 | 375001 | 4576 | 364140 | 26639 |
| COL15A1 | 204291 | 496686 | 4577 | N/A | |
| COL15A1 | 204291 | 610452 | 4578 | 483455 | 26640 |
| COL18A1 | 182871 | 400337 | 4579 | 383191 | 26641 |
| COL18A1 | 182871 | 355480 | 4580 | 347665 | 26642 |
| COL18A1 | 182871 | 342220 | 4581 | 339118 | 26643 |
| COL18A1 | 182871 | 459895 | 4582 | N/A | |
| COL18A1 | 182871 | 423214 | 4583 | 415692 | 26644 |
| COL18A1 | 182871 | 473212 | 4584 | N/A | |
| COL18A1 | 182871 | 359759 | 4585 | 352798 | 26645 |
| COL1A1 | 108821 | 225964 | 4586 | 225964 | 26646 |
| COL1A1 | 108821 | 510710 | 4587 | N/A | |
| COL1A1 | 108821 | 486572 | 4588 | N/A | |
| COL1A1 | 108821 | 511732 | 4589 | N/A | |
| COL1A1 | 108821 | 494334 | 4590 | N/A | |
| COL1A1 | 108821 | 476387 | 4591 | N/A | |
| COL1A1 | 108821 | 504289 | 4592 | N/A | |
| COL1A1 | 108821 | 463440 | 4593 | N/A | |
| COL1A1 | 108821 | 471344 | 4594 | N/A | |
| COL1A1 | 108821 | 485870 | 4595 | N/A | |
| COL1A1 | 108821 | 495677 | 4596 | N/A | |
| COL1A1 | 108821 | 474644 | 4597 | N/A | |
| COL1A1 | 108821 | 507689 | 4598 | 460459 | 26647 |
| COL1A2 | 164692 | 297268 | 4599 | 297268 | 26648 |
| COL1A2 | 164692 | 488298 | 4600 | N/A | |
| COL1A2 | 164692 | 473573 | 4601 | N/A | |
| COL1A2 | 164692 | 497316 | 4602 | N/A | |
| COL1A2 | 164692 | 461525 | 4603 | N/A | |
| COL1A2 | 164692 | 467931 | 4604 | N/A | |
| COL1A2 | 164692 | 481570 | 4605 | N/A | |
| COL1A2 | 164692 | 469732 | 4606 | N/A | |
| COL1A2 | 164692 | 478215 | 4607 | N/A | |
| COL1A2 | 164692 | 488121 | 4608 | N/A | |
| COL1A2 | 164692 | 492110 | 4609 | N/A | |
| COL1A2 | 164692 | 464916 | 4610 | N/A | |
| COL1A2 | 164692 | 620463 | 4611 | 477719 | 26649 |
| COL20A1 | 101203 | 358894 | 4612 | 351767 | 26650 |
| COL20A1 | 101203 | 479501 | 4613 | N/A | |
| COL20A1 | 101203 | 422202 | 4614 | 414753 | 26651 |
| COL20A1 | 101203 | 415763 | 4615 | 410799 | 26652 |

| Symbol | ENSG | ENST | SEQ ID | ENSP | SEQ ID |
|---|---|---|---|---|---|
| COL20A1 | 101203 | 455906 | 4616 | 406345 | 26653 |
| COL20A1 | 101203 | 471582 | 4617 | N/A | |
| COL20A1 | 101203 | 494913 | 4618 | N/A | |
| COL20A1 | 101203 | 496810 | 4619 | N/A | |
| COL22A1 | 169436 | 341807 | 4620 | N/A | |
| COL22A1 | 169436 | 303045 | 4621 | 303153 | 26654 |
| COL22A1 | 169436 | 487854 | 4622 | N/A | |
| COL22A1 | 169436 | 522546 | 4623 | 428244 | 26655 |
| COL22A1 | 169436 | 517515 | 4624 | N/A | |
| COL22A1 | 169436 | 484387 | 4625 | N/A | |
| COL22A1 | 169436 | 435777 | 4626 | 387655 | 26656 |
| COL23A1 | 050767 | 390654 | 4627 | 375069 | 26657 |
| COL23A1 | 050767 | 484750 | 4628 | N/A | |
| COL23A1 | 050767 | 407622 | 4629 | 385092 | 26658 |
| COL25A1 | 188517 | 494183 | 4630 | 437131 | 26659 |
| COL25A1 | 188517 | 512961 | 4631 | 426841 | 26660 |
| COL25A1 | 188517 | 399132 | 4632 | 382083 | 26661 |
| COL25A1 | 188517 | 399127 | 4633 | 382078 | 26662 |
| COL25A1 | 188517 | 399129 | 4634 | 382077 | 26663 |
| COL25A1 | 188517 | 505377 | 4635 | N/A | |
| COL25A1 | 188517 | 505591 | 4636 | 422266 | 26664 |
| COL25A1 | 188517 | 610288 | 4637 | 482699 | 26665 |
| COL25A1 | 188517 | 622134 | 4638 | 484110 | 26666 |
| COL4A1 | 187498 | 375820 | 4639 | 364979 | 26667 |
| COL4A1 | 187498 | 467182 | 4640 | N/A | |
| COL4A1 | 187498 | 474391 | 4641 | N/A | |
| COL4A1 | 187498 | 543140 | 4642 | 443348 | 26668 |
| COL4A1 | 187498 | 615732 | 4643 | 478222 | 26669 |
| COL4A5 | 188153 | 477429 | 4644 | N/A | |
| COL4A5 | 188153 | 328300 | 4645 | 331902 | 26670 |
| COL4A5 | 188153 | 361603 | 4646 | 354505 | 26671 |
| COL4A5 | 188153 | 470339 | 4647 | N/A | |
| COL4A5 | 188153 | 483338 | 4648 | N/A | |
| COL4A5 | 188153 | 505728 | 4649 | 424137 | 26672 |
| COL4A5 | 188153 | 489230 | 4650 | N/A | |
| COL4A5 | 188153 | 510690 | 4651 | N/A | |
| COL4A5 | 188153 | 515658 | 4652 | 423520 | 26673 |
| COL4A5 | 188153 | 504541 | 4653 | 424845 | 26674 |
| COL5A1 | 130635 | 371817 | 4654 | 360882 | 26675 |
| COL5A1 | 130635 | 464187 | 4655 | N/A | |
| COL5A1 | 130635 | 469093 | 4656 | N/A | |
| COL5A1 | 130635 | 463925 | 4657 | N/A | |
| COL5A1 | 130635 | 460264 | 4658 | N/A | |
| COL5A1 | 130635 | 371820 | 4659 | 360885 | 26676 |
| COL5A1 | 130635 | 465877 | 4660 | N/A | |
| COL5A1 | 130635 | 618395 | 4661 | 481360 | 26677 |
| COL5A3 | 080573 | 264828 | 4662 | 264828 | 26678 |
| COL5A3 | 080573 | 461214 | 4663 | N/A | |
| COL6A1 | 142156 | 361866 | 4664 | 355180 | 26679 |
| COL6A1 | 142156 | 492851 | 4665 | N/A | |
| COL6A1 | 142156 | 466285 | 4666 | N/A | |
| COL6A1 | 142156 | 463060 | 4667 | N/A | |
| COL6A1 | 142156 | 498614 | 4668 | N/A | |
| COL6A1 | 142156 | 486023 | 4669 | N/A | |
| COL6A1 | 142156 | 612273 | 4670 | 483630 | 26680 |
| COL9A1 | 112280 | 357250 | 4671 | 349790 | 26681 |
| COL9A1 | 112280 | 320755 | 4672 | 315252 | 26682 |
| COL9A1 | 112280 | 486080 | 4673 | N/A | |
| COL9A1 | 112280 | 489611 | 4674 | N/A | |
| COL9A1 | 112280 | 447041 | 4675 | N/A | |
| COL9A1 | 112280 | 493682 | 4676 | N/A | |
| COL9A1 | 112280 | 360859 | 4677 | N/A | |
| COL9A1 | 112280 | 489861 | 4678 | N/A | |
| COL9A1 | 112280 | 470652 | 4679 | N/A | |
| COL9A1 | 112280 | 370496 | 4680 | 359527 | 26683 |
| COLEC12 | 158270 | 580242 | 4681 | N/A | |
| COLEC12 | 158270 | 400256 | 4682 | 383115 | 26684 |
| COLEC12 | 158270 | 582147 | 4683 | N/A | |
| COLGALT2 | 198756 | 486375 | 4684 | N/A | |
| COLGALT2 | 198756 | 367521 | 4685 | 356491 | 26685 |
| COLGALT2 | 198756 | 361927 | 4686 | 354960 | 26686 |
| COLGALT2 | 198756 | 367520 | 4687 | 356490 | 26687 |
| COLGALT2 | 198756 | 486375 | 4688 | N/A | |
| COLGALT2 | 198756 | 367521 | 4689 | 356491 | 26688 |
| COLGALT2 | 198756 | 361927 | 4690 | 354960 | 26689 |
| COLGALT2 | 198756 | 367520 | 4691 | 356490 | 26690 |

-continued

-continued

| Symbol | ENSG | ENST | SEQ ID | ENSP | SEQ ID |
|---|---|---|---|---|---|
| COQ10B | 115520 | 263960 | 4692 | 263960 | 26691 |
| COQ10B | 115520 | 409398 | 4693 | 386785 | 26692 |
| COQ10B | 115520 | 488445 | 4694 | N/A | |
| COQ10B | 115520 | 409010 | 4695 | 387223 | 26693 |
| CORIN | 145244 | 273857 | 4696 | 273857 | 26694 |
| CORIN | 145244 | 508498 | 4697 | 425597 | 26695 |
| CORIN | 145244 | 502252 | 4698 | 424212 | 26696 |
| CORIN | 145244 | 505909 | 4699 | 425401 | 26697 |
| CORIN | 145244 | 515827 | 4700 | N/A | |
| CORIN | 145244 | 505754 | 4701 | N/A | |
| CORIN | 145244 | 504584 | 4702 | 423216 | 26698 |
| CORIN | 145244 | 503821 | 4703 | N/A | |
| CORIN | 145244 | 502726 | 4704 | N/A | |
| CORIN | 145244 | 510974 | 4705 | N/A | |
| CORIN | 145244 | 610355 | 4706 | 484087 | 26699 |
| CORO1C | 110880 | 261401 | 4707 | 261401 | 26700 |
| CORO1C | 110880 | 541050 | 4708 | 438341 | 26701 |
| CORO1C | 110880 | 546705 | 4709 | 447337 | 26702 |
| CORO1C | 110880 | 549384 | 4710 | N/A | |
| CORO1C | 110880 | 421578 | 4711 | 415554 | 26703 |
| CORO1C | 110880 | 550542 | 4712 | 448130 | 26704 |
| CORO1C | 110880 | 549772 | 4713 | 447534 | 26705 |
| CORO1C | 110880 | 549387 | 4714 | N/A | |
| CORO1C | 110880 | 552030 | 4715 | N/A | |
| CORO1C | 110880 | 547361 | 4716 | N/A | |
| CORO1C | 110880 | 552871 | 4717 | 449658 | 26706 |
| CORO1C | 110880 | 547294 | 4718 | 449330 | 26707 |
| CORO1C | 110880 | 550032 | 4719 | 447989 | 26708 |
| CORO1C | 110880 | 551550 | 4720 | 448527 | 26709 |
| CORO1C | 110880 | 546571 | 4721 | 448195 | 26710 |
| CORO1C | 110880 | 551044 | 4722 | 447049 | 26711 |
| CORO1C | 110880 | 547170 | 4723 | N/A | |
| CORO1C | 110880 | 551059 | 4724 | N/A | |
| CORO1C | 110880 | 420959 | 4725 | 394496 | 26712 |
| CORO2A | 106789 | 343933 | 4726 | 343746 | 26713 |
| CORO2A | 106789 | 375077 | 4727 | 364218 | 26714 |
| CORO2B | 103647 | 261861 | 4728 | 261861 | 26715 |
| CORO2B | 103647 | 566799 | 4729 | 454783 | 26716 |
| CORO2B | 103647 | 540068 | 4730 | 446250 | 26717 |
| CORO2B | 103647 | 543950 | 4731 | 443819 | 26718 |
| CORO6 | 167549 | 469090 | 4732 | N/A | |
| CORO6 | 167549 | 345068 | 4733 | 344562 | 26719 |
| CORO6 | 167549 | 459686 | 4734 | N/A | |
| CORO6 | 167549 | 580212 | 4735 | 463723 | 26720 |
| CORO6 | 167549 | 579388 | 4736 | N/A | |
| CORO6 | 167549 | 467534 | 4737 | N/A | |
| CORO6 | 167549 | 480954 | 4738 | 464621 | 26721 |
| CORO6 | 167549 | 584969 | 4739 | 462627 | 26722 |
| CORO6 | 167549 | 577909 | 4740 | N/A | |
| CORO6 | 167549 | 492276 | 4741 | 464396 | 26723 |
| CORO6 | 167549 | 584602 | 4742 | 468235 | 26724 |
| CORO6 | 167549 | 388767 | 4743 | 373419 | 26725 |
| COTL1 | 103187 | 262428 | 4744 | 262428 | 26726 |
| COTL1 | 103187 | 567278 | 4745 | N/A | |
| COTL1 | 103187 | 564057 | 4746 | 457033 | 26727 |
| COTL1 | 103187 | 561707 | 4747 | N/A | |
| COTL1 | 103187 | 564662 | 4748 | N/A | |
| COTL1 | 103187 | 567786 | 4749 | 480117 | 26728 |
| COX6B2 | 160471 | 588572 | 4750 | 467959 | 26729 |
| COX6B2 | 160471 | 326529 | 4751 | 320672 | 26730 |
| COX6B2 | 160471 | 593184 | 4752 | 467266 | 26731 |
| COX6B2 | 160471 | 590900 | 4753 | 467128 | 26732 |
| COX6B2 | 160471 | 589879 | 4754 | N/A | |
| COX6B2 | 160471 | 588586 | 4755 | N/A | |
| COX6B2 | 160471 | 586191 | 4756 | N/A | |
| COX6B2 | 160471 | 589467 | 4757 | 476768 | 26733 |
| COX6B2 | 160471 | 587357 | 4758 | N/A | |
| COX6B2 | 160471 | 587854 | 4759 | N/A | |
| CPE | 109472 | 513982 | 4760 | 424830 | 26734 |
| CPE | 109472 | 402744 | 4761 | 386104 | 26735 |
| CPE | 109472 | 480404 | 4762 | 427629 | 26736 |
| CPE | 109472 | 431967 | 4763 | 416601 | 26737 |
| CPE | 109472 | 511992 | 4764 | 423699 | 26738 |
| CPLX2 | 145920 | 359546 | 4765 | 352544 | 26739 |
| CPLX2 | 145920 | 506642 | 4766 | N/A | |
| CPLX2 | 145920 | 515502 | 4767 | 423564 | 26740 |

| Symbol | ENSG | ENST | SEQ ID | ENSP | SEQ ID |
|---|---|---|---|---|---|
| CPLX2 | 145920 | 509837 | 4768 | 421106 | 26741 |
| CPLX2 | 145920 | 393745 | 4769 | 377346 | 26742 |
| CPLX2 | 145920 | 512824 | 4770 | 425973 | 26743 |
| CPLX2 | 145920 | 514150 | 4771 | 423612 | 26744 |
| CPLX2 | 145920 | 502265 | 4772 | 424305 | 26745 |
| CPLX2 | 145920 | 515025 | 4773 | 425284 | 26746 |
| CPLX2 | 145920 | 515094 | 4774 | 421825 | 26747 |
| CPLX3 | 213578 | 395018 | 4775 | 378464 | 26748 |
| CPM | 135678 | 546556 | 4776 | 447051 | 26749 |
| CPM | 135678 | 551897 | 4777 | 447455 | 26750 |
| CPM | 135678 | 551568 | 4778 | 448517 | 26751 |
| CPM | 135678 | 546373 | 4779 | 447255 | 26752 |
| CPM | 135678 | 546912 | 4780 | N/A | |
| CPM | 135678 | 548954 | 4781 | 446799 | 26753 |
| CPM | 135678 | 551728 | 4782 | 446573 | 26754 |
| CPM | 135678 | 547134 | 4783 | 450400 | 26755 |
| CPM | 135678 | 547924 | 4784 | N/A | |
| CPM | 135678 | 548262 | 4785 | 449911 | 26756 |
| CPM | 135678 | 549781 | 4786 | 448078 | 26757 |
| CPM | 135678 | 549691 | 4787 | N/A | |
| CPM | 135678 | 338356 | 4788 | 339157 | 26758 |
| CPNE4 | 196353 | 617767 | 4789 | 478878 | 26759 |
| CPNE4 | 196353 | 429747 | 4790 | 411904 | 26760 |
| CPNE4 | 196353 | 505881 | 4791 | 425506 | 26761 |
| CPNE4 | 196353 | 511604 | 4792 | 423811 | 26762 |
| CPNE4 | 196353 | 512332 | 4793 | 424853 | 26763 |
| CPNE4 | 196353 | 503204 | 4794 | N/A | |
| CPNE4 | 196353 | 514439 | 4795 | N/A | |
| CPNE4 | 196353 | 505331 | 4796 | N/A | |
| CPNE4 | 196353 | 506687 | 4797 | N/A | |
| CPNE4 | 196353 | 505957 | 4798 | 421394 | 26764 |
| CPNE4 | 196353 | 514999 | 4799 | 427561 | 26765 |
| CPNE4 | 196353 | 502818 | 4800 | 421646 | 26766 |
| CPNE4 | 196353 | 515418 | 4801 | N/A | |
| CPNE4 | 196353 | 512055 | 4802 | 421705 | 26767 |
| CPNE7 | 178773 | 268720 | 4803 | 268720 | 26768 |
| CPNE7 | 178773 | 525982 | 4804 | 431863 | 26769 |
| CPNE7 | 178773 | 319518 | 4805 | 317374 | 26770 |
| CPNE7 | 178773 | 532500 | 4806 | N/A | |
| CPNE7 | 178773 | 529800 | 4807 | 435876 | 26771 |
| CPNE7 | 178773 | 568977 | 4808 | 455086 | 26772 |
| CPNE7 | 178773 | 566398 | 4809 | N/A | |
| CPNE7 | 178773 | 526232 | 4810 | 434886 | 26773 |
| CPNE7 | 178773 | 564421 | 4811 | N/A | |
| CPNE8 | 139117 | 552259 | 4812 | N/A | |
| CPNE8 | 139117 | 331366 | 4813 | 329748 | 26774 |
| CPNE8 | 139117 | 538596 | 4814 | 439237 | 26775 |
| CPNE8 | 139117 | 546603 | 4815 | N/A | |
| CPNE8 | 139117 | 360449 | 4816 | 353633 | 26776 |
| CPNE8 | 139117 | 547417 | 4817 | N/A | |
| CPNE8 | 139117 | 549842 | 4818 | N/A | |
| CPNE8 | 139117 | 551855 | 4819 | N/A | |
| CPNE8 | 139117 | 550863 | 4820 | 447761 | 26777 |
| CPNE9 | 144550 | 383832 | 4821 | 373343 | 26778 |
| CPNE9 | 144550 | 383831 | 4822 | 373342 | 26779 |
| CPNE9 | 144550 | 491802 | 4823 | N/A | |
| CPNE9 | 144550 | 273027 | 4824 | 273027 | 26780 |
| CPNE9 | 144550 | 613455 | 4825 | 480762 | 26781 |
| CPVL | 106066 | 265394 | 4826 | 265394 | 26782 |
| CPVL | 106066 | 396276 | 4827 | 379572 | 26783 |
| CPVL | 106066 | 432534 | 4828 | 397327 | 26784 |
| CPVL | 106066 | 455893 | 4829 | 403580 | 26785 |
| CPVL | 106066 | 409850 | 4830 | 387164 | 26786 |
| CPVL | 106066 | 448959 | 4831 | 409036 | 26787 |
| CPVL | 106066 | 458405 | 4832 | 417015 | 26788 |
| CPVL | 106066 | 447426 | 4833 | 395690 | 26789 |
| CPVL | 106066 | 488891 | 4834 | N/A | |
| CPVL | 106066 | 449801 | 4835 | 413287 | 26790 |
| CPVL | 106066 | 455544 | 4836 | 412857 | 26791 |
| CPVL | 106066 | 437527 | 4837 | 416555 | 26792 |
| CREB3L1 | 157613 | 621158 | 4838 | 481956 | 26793 |
| CREB3L1 | 157613 | 534787 | 4839 | 431677 | 26794 |
| CREB3L1 | 157613 | 527342 | 4840 | N/A | |
| CREB3L1 | 157613 | 530518 | 4841 | 436574 | 26795 |
| CREB3L1 | 157613 | 534616 | 4842 | N/A | |
| CREB3L1 | 157613 | 616094 | 4843 | N/A | |

-continued

-continued

| Symbol | ENSG | ENST | SEQ ID | ENSP | SEQ ID | Symbol | ENSG | ENST | SEQ ID | ENSP | SEQ ID |
|---|---|---|---|---|---|---|---|---|---|---|---|
| CREB3L2 | 182158 | 330387 | 4844 | 329140 | 26796 | CRYBG3 | 080200 | 495403 | 4920 | 418420 | 26852 |
| CREB3L2 | 182158 | 456390 | 4845 | 403550 | 26797 | CRYBG3 | 080200 | 485253 | 4921 | N/A | |
| CREB3L2 | 182158 | 452463 | 4846 | 410314 | 26798 | CRYL1 | 165475 | 480748 | 4922 | 479908 | 26853 |
| CREB3L2 | 182158 | 458726 | 4847 | 388917 | 26799 | CRYL1 | 165475 | 382812 | 4923 | 372262 | 26854 |
| CREB3L2 | 182158 | 420629 | 4848 | 402889 | 26800 | CRYL1 | 165475 | 298248 | 4924 | 298248 | 26855 |
| CREB3L2 | 182158 | 468127 | 4849 | N/A | | CRYM | 103316 | 574448 | 4925 | 459982 | 26856 |
| CREB3L2 | 182158 | 616381 | 4850 | 478432 | 26801 | CRYM | 103316 | 570401 | 4926 | 460820 | 26857 |
| CREB3L2 | 182158 | 620715 | 4851 | 478809 | 26802 | CRYM | 103316 | 219599 | 4927 | 219599 | 26858 |
| CRIM1 | 150938 | 280527 | 4852 | 280527 | 26803 | CRYM | 103316 | 572113 | 4928 | N/A | |
| CRIM1 | 150938 | 426856 | 4853 | 407636 | 26804 | CRYM | 103316 | 576703 | 4929 | 460126 | 26859 |
| CRIM1 | 150938 | 428774 | 4854 | 415706 | 26805 | CRYM | 103316 | 571666 | 4930 | N/A | |
| CRIM1 | 150938 | 473403 | 4855 | N/A | | CRYM | 103316 | 572914 | 4931 | 461904 | 26860 |
| CRIM1 | 150938 | 477491 | 4856 | N/A | | CRYM | 103316 | 571358 | 4932 | 460510 | 26861 |
| CRIM1 | 150938 | 497236 | 4857 | N/A | | CRYM | 103316 | 574787 | 4933 | N/A | |
| CRIM1 | 150938 | 481321 | 4858 | N/A | | CRYM | 103316 | 543948 | 4934 | 440227 | 26862 |
| CRIM1 | 150938 | 413985 | 4859 | 403120 | 26806 | CRYM | 283922 | 639469 | 4935 | 492884 | 26863 |
| CRIM1 | 277354 | 619072 | 4860 | 480938 | 26807 | CRYM | 283922 | 639312 | 4936 | 491775 | 26864 |
| CRIM1 | 277354 | 613124 | 4861 | 480932 | 26808 | CRYM | 283922 | 639592 | 4937 | 490961 | 26865 |
| CRIM1 | 277354 | 619935 | 4862 | 478123 | 26809 | CRYM | 283922 | 640547 | 4938 | 492104 | 26866 |
| CRIPT | 119878 | 486447 | 4863 | N/A | | CRYM | 283922 | 640971 | 4939 | N/A | |
| CRIPT | 119878 | 238892 | 4864 | 238892 | 26810 | CRYM | 283922 | 640031 | 4940 | 491052 | 26867 |
| CRISPLD1 | 121005 | 262207 | 4865 | 262207 | 26811 | CRYM | 283922 | 639726 | 4941 | N/A | |
| CRISPLD1 | 121005 | 519798 | 4866 | N/A | | CRYM | 283922 | 640994 | 4942 | 491368 | 26868 |
| CRISPLD1 | 121005 | 520277 | 4867 | 430504 | 26812 | CRYM | 283922 | 638658 | 4943 | 492312 | 26869 |
| CRISPLD1 | 121005 | 523524 | 4868 | 430105 | 26813 | CRYM | 283922 | 638961 | 4944 | N/A | |
| CRISPLD1 | 121005 | 517786 | 4869 | 429746 | 26814 | CRYM-AS1 | 189149 | 338573 | 4945 | N/A | |
| CRISPLD2 | 103196 | 262424 | 4870 | 262424 | 26815 | CRYM-AS1 | 189149 | 561968 | 4946 | N/A | |
| CRISPLD2 | 103196 | 566151 | 4871 | 456554 | 26816 | CRYM-AS1 | 189149 | 444326 | 4947 | N/A | |
| CRISPLD2 | 103196 | 567845 | 4872 | 457183 | 26817 | CRYM-AS1 | 189149 | 637983 | 4948 | N/A | |
| CRISPLD2 | 103196 | 566431 | 4873 | N/A | | CSF1R | 182578 | 504875 | 4949 | 422212 | 26870 |
| CRISPLD2 | 103196 | 565561 | 4874 | N/A | | CSF1R | 182578 | 286301 | 4950 | 286301 | 26871 |
| CRISPLD2 | 103196 | 564567 | 4875 | 457655 | 26818 | CSF1R | 182578 | 509861 | 4951 | N/A | |
| CRISPLD2 | 103196 | 569090 | 4876 | 454858 | 26819 | CSF1R | 182578 | 515068 | 4952 | 427545 | 26872 |
| CRISPLD2 | 103196 | 569262 | 4877 | N/A | | CSF1R | 182578 | 515239 | 4953 | N/A | |
| CRISPLD2 | 103196 | 563066 | 4878 | 456952 | 26820 | CSF1R | 182578 | 513609 | 4954 | N/A | |
| CRISPLD2 | 103196 | 566789 | 4879 | 457259 | 26821 | CSF1R | 182578 | 502660 | 4955 | N/A | |
| CRISPLD2 | 103196 | 566165 | 4880 | 463171 | 26822 | CSF1R | 182578 | 511344 | 4956 | 421174 | 26873 |
| CRLF1 | 006016 | 594325 | 4881 | N/A | | CSF1R | 182578 | 543093 | 4957 | 445282 | 26874 |
| CRLF1 | 006016 | 596360 | 4882 | N/A | | CSMD1 | 183117 | 335551 | 4958 | 334828 | 26875 |
| CRLF1 | 006016 | 392386 | 4883 | 376188 | 26823 | CSMD1 | 183117 | 400186 | 4959 | 383047 | 26876 |
| CRLF1 | 006016 | 597131 | 4884 | 470625 | 26824 | CSMD1 | 183117 | 602723 | 4960 | 473617 | 26877 |
| CRLF1 | 006016 | 593286 | 4885 | N/A | | CSMD1 | 183117 | 635120 | 4961 | 489225 | 26878 |
| CRTAC1 | 095713 | 413387 | 4886 | 408445 | 26825 | CSMD1 | 183117 | 520002 | 4962 | 430733 | 26879 |
| CRTAC1 | 095713 | 370597 | 4887 | 359629 | 26826 | CSMD1 | 183117 | 602557 | 4963 | 473359 | 26880 |
| CRTAC1 | 095713 | 436034 | 4888 | 404549 | 26827 | CSMD1 | 183117 | 519623 | 4964 | N/A | |
| CRTAC1 | 095713 | 309155 | 4889 | 310810 | 26828 | CSMD1 | 183117 | 523062 | 4965 | N/A | |
| CRTAC1 | 095713 | 468549 | 4890 | N/A | | CSMD1 | 183117 | 520561 | 4966 | N/A | |
| CRTAC1 | 095713 | 370591 | 4891 | 359623 | 26829 | CSMD1 | 183117 | 523387 | 4967 | N/A | |
| CRY1 | 008405 | 008527 | 4892 | 008527 | 26830 | CSMD1 | 183117 | 523488 | 4968 | N/A | |
| CRY1 | 008405 | 552790 | 4893 | N/A | | CSMD1 | 183117 | 520451 | 4969 | N/A | |
| CRY1 | 008405 | 549356 | 4894 | 447738 | 26831 | CSMD1 | 183117 | 521646 | 4970 | N/A | |
| CRY1 | 008405 | 546722 | 4895 | N/A | | CSMD1 | 183117 | 524177 | 4971 | N/A | |
| CRY1 | 008405 | 550633 | 4896 | N/A | | CSMD1 | 183117 | 520630 | 4972 | N/A | |
| CRYAB | 109846 | 526180 | 4897 | 436051 | 26832 | CSMD1 | 183117 | 519090 | 4973 | N/A | |
| CRYAB | 109846 | 524660 | 4898 | 432454 | 26833 | CSMD1 | 183117 | 518151 | 4974 | N/A | |
| CRYAB | 109846 | 533280 | 4899 | 435046 | 26834 | CSMD1 | 183117 | 537824 | 4975 | 441462 | 26881 |
| CRYAB | 109846 | 525823 | 4900 | 435411 | 26835 | CSMD1 | 183117 | 335551 | 4976 | 334828 | 26882 |
| CRYAB | 109846 | 533475 | 4901 | 433560 | 26836 | CSMD1 | 183117 | 400186 | 4977 | 383047 | 26883 |
| CRYAB | 109846 | 527950 | 4902 | 437149 | 26837 | CSMD1 | 183117 | 602723 | 4978 | 473617 | 26884 |
| CRYAB | 109846 | 227251 | 4903 | 227251 | 26838 | CSMD1 | 183117 | 635120 | 4979 | 489225 | 26885 |
| CRYAB | 109846 | 531198 | 4904 | 434247 | 26839 | CSMD1 | 183117 | 520002 | 4980 | 430733 | 26886 |
| CRYAB | 109846 | 528961 | 4905 | 435960 | 26840 | CSMD1 | 183117 | 602557 | 4981 | 473359 | 26887 |
| CRYAB | 109846 | 527899 | 4906 | 436089 | 26841 | CSMD1 | 183117 | 519623 | 4982 | N/A | |
| CRYAB | 109846 | 526167 | 4907 | 434793 | 26842 | CSMD1 | 183117 | 523062 | 4983 | N/A | |
| CRYAB | 109846 | 529647 | 4908 | 431754 | 26843 | CSMD1 | 183117 | 520561 | 4984 | N/A | |
| CRYAB | 109846 | 533971 | 4909 | 434269 | 26844 | CSMD1 | 183117 | 523387 | 4985 | N/A | |
| CRYAB | 109846 | 528628 | 4910 | 432182 | 26845 | CSMD1 | 183117 | 523488 | 4986 | N/A | |
| CRYAB | 109846 | 533879 | 4911 | 435931 | 26846 | CSMD1 | 183117 | 520451 | 4987 | N/A | |
| CRYAB | 109846 | 616970 | 4912 | 483554 | 26847 | CSMD1 | 183117 | 521646 | 4988 | N/A | |
| CRYBA2 | 163499 | 392096 | 4913 | 375946 | 26848 | CSMD1 | 183117 | 524177 | 4989 | N/A | |
| CRYBA2 | 163499 | 496566 | 4914 | N/A | | CSMD1 | 183117 | 520630 | 4990 | N/A | |
| CRYBA2 | 163499 | 487181 | 4915 | N/A | | CSMD1 | 183117 | 519090 | 4991 | N/A | |
| CRYBA2 | 163499 | 295728 | 4916 | 295728 | 26849 | CSMD1 | 183117 | 518151 | 4992 | N/A | |
| CRYBA2 | 163499 | 453769 | 4917 | 395120 | 26850 | CSMD1 | 183117 | 537824 | 4993 | 441462 | 26888 |
| CRYBA2 | 163499 | 490678 | 4918 | N/A | | CSMD2 | 121904 | 241312 | 4994 | 241312 | 26889 |
| CRYBG3 | 080200 | 389622 | 4919 | 374273 | 26851 | CSMD2 | 121904 | 465819 | 4995 | N/A | |

-continued

-continued

| Symbol | ENSG | ENST | SEQ ID | ENSP | SEQ ID |
|---|---|---|---|---|---|
| CSMD2 | 121904 | 373380 | 4996 | 362478 | 26890 |
| CSMD2 | 121904 | 489419 | 4997 | N/A | |
| CSMD2 | 121904 | 373377 | 4998 | 362475 | 26891 |
| CSMD2 | 121904 | 338325 | 4999 | 340311 | 26892 |
| CSMD2 | 121904 | 471438 | 5000 | N/A | |
| CSMD2 | 121904 | 373388 | 5001 | 362486 | 26893 |
| CSMD2 | 121904 | 373381 | 5002 | 362479 | 26894 |
| CSMD2 | 121904 | 619121 | 5003 | 483463 | 26895 |
| CSPG4 | 173546 | 308508 | 5004 | 312506 | 26896 |
| CSPG4 | 173546 | 308508 | 5005 | 312506 | 26897 |
| CSPG5 | 114646 | 456150 | 5006 | 392096 | 26898 |
| CSPG5 | 114646 | 383738 | 5007 | 373244 | 26899 |
| CSPG5 | 114646 | 264723 | 5008 | 264723 | 26900 |
| CSPG5 | 114646 | 465441 | 5009 | N/A | |
| CSPG5 | 114646 | 610462 | 5010 | 478923 | 26901 |
| CSRNP1 | 144655 | 273153 | 5011 | 273153 | 26902 |
| CSRNP1 | 144655 | 514182 | 5012 | 422532 | 26903 |
| CSRNP3 | 178662 | 421875 | 5013 | 412081 | 26904 |
| CSRNP3 | 178662 | 409664 | 5014 | 386278 | 26905 |
| CSRNP3 | 178662 | 464503 | 5015 | N/A | |
| CSRNP3 | 178662 | 342316 | 5016 | 344042 | 26906 |
| CSRNP3 | 178662 | 409420 | 5017 | 387195 | 26907 |
| CSRNP3 | 178662 | 314499 | 5018 | 318258 | 26908 |
| CSRP1 | 159176 | 367306 | 5019 | 356275 | 26909 |
| CSRP1 | 159176 | 533402 | 5020 | N/A | |
| CSRP1 | 159176 | 527662 | 5021 | N/A | |
| CSRP1 | 159176 | 532313 | 5022 | N/A | |
| CSRP1 | 159176 | 531916 | 5023 | 432110 | 26910 |
| CSRP1 | 159176 | 532460 | 5024 | 434147 | 26911 |
| CSRP1 | 159176 | 526256 | 5025 | 483864 | 26912 |
| CSRP1 | 159176 | 533432 | 5026 | 436792 | 26913 |
| CSRP1 | 159176 | 530120 | 5027 | N/A | |
| CSRP1 | 159176 | 526723 | 5028 | 436491 | 26914 |
| CSRP1 | 159176 | 526317 | 5029 | N/A | |
| CSRP1 | 159176 | 524951 | 5030 | 437218 | 26915 |
| CSRP1 | 159176 | 458271 | 5031 | N/A | |
| CSRP1 | 159176 | 527573 | 5032 | N/A | |
| CSRP1 | 159176 | 529975 | 5033 | N/A | |
| CSRP1 | 159176 | 533188 | 5034 | N/A | |
| CSRP1 | 159176 | 471596 | 5035 | N/A | |
| CSRP1 | 159176 | 481851 | 5036 | N/A | |
| CSRP1 | 159176 | 340006 | 5037 | 345079 | 26916 |
| CSTA | 121552 | 264474 | 5038 | 264474 | 26917 |
| CSTA | 121552 | 479204 | 5039 | 418891 | 26918 |
| CSTF2T | 177613 | 331173 | 5040 | 332444 | 26919 |
| LINC01933 | 254226 | 524295 | 5041 | N/A | |
| LINC01933 | 254226 | 524034 | 5042 | N/A | |
| LINC01933 | 254226 | 518431 | 5043 | N/A | |
| LINC01933 | 254226 | 523605 | 5044 | N/A | |
| CTH | 116761 | 464926 | 5045 | N/A | |
| CTH | 116761 | 370938 | 5046 | 359976 | 26920 |
| CTH | 116761 | 346806 | 5047 | 311554 | 26921 |
| CTH | 116761 | 482383 | 5048 | N/A | |
| CTH | 116761 | 411986 | 5049 | 413407 | 26922 |
| CTNNA3 | 183230 | 433211 | 5050 | 389714 | 26923 |
| CTNNA3 | 183230 | 373735 | 5051 | N/A | |
| CTNNA3 | 183230 | 494580 | 5052 | 477144 | 26924 |
| CTNNA3 | 183230 | 330298 | 5053 | 330570 | 26925 |
| CTNNA3 | 183230 | 545309 | 5054 | 441444 | 26926 |
| CTSL | 135047 | 343150 | 5055 | 345344 | 26927 |
| CTSL | 135047 | 340342 | 5056 | 365061 | 26928 |
| CTSL | 135047 | 375894 | 5057 | N/A | |
| CTSL | 135047 | 495822 | 5058 | N/A | |
| CTSL | 135047 | 342020 | 5059 | 340470 | 26929 |
| CTSL | 135047 | 482054 | 5060 | N/A | |
| CTSS | 163131 | 368985 | 5061 | 357981 | 26930 |
| CTSS | 163131 | 472977 | 5062 | 475176 | 26931 |
| CTSS | 163131 | 607427 | 5063 | 475557 | 26932 |
| CTSS | 163131 | 448301 | 5064 | 408414 | 26933 |
| CTSS | 163131 | 483930 | 5065 | 475812 | 26934 |
| CTSS | 163131 | 480760 | 5066 | N/A | |
| CTTNBP2 | 077063 | 160373 | 5067 | 160373 | 26935 |
| CTTNBP2 | 077063 | 446636 | 5068 | 389576 | 26936 |
| CTTNBP2 | 077063 | 441556 | 5069 | 397678 | 26937 |
| CTTNBP2 | 077063 | 445366 | 5070 | 389491 | 26938 |
| CTTNBP2 | 077063 | 435233 | 5071 | 395925 | 26939 |

| Symbol | ENSG | ENST | SEQ ID | ENSP | SEQ ID |
|---|---|---|---|---|---|
| CTTNBP2 | 077063 | 482124 | 5072 | N/A | |
| CTTNBP2 | 077063 | 416239 | 5073 | 406142 | 26940 |
| CTTNBP2 | 077063 | 467088 | 5074 | N/A | |
| CTTNBP2 | 077063 | 434890 | 5075 | 396014 | 26941 |
| CTTNBP2 | 077063 | 487820 | 5076 | N/A | |
| CTTNBP2 | 077063 | 454375 | 5077 | 405831 | 26942 |
| CTTNBP2 | 077063 | 412853 | 5078 | 393373 | 26943 |
| CTXN1 | 178531 | 318978 | 5079 | 313226 | 26944 |
| CTXN3 | 205279 | 379445 | 5080 | 368758 | 26945 |
| CTXN3 | 205279 | 514851 | 5081 | N/A | |
| CTXN3 | 205279 | 395322 | 5082 | 378732 | 26946 |
| CTXN3 | 205279 | 620385 | 5083 | 482081 | 26947 |
| CUL7 | 044090 | 265348 | 5084 | 265348 | 26948 |
| CUL7 | 044090 | 478630 | 5085 | N/A | |
| CUL7 | 044090 | 535468 | 5086 | 438788 | 26949 |
| CX3CL1 | 006210 | 006053 | 5087 | 006053 | 26950 |
| CX3CL1 | 006210 | 563383 | 5088 | 456830 | 26951 |
| CX3CL1 | 006210 | 564948 | 5089 | 457996 | 26952 |
| CX3CL1 | 006210 | 565912 | 5090 | 464114 | 26953 |
| CX3CR1 | 168329 | 399220 | 5091 | 382166 | 26954 |
| CX3CR1 | 168329 | 435290 | 5092 | 394960 | 26955 |
| CX3CR1 | 168329 | 412814 | 5093 | 408835 | 26956 |
| CX3CR1 | 168329 | 541347 | 5094 | 439140 | 26957 |
| CX3CR1 | 168329 | 542107 | 5095 | 444928 | 26958 |
| CX3CR1 | 168329 | 358309 | 5096 | 351059 | 26959 |
| CXCL12 | 107562 | 374429 | 5097 | 363551 | 26960 |
| CXCL12 | 107562 | 395793 | 5098 | 379139 | 26961 |
| CXCL12 | 107562 | 374426 | 5099 | 363548 | 26962 |
| CXCL12 | 107562 | 343575 | 5100 | 339913 | 26963 |
| CXCL12 | 107562 | 395794 | 5101 | 379140 | 26964 |
| CXCL12 | 107562 | 496375 | 5102 | N/A | |
| CXCL12 | 107562 | 488591 | 5103 | N/A | |
| CXCL12 | 107562 | 395795 | 5104 | 379141 | 26965 |
| CXCL14 | 145824 | 512158 | 5105 | 423783 | 26966 |
| CXCL14 | 145824 | 337225 | 5106 | 337065 | 26967 |
| CXCL5 | 163735 | 296027 | 5107 | 296027 | 26968 |
| CXCR4 | 121966 | 409817 | 5108 | 386884 | 26969 |
| CXCR4 | 121966 | 241393 | 5109 | 241393 | 26970 |
| CXCR4 | 121966 | 466288 | 5110 | N/A | |
| CXorf36 | 147113 | 398000 | 5111 | 381086 | 26971 |
| CXorf36 | 147113 | 477281 | 5112 | N/A | |
| CXorf36 | 147113 | 377934 | 5113 | 367168 | 26972 |
| CXorf36 | 147113 | 492138 | 5114 | N/A | |
| CXXC4 | 168772 | 394767 | 5115 | 378248 | 26973 |
| CXXC4 | 168772 | 466963 | 5116 | N/A | |
| CXXC4 | 168772 | 515509 | 5117 | N/A | |
| CYB5A | 166347 | 340533 | 5118 | 341625 | 26974 |
| CYB5A | 166347 | 580678 | 5119 | N/A | |
| CYB5A | 166347 | 299438 | 5120 | 299438 | 26975 |
| CYB5A | 166347 | 494131 | 5121 | 436461 | 26976 |
| CYB5A | 166347 | 583418 | 5122 | N/A | |
| CYB5A | 166347 | 397914 | 5123 | 381011 | 26977 |
| CYB5A | 166347 | 579064 | 5124 | N/A | |
| CYCS | 172115 | 305786 | 5125 | 307786 | 26978 |
| CYCS | 172115 | 409409 | 5126 | 386270 | 26979 |
| CYCS | 172115 | 409764 | 5127 | 387279 | 26980 |
| CYCS | 172115 | 413447 | 5128 | 416479 | 26981 |
| CYFIP2 | 055163 | 616178 | 5129 | 479719 | 26982 |
| CYFIP2 | 055163 | 620254 | 5130 | 479968 | 26983 |
| CYFIP2 | 055163 | 522463 | 5131 | 428009 | 26984 |
| CYFIP2 | 055163 | 435847 | 5132 | 403793 | 26985 |
| CYFIP2 | 055163 | 522637 | 5133 | 428079 | 26986 |
| CYFIP2 | 055163 | 521420 | 5134 | 430904 | 26987 |
| CYFIP2 | 055163 | 622696 | 5135 | N/A | |
| CYFIP2 | 055163 | 617629 | 5136 | 480605 | 26988 |
| CYFIP2 | 055163 | 611075 | 5137 | 479376 | 26989 |
| CYFIP2 | 055163 | 611925 | 5138 | 478058 | 26990 |
| CYFIP2 | 055163 | 618329 | 5139 | 484819 | 26991 |
| CYFIP2 | 055163 | 518456 | 5140 | N/A | |
| CYFIP2 | 055163 | 621516 | 5141 | 479211 | 26992 |
| CYFIP2 | 055163 | 518511 | 5142 | N/A | |
| CYFIP2 | 055163 | 520942 | 5143 | N/A | |
| CYFIP2 | 055163 | 520960 | 5144 | 482739 | 26993 |
| CYFIP2 | 055163 | 518555 | 5145 | N/A | |
| CYFIP2 | 055163 | 520424 | 5146 | N/A | |
| CYFIP2 | 055163 | 522892 | 5147 | N/A | |

-continued

-continued

| Symbol | ENSG | ENST | SEQ ID | ENSP | SEQ ID |
|---|---|---|---|---|---|
| CYFIP2 | 055163 | 523383 | 5148 | N/A | |
| CYFIP2 | 055163 | 524058 | 5149 | N/A | |
| CYFIP2 | 055163 | 519663 | 5150 | N/A | |
| CYFIP2 | 055163 | 522884 | 5151 | N/A | |
| CYFIP2 | 055163 | 522775 | 5152 | N/A | |
| CYGB | 161544 | 293230 | 5153 | 293230 | 26994 |
| CYGB | 161544 | 586160 | 5154 | N/A | |
| CYGB | 161544 | 589342 | 5155 | 466448 | 26995 |
| CYGB | 161544 | 590175 | 5156 | 464817 | 26996 |
| CYGB | 161544 | 589145 | 5157 | 468559 | 26997 |
| CYP27A1 | 135929 | 494263 | 5158 | N/A | |
| CYP27A1 | 135929 | 258415 | 5159 | 258415 | 26998 |
| CYP27A1 | 135929 | 445971 | 5160 | 404945 | 26999 |
| CYP27A1 | 135929 | 466602 | 5161 | N/A | |
| CYP27A1 | 135929 | 411688 | 5162 | 392671 | 27000 |
| CYP2D6 | 100197 | 360124 | 5163 | 353241 | 27001 |
| CYP2D6 | 100197 | 360608 | 5164 | 353820 | 27002 |
| CYP2D6 | 100197 | 488442 | 5165 | N/A | |
| CYP2D6 | 100197 | 359033 | 5166 | 351927 | 27003 |
| CYP2D6 | 100197 | 389970 | 5167 | 374620 | 27004 |
| CYP2D6 | 275211 | 625976 | 5168 | 487214 | 27005 |
| CYP2D6 | 275211 | 615454 | 5169 | 479867 | 27006 |
| CYP2D6 | 275211 | 628592 | 5170 | N/A | |
| CYP2D6 | 275211 | 612990 | 5171 | 483677 | 27007 |
| CYP2D6 | 272532 | 607853 | 5172 | 476021 | 27008 |
| CYP2D6 | 272532 | 619390 | 5173 | 483245 | 27009 |
| CYP2D6 | 280905 | 630793 | 5174 | 487281 | 27010 |
| CYP2D6 | 280905 | 630716 | 5175 | 486094 | 27011 |
| CYP2D6 | 280905 | 625898 | 5176 | 487558 | 27012 |
| CYP2D6 | 280905 | 626412 | 5177 | N/A | |
| CYP2D6 | 280905 | 629640 | 5178 | 486619 | 27013 |
| CYP2D6 | 282966 | 635505 | 5179 | 488991 | 27014 |
| CYP2D6 | 282966 | 634240 | 5180 | 489231 | 27015 |
| CYP2D6 | 282966 | 635201 | 5181 | N/A | |
| CYP2D6 | 282966 | 634653 | 5182 | 489103 | 27016 |
| CYP2D6 | 282966 | 635028 | 5183 | 489144 | 27017 |
| CYP2D6 | 283284 | 636910 | 5184 | 490065 | 27018 |
| CYP2D6 | 283284 | 638004 | 5185 | 489906 | 27019 |
| CYP2D6 | 283284 | 636361 | 5186 | 489990 | 27020 |
| CYP2D6 | 283284 | 635910 | 5187 | N/A | |
| CYP2D6 | 283284 | 637987 | 5188 | 490398 | 27021 |
| CYP2J2 | 134716 | 371204 | 5189 | 360247 | 27022 |
| CYP2J2 | 134716 | 492633 | 5190 | N/A | |
| CYP2J2 | 134716 | 466095 | 5191 | N/A | |
| CYP2J2 | 134716 | 469406 | 5192 | N/A | |
| CYP2J2 | 134716 | 468257 | 5193 | N/A | |
| CYP7B1 | 172817 | 523954 | 5194 | N/A | |
| CYP7B1 | 172817 | 310193 | 5195 | 310721 | 27023 |
| CYR61 | 142871 | 451137 | 5196 | 398736 | 27024 |
| CYR61 | 142871 | 480413 | 5197 | N/A | |
| CYSTM1 | 120306 | 261811 | 5198 | 261811 | 27025 |
| CYSTM1 | 120306 | 509589 | 5199 | N/A | |
| CYSTM1 | 120306 | 504227 | 5200 | N/A | |
| CYSTM1 | 120306 | 509789 | 5201 | N/A | |
| CYYR1 | 166265 | 299340 | 5202 | 299340 | 27026 |
| CYYR1 | 166265 | 400043 | 5203 | 382918 | 27027 |
| C21orf91 | 154642 | 284881 | 5204 | 284881 | 27028 |
| C21orf91 | 154642 | 400559 | 5205 | 383404 | 27029 |
| C21orf91 | 154642 | 400558 | 5206 | 383403 | 27030 |
| C21orf91 | 154642 | 405964 | 5207 | 385566 | 27031 |
| C21orf91 | 154642 | 493464 | 5208 | N/A | |
| C21orf91 | 154642 | 482915 | 5209 | N/A | |
| KIAA1549L | 110427 | 526400 | 5210 | 433481 | 27032 |
| KIAA1549L | 110427 | 321505 | 5211 | 315295 | 27033 |
| KIAA1549L | 110427 | 265654 | 5212 | 265654 | 27034 |
| KIAA1549L | 110427 | 526400 | 5213 | 433481 | 27035 |
| KIAA1549L | 110427 | 321505 | 5214 | 315295 | 27036 |
| KIAA1549L | 110427 | 265654 | 5215 | 265654 | 27037 |
| KIAA0556 | 047578 | 566023 | 5216 | N/A | |
| KIAA0556 | 047578 | 261588 | 5217 | 261588 | 27038 |
| KIAA0556 | 047578 | 568258 | 5218 | 454884 | 27039 |
| KIAA0556 | 047578 | 565672 | 5219 | 455380 | 27040 |
| KIAA0556 | 047578 | 618117 | 5220 | 483214 | 27041 |
| KIAA0556 | 047578 | 564749 | 5221 | N/A | |
| KIAA0556 | 047578 | 567894 | 5222 | N/A | |
| KIAA0556 | 047578 | 573850 | 5223 | N/A | |

| Symbol | ENSG | ENST | SEQ ID | ENSP | SEQ ID |
|---|---|---|---|---|---|
| KIAA0556 | 047578 | 562207 | 5224 | N/A | |
| KIAA0556 | 047578 | 568622 | 5225 | N/A | |
| C2orf80 | 188674 | 451342 | 5226 | 389385 | 27042 |
| C2orf80 | 188674 | 341287 | 5227 | 343171 | 27043 |
| C2orf80 | 188674 | 451346 | 5228 | 405393 | 27044 |
| C2orf80 | 188674 | 428015 | 5229 | 408378 | 27045 |
| C2orf80 | 188674 | 453017 | 5230 | 397144 | 27046 |
| C2orf80 | 188674 | 423952 | 5231 | 413016 | 27047 |
| C2orf80 | 188674 | 449053 | 5232 | 397281 | 27048 |
| C10orf90 | 154493 | 424927 | 5233 | 411609 | 27049 |
| C10orf90 | 154493 | 480379 | 5234 | 474753 | 27050 |
| C10orf90 | 154493 | 356858 | 5235 | 349318 | 27051 |
| C10orf90 | 154493 | 432642 | 5236 | 405995 | 27052 |
| C10orf90 | 154493 | 368674 | 5237 | N/A | |
| C10orf90 | 154493 | 488181 | 5238 | 474558 | 27053 |
| C10orf90 | 154493 | 463082 | 5239 | 474615 | 27054 |
| C10orf90 | 154493 | 284694 | 5240 | 284694 | 27055 |
| TMEM131L | 121210 | 409663 | 5241 | 386574 | 27056 |
| TMEM131L | 121210 | 445960 | 5242 | 413054 | 27057 |
| TMEM131L | 121210 | 409959 | 5243 | 386787 | 27058 |
| TMEM131L | 121210 | 462540 | 5244 | N/A | |
| TMEM131L | 121210 | 240487 | 5245 | 240487 | 27059 |
| TMEM131L | 121210 | 509565 | 5246 | N/A | |
| TMEM131L | 121210 | 497247 | 5247 | N/A | |
| TMEM131L | 121210 | 478919 | 5248 | N/A | |
| DAB1 | 173406 | 371236 | 5249 | 360280 | 27060 |
| DAB1 | 173406 | 485760 | 5250 | N/A | |
| DAB1 | 173406 | 371231 | 5251 | 360275 | 27061 |
| DAB1 | 173406 | 371232 | 5252 | 360276 | 27062 |
| DAB1 | 173406 | 332102 | 5253 | 329120 | 27063 |
| DAB1 | 173406 | 371230 | 5254 | 360274 | 27064 |
| DAB1 | 173406 | 489267 | 5255 | N/A | |
| DAB1 | 173406 | 473821 | 5256 | N/A | |
| DAB1 | 173406 | 477280 | 5257 | N/A | |
| DAB1 | 173406 | 414851 | 5258 | 387581 | 27065 |
| DAB1 | 173406 | 420954 | 5259 | 395296 | 27066 |
| DACH1 | 276644 | 613252 | 5260 | 482245 | 27067 |
| DACH1 | 276644 | 619232 | 5261 | 482797 | 27068 |
| DACH1 | 276644 | 611519 | 5262 | 482493 | 27069 |
| DACH1 | 276644 | 620444 | 5263 | 481551 | 27070 |
| DACT2 | 164488 | 366796 | 5264 | 355761 | 27071 |
| DACT2 | 164488 | 366795 | 5265 | 355760 | 27072 |
| DACT2 | 164488 | 610183 | 5266 | 476573 | 27073 |
| DACT2 | 164488 | 607983 | 5267 | 476434 | 27074 |
| DAGLA | 134780 | 257215 | 5268 | 257215 | 27075 |
| DAGLA | 134780 | 540717 | 5269 | 440264 | 27076 |
| DAO | 110887 | 548052 | 5270 | N/A | |
| DAO | 110887 | 551261 | 5271 | 446853 | 27077 |
| DAO | 110887 | 228476 | 5272 | 228476 | 27078 |
| DAO | 110887 | 547122 | 5273 | 448095 | 27079 |
| DAO | 110887 | 547768 | 5274 | 449967 | 27080 |
| DAO | 110887 | 549215 | 5275 | 449248 | 27081 |
| DAO | 110887 | 547166 | 5276 | 447104 | 27082 |
| DAO | 110887 | 546552 | 5277 | N/A | |
| DAPK1 | 196730 | 358077 | 5278 | 350785 | 27083 |
| DAPK1 | 196730 | 472284 | 5279 | 417076 | 27084 |
| DAPK1 | 196730 | 469067 | 5280 | N/A | |
| DAPK1 | 196730 | 495182 | 5281 | N/A | |
| DAPK1 | 196730 | 408954 | 5282 | 386135 | 27085 |
| DAPK1 | 196730 | 470267 | 5283 | N/A | |
| DAPK1 | 196730 | 496522 | 5284 | N/A | |
| DAPK1 | 196730 | 472344 | 5285 | N/A | |
| DAPK1 | 196730 | 491893 | 5286 | 419026 | 27086 |
| DAPK1 | 196730 | 489291 | 5287 | 417746 | 27087 |
| DAPK1 | 196730 | 463069 | 5288 | N/A | |
| DAPK1 | 196730 | 475804 | 5289 | N/A | |
| DAPK1 | 196730 | 495281 | 5290 | N/A | |
| DAPK1 | 196730 | 494010 | 5291 | N/A | |
| DAPK1 | 196730 | 466188 | 5292 | N/A | |
| DAPK1 | 196730 | 497743 | 5293 | N/A | |
| DAPK1 | 196730 | 468482 | 5294 | N/A | |
| DAPK1 | 196730 | 622514 | 5295 | 484267 | 27088 |
| DAPK1 | 196730 | 469640 | 5296 | 418885 | 27089 |
| DAPK2 | 035664 | 559007 | 5297 | 453639 | 27090 |
| DAPK2 | 035664 | 457488 | 5298 | 408277 | 27091 |
| DAPK2 | 035664 | 559731 | 5299 | N/A | |

-continued

-continued

| Symbol | ENSG | ENST | SEQ ID | ENSP | SEQ ID |
|---|---|---|---|---|---|
| DAPK2 | 035664 | 558064 | 5300 | 453101 | 27092 |
| DAPK2 | 035664 | 557867 | 5301 | N/A | |
| DAPK2 | 035664 | 612884 | 5302 | 484390 | 27093 |
| DAPK2 | 035664 | 558076 | 5303 | N/A | |
| DAPK2 | 035664 | 558482 | 5304 | N/A | |
| DAPK2 | 035664 | 559897 | 5305 | N/A | |
| DAPK2 | 035664 | 561162 | 5306 | 453284 | 27094 |
| DAPK2 | 035664 | 559306 | 5307 | 452970 | 27095 |
| DAPK2 | 035664 | 261891 | 5308 | 261891 | 27096 |
| DAPK2 | 035664 | 558069 | 5309 | 453235 | 27097 |
| SLC6A3 | 142319 | 270349 | 5310 | 270349 | 27098 |
| SLC6A3 | 142319 | 512002 | 5311 | N/A | |
| SLC6A3 | 142319 | 511750 | 5312 | N/A | |
| SLC6A3 | 276996 | 621716 | 5313 | 479597 | 27099 |
| SLC6A3 | 276996 | 626610 | 5314 | N/A | |
| SLC6A3 | 276996 | 630314 | 5315 | N/A | |
| DBH | 123454 | 393056 | 5316 | 376776 | 27100 |
| DBH | 123454 | 263611 | 5317 | 263611 | 27101 |
| DCBLD1 | 164465 | 528138 | 5318 | N/A | |
| DCBLD1 | 164465 | 525483 | 5319 | N/A | |
| DCBLD1 | 164465 | 533950 | 5320 | N/A | |
| DCBLD1 | 164465 | 528162 | 5321 | N/A | |
| DCBLD1 | 164465 | 296955 | 5322 | 296955 | 27102 |
| DCBLD1 | 164465 | 338728 | 5323 | 342422 | 27103 |
| DCBLD1 | 164465 | 533453 | 5324 | N/A | |
| DCBLD1 | 164465 | 481630 | 5325 | N/A | |
| DCBLD1 | 164465 | 424717 | 5326 | 391700 | 27104 |
| DCBLD1 | 164465 | 534777 | 5327 | N/A | |
| DCBLD1 | 164465 | 478345 | 5328 | N/A | |
| DCBLD1 | 164465 | 487076 | 5329 | N/A | |
| DCC | 187323 | 442544 | 5330 | 389140 | 27105 |
| DCC | 187323 | 578080 | 5331 | 463699 | 27106 |
| DCC | 187323 | 580024 | 5332 | N/A | |
| DCC | 187323 | 582875 | 5333 | 463131 | 27107 |
| DCC | 187323 | 304775 | 5334 | 304146 | 27108 |
| DCC | 187323 | 579349 | 5335 | 464277 | 27109 |
| DCC | 187323 | 581559 | 5336 | 463463 | 27110 |
| DCC | 187323 | 579666 | 5337 | N/A | |
| DCC | 187323 | 582595 | 5338 | N/A | |
| DCC | 187323 | 584710 | 5339 | N/A | |
| DCC | 187323 | 579883 | 5340 | N/A | |
| DCC | 187323 | 581580 | 5341 | 464582 | 27111 |
| DCC | 187323 | 578949 | 5342 | 463766 | 27112 |
| DCC | 187323 | 580146 | 5343 | N/A | |
| DCC | 187323 | 579941 | 5344 | 464292 | 27113 |
| DCC | 187323 | 579702 | 5345 | N/A | |
| DCC | 187323 | 577224 | 5346 | N/A | |
| DCC | 187323 | 412726 | 5347 | 397322 | 27114 |
| DCLK1 | 133083 | 360631 | 5348 | 353846 | 27115 |
| DCLK1 | 133083 | 379893 | 5349 | 369223 | 27116 |
| DCLK1 | 133083 | 255448 | 5350 | 255448 | 27117 |
| DCLK1 | 133083 | 477664 | 5351 | N/A | |
| DCLK1 | 133083 | 486239 | 5352 | N/A | |
| DCLK1 | 133083 | 460982 | 5353 | N/A | |
| DCLK1 | 133083 | 379892 | 5354 | 369222 | 27118 |
| DCLK1 | 133083 | 615680 | 5355 | 484452 | 27119 |
| DCUN1D3 | 188215 | 324344 | 5356 | 319482 | 27120 |
| DCUN1D3 | 188215 | 563934 | 5357 | 454762 | 27121 |
| DCX | 077279 | 635795 | 5358 | 489635 | 27122 |
| DCX | 077279 | 636035 | 5359 | 490614 | 27123 |
| DCX | 077279 | 358070 | 5360 | 350776 | 27124 |
| DCX | 077279 | 637570 | 5361 | 490878 | 27125 |
| DCX | 077279 | 356220 | 5362 | 348553 | 27126 |
| DCX | 077279 | 488120 | 5363 | 419861 | 27127 |
| DCX | 077279 | 637453 | 5364 | 490357 | 27128 |
| DCX | 077279 | 496551 | 5365 | 490448 | 27129 |
| DCX | 077279 | 636381 | 5366 | 490068 | 27130 |
| DCX | 077279 | 468911 | 5367 | 418811 | 27131 |
| DCX | 077279 | 371993 | 5368 | 361061 | 27132 |
| DDHD1 | 100523 | 395606 | 5369 | 378970 | 27133 |
| DDHD1 | 100523 | 323669 | 5370 | 327104 | 27134 |
| DDHD1 | 100523 | 357758 | 5371 | 350401 | 27135 |
| DDHD1 | 100523 | 556027 | 5372 | N/A | |
| DDHD1 | 100523 | 555621 | 5373 | N/A | |
| DDHD1 | 100523 | 555400 | 5374 | N/A | |
| DDHD1 | 100523 | 553406 | 5375 | N/A | |

| Symbol | ENSG | ENST | SEQ ID | ENSP | SEQ ID |
|---|---|---|---|---|---|
| DDHD1 | 100523 | 556910 | 5376 | 450785 | 27136 |
| DDHD1 | 100523 | 557445 | 5377 | N/A | |
| DDHD1 | 100523 | 612692 | 5378 | 483405 | 27137 |
| DDIT3 | 175197 | 547303 | 5379 | 447188 | 27138 |
| DDIT3 | 175197 | 551116 | 5380 | 448665 | 27139 |
| DDIT3 | 175197 | 623876 | 5381 | N/A | |
| DDIT3 | 175197 | 346473 | 5382 | 340671 | 27140 |
| DDIT3 | 175197 | 552740 | 5383 | 447803 | 27141 |
| DDIT3 | 175197 | 547526 | 5384 | 447503 | 27142 |
| DDIT4 | 168209 | 307365 | 5385 | 307305 | 27143 |
| DDIT4 | 168209 | 473155 | 5386 | N/A | |
| DDIT4 | 168209 | 471240 | 5387 | N/A | |
| DDIT4L | 145358 | 273990 | 5388 | 354830 | 27144 |
| DDIT4L | 145358 | 502763 | 5389 | 427301 | 27145 |
| DDIT4L | 145358 | 513992 | 5390 | 427040 | 27146 |
| DDN | 181418 | 421952 | 5391 | 390590 | 27147 |
| DDO | 203797 | 368924 | 5392 | 357920 | 27148 |
| DDO | 203797 | 368923 | 5393 | 357919 | 27149 |
| DDO | 203797 | 479373 | 5394 | 436642 | 27150 |
| DDR2 | 162733 | 446985 | 5395 | 400309 | 27151 |
| DDR2 | 162733 | 415555 | 5396 | 391310 | 27152 |
| DDR2 | 162733 | 367922 | 5397 | 356899 | 27153 |
| DDR2 | 162733 | 367921 | 5398 | 356898 | 27154 |
| DDR2 | 162733 | 458105 | 5399 | 417030 | 27155 |
| DDR2 | 162733 | 433757 | 5400 | 396864 | 27156 |
| DDX3Y | 067048 | 360160 | 5401 | 353284 | 27157 |
| DDX3Y | 067048 | 454054 | 5402 | 398953 | 27158 |
| DDX3Y | 067048 | 336079 | 5403 | 336725 | 27159 |
| DDX3Y | 067048 | 493363 | 5404 | N/A | |
| DDX3Y | 067048 | 440554 | 5405 | 400377 | 27160 |
| DDX3Y | 067048 | 469101 | 5406 | N/A | |
| DDX3Y | 067048 | 472510 | 5407 | N/A | |
| DDX3Y | 067048 | 463199 | 5408 | N/A | |
| DDX3Y | 067048 | 495478 | 5409 | N/A | |
| DDX49 | 105671 | 247003 | 5410 | 247003 | 27161 |
| DDX49 | 105671 | 599981 | 5411 | N/A | |
| DDX49 | 105671 | 599373 | 5412 | N/A | |
| DDX49 | 105671 | 594021 | 5413 | 470440 | 27162 |
| DDX49 | 105671 | 595858 | 5414 | 471292 | 27163 |
| DDX49 | 105671 | 593361 | 5415 | 472289 | 27164 |
| DDX49 | 105671 | 598972 | 5416 | 472084 | 27165 |
| DDX49 | 105671 | 602113 | 5417 | 469086 | 27166 |
| DDX49 | 105671 | 601803 | 5418 | N/A | |
| DDX49 | 105671 | 599156 | 5419 | N/A | |
| DDX49 | 105671 | 601772 | 5420 | N/A | |
| DDX49 | 105671 | 598277 | 5421 | N/A | |
| DDX49 | 105671 | 596502 | 5422 | N/A | |
| DDX49 | 105671 | 629999 | 5423 | 487048 | 27167 |
| DEDD2 | 160570 | 336034 | 5424 | 336972 | 27168 |
| DEDD2 | 160570 | 595337 | 5425 | 470082 | 27169 |
| DEDD2 | 160570 | 593804 | 5426 | N/A | |
| DEDD2 | 160570 | 596251 | 5427 | 471512 | 27170 |
| DEDD2 | 160570 | 601135 | 5428 | N/A | |
| DEDD2 | 160570 | 598415 | 5429 | N/A | |
| DEDD2 | 160570 | 602075 | 5430 | N/A | |
| DEDD2 | 160570 | 600559 | 5431 | N/A | |
| DEDD2 | 160570 | 598090 | 5432 | N/A | |
| DEDD2 | 160570 | 598727 | 5433 | 469233 | 27171 |
| DEDD2 | 160570 | 593561 | 5434 | N/A | |
| DEDD2 | 160570 | 602201 | 5435 | N/A | |
| DEDD2 | 160570 | 598200 | 5436 | 469898 | 27172 |
| DEPDC1B | 035499 | 265036 | 5437 | 265036 | 27173 |
| DEPDC1B | 035499 | 453022 | 5438 | 389101 | 27174 |
| DEPDC1B | 035499 | 512078 | 5439 | 427527 | 27175 |
| DEPDC1B | 035499 | 509006 | 5440 | N/A | |
| DEPDC1B | 035499 | 505017 | 5441 | N/A | |
| DEPDC1B | 035499 | 512452 | 5442 | 426979 | 27176 |
| DEPDC7 | 121690 | 241051 | 5443 | 241051 | 27177 |
| DEPDC7 | 121690 | 427755 | 5444 | N/A | |
| DEPDC7 | 121690 | 532078 | 5445 | N/A | |
| DEPDC7 | 121690 | 311388 | 5446 | 308971 | 27178 |
| DES | 175084 | 373960 | 5447 | 363071 | 27179 |
| DES | 175084 | 477226 | 5448 | N/A | |
| DES | 175084 | 492726 | 5449 | N/A | |
| DES | 175084 | 483395 | 5450 | N/A | |
| GSDME | 105928 | 342947 | 5451 | 339587 | 27180 |

-continued

| Symbol | ENSG | ENST | SEQ ID | ENSP | SEQ ID |
|---|---|---|---|---|---|
| GSDME | 105928 | 479636 | 5452 | N/A | |
| GSDME | 105928 | 409970 | 5453 | 387119 | 27181 |
| GSDME | 105928 | 409775 | 5454 | 386670 | 27182 |
| GSDME | 105928 | 430096 | 5455 | 395540 | 27183 |
| GSDME | 105928 | 415480 | 5456 | 389874 | 27184 |
| GSDME | 105928 | 446822 | 5457 | 398445 | 27185 |
| GSDME | 105928 | 469133 | 5458 | N/A | |
| GSDME | 105928 | 411476 | 5459 | 414090 | 27186 |
| GSDME | 105928 | 559637 | 5460 | N/A | |
| GSDME | 105928 | 493723 | 5461 | N/A | |
| GSDME | 105928 | 414428 | 5462 | 413963 | 27187 |
| GSDME | 105928 | 473990 | 5463 | N/A | |
| GSDME | 105928 | 419307 | 5464 | 401332 | 27188 |
| DGCR5 | 283406 | 440005 | 5465 | N/A | |
| DGCR5 | 237517 | 438934 | 5466 | N/A | |
| DGCR5 | 237517 | 421572 | 5467 | N/A | |
| DGCR5 | 237517 | 399539 | 5468 | N/A | |
| DGKA | 065357 | 546878 | 5469 | 446515 | 27189 |
| DGKA | 065357 | 546995 | 5470 | N/A | |
| DGKA | 065357 | 547015 | 5471 | 449178 | 27190 |
| DGKA | 065357 | 331886 | 5472 | 328405 | 27191 |
| DGKA | 065357 | 555090 | 5473 | 452353 | 27192 |
| DGKA | 065357 | 549629 | 5474 | 450977 | 27193 |
| DGKA | 065357 | 555218 | 5475 | 451743 | 27194 |
| DGKA | 065357 | 548479 | 5476 | N/A | |
| DGKA | 065357 | 547324 | 5477 | N/A | |
| DGKA | 065357 | 553084 | 5478 | 446605 | 27195 |
| DGKA | 065357 | 547358 | 5479 | N/A | |
| DGKA | 065357 | 548549 | 5480 | 448565 | 27196 |
| DGKA | 065357 | 549368 | 5481 | 447050 | 27197 |
| DGKA | 065357 | 548407 | 5482 | N/A | |
| DGKA | 065357 | 555025 | 5483 | 450608 | 27198 |
| DGKA | 065357 | 551615 | 5484 | N/A | |
| DGKA | 065357 | 547535 | 5485 | N/A | |
| DGKA | 065357 | 549323 | 5486 | N/A | |
| DGKA | 065357 | 549097 | 5487 | N/A | |
| DGKA | 065357 | 551156 | 5488 | 450359 | 27199 |
| DGKA | 065357 | 402956 | 5489 | 385792 | 27200 |
| DGKA | 065357 | 553783 | 5490 | 450999 | 27201 |
| DGKA | 065357 | 557080 | 5491 | 451814 | 27202 |
| DGKA | 065357 | 432422 | 5492 | 402307 | 27203 |
| DGKA | 065357 | 556001 | 5493 | 451266 | 27204 |
| DGKA | 065357 | 550115 | 5494 | N/A | |
| DGKA | 065357 | 548378 | 5495 | N/A | |
| DGKA | 065357 | 551296 | 5496 | N/A | |
| DGKA | 065357 | 551707 | 5497 | 447460 | 27205 |
| DGKA | 065357 | 552478 | 5498 | N/A | |
| DGKA | 065357 | 550888 | 5499 | 449923 | 27206 |
| DGKA | 065357 | 556344 | 5500 | N/A | |
| DGKA | 065357 | 549079 | 5501 | N/A | |
| DGKA | 065357 | 551739 | 5502 | N/A | |
| DGKA | 065357 | 549085 | 5503 | N/A | |
| DGKA | 065357 | 552687 | 5504 | N/A | |
| DGKA | 065357 | 546895 | 5505 | N/A | |
| DGKA | 065357 | 549986 | 5506 | N/A | |
| DGKA | 065357 | 552335 | 5507 | N/A | |
| DGKA | 065357 | 548047 | 5508 | N/A | |
| DGKA | 065357 | 554434 | 5509 | N/A | |
| DGKA | 065357 | 557180 | 5510 | 451330 | 27207 |
| DGKA | 065357 | 552652 | 5511 | N/A | |
| DGKA | 065357 | 550484 | 5512 | N/A | |
| DGKA | 065357 | 552903 | 5513 | 451518 | 27208 |
| DGKA | 065357 | 551585 | 5514 | N/A | |
| DGKA | 065357 | 550957 | 5515 | N/A | |
| DGKA | 065357 | 548491 | 5516 | N/A | |
| DGKA | 065357 | 394147 | 5517 | 377703 | 27209 |
| DGKB | 136267 | 403951 | 5518 | 385780 | 27210 |
| DGKB | 136267 | 402815 | 5519 | 384909 | 27211 |
| DGKB | 136267 | 407950 | 5520 | 385031 | 27212 |
| DGKB | 136267 | 493142 | 5521 | N/A | |
| DGKB | 136267 | 406247 | 5522 | 386066 | 27213 |
| DGKB | 136267 | 403963 | 5523 | N/A | |
| DGKB | 136267 | 471732 | 5524 | N/A | |
| DGKB | 136267 | 477401 | 5525 | N/A | |
| DGKB | 136267 | 464065 | 5526 | N/A | |
| DGKB | 136267 | 467449 | 5527 | N/A | |

-continued

| Symbol | ENSG | ENST | SEQ ID | ENSP | SEQ ID |
|---|---|---|---|---|---|
| DGKB | 136267 | 437998 | 5528 | 405569 | 27214 |
| DGKB | 136267 | 463981 | 5529 | N/A | |
| DGKB | 136267 | 399322 | 5530 | 382260 | 27215 |
| DGKH | 102780 | 337343 | 5531 | 337572 | 27216 |
| DGKH | 102780 | 261491 | 5532 | 261491 | 27217 |
| DGKH | 102780 | 611224 | 5533 | 482250 | 27218 |
| DGKH | 102780 | 628433 | 5534 | 485809 | 27219 |
| DGKH | 102780 | 627777 | 5535 | 486838 | 27220 |
| DGKH | 102780 | 626247 | 5536 | 486329 | 27221 |
| DGKH | 102780 | 536612 | 5537 | 445114 | 27222 |
| DGKH | 102780 | 498255 | 5538 | N/A | |
| DGKH | 102780 | 489851 | 5539 | N/A | |
| DGKH | 102780 | 379274 | 5540 | 368576 | 27223 |
| DGKI | 157680 | 453654 | 5541 | 392161 | 27224 |
| DGKI | 157680 | 494390 | 5542 | N/A | |
| DGKI | 157680 | 288490 | 5543 | 288490 | 27225 |
| DGKI | 157680 | 446122 | 5544 | 399131 | 27226 |
| DGKI | 157680 | 424189 | 5545 | 396078 | 27227 |
| DGKI | 157680 | 477835 | 5546 | N/A | |
| DGKI | 157680 | 486153 | 5547 | N/A | |
| DGKI | 157680 | 497321 | 5548 | N/A | |
| DGKI | 157680 | 460662 | 5549 | N/A | |
| DGKI | 157680 | 470895 | 5550 | N/A | |
| DGKI | 157680 | 483619 | 5551 | N/A | |
| DGKI | 157680 | 475388 | 5552 | N/A | |
| DGKI | 157680 | 614521 | 5553 | 479053 | 27228 |
| DHDDS | 117682 | 434391 | 5554 | 403529 | 27229 |
| DHDDS | 117682 | 427245 | 5555 | 399177 | 27230 |
| DHDDS | 117682 | 527611 | 5556 | N/A | |
| DHDDS | 117682 | 374186 | 5557 | N/A | |
| DHDDS | 117682 | 525682 | 5558 | 434984 | 27231 |
| DHDDS | 117682 | 236342 | 5559 | 236342 | 27232 |
| DHDDS | 117682 | 526219 | 5560 | 434219 | 27233 |
| DHDDS | 117682 | 374185 | 5561 | 363300 | 27234 |
| DHDDS | 117682 | 487944 | 5562 | N/A | |
| DHDDS | 117682 | 360009 | 5563 | 353104 | 27235 |
| DHDDS | 117682 | 533087 | 5564 | 436119 | 27236 |
| DHDDS | 117682 | 531312 | 5565 | 436764 | 27237 |
| DHDDS | 117682 | 525165 | 5566 | 434185 | 27238 |
| DHDDS | 117682 | 525326 | 5567 | 431407 | 27239 |
| DHDDS | 117682 | 525546 | 5568 | 433976 | 27240 |
| DHDDS | 117682 | 528557 | 5569 | N/A | |
| DHDDS | 117682 | 526278 | 5570 | N/A | |
| DHDDS | 117682 | 436153 | 5571 | 405604 | 27241 |
| DHDDS | 117682 | 529688 | 5572 | N/A | |
| DHDDS | 117682 | 530781 | 5573 | 433491 | 27242 |
| DHDDS | 117682 | 531955 | 5574 | N/A | |
| DHDDS | 117682 | 525410 | 5575 | N/A | |
| DHDDS | 117682 | 430232 | 5576 | 397584 | 27243 |
| DHDDS | 117682 | 431933 | 5577 | 399781 | 27244 |
| DHDDS | 117682 | 416052 | 5578 | 393961 | 27245 |
| DHFR | 228716 | 439211 | 5579 | 396308 | 27246 |
| DHFR | 228716 | 505337 | 5580 | 426474 | 27247 |
| DHFR | 228716 | 511032 | 5581 | 422732 | 27248 |
| DHFR | 228716 | 504396 | 5582 | 421334 | 27249 |
| DHFR | 228716 | 513048 | 5583 | N/A | |
| DHFR | 228716 | 508282 | 5584 | N/A | |
| DHFR | 228716 | 513314 | 5585 | N/A | |
| DIRAS2 | 165023 | 375765 | 5586 | 364919 | 27250 |
| DIRAS2 | 165023 | 636786 | 5587 | 490457 | 27251 |
| DIRAS2 | 165023 | 637905 | 5588 | 490853 | 27252 |
| DISP2 | 140323 | 267889 | 5589 | 267889 | 27253 |
| DISP2 | 140323 | 559721 | 5590 | N/A | |
| DISP2 | 140323 | 558623 | 5591 | N/A | |
| DISP2 | 140323 | 561261 | 5592 | N/A | |
| DISP3 | 204624 | 423056 | 5593 | N/A | |
| DISP3 | 204624 | 294484 | 5594 | 294484 | 27254 |
| DISP3 | 204624 | 304391 | 5595 | 303400 | 27255 |
| DIXDC1 | 150764 | 529225 | 5596 | 434130 | 27256 |
| DIXDC1 | 150764 | 440160 | 5597 | 394352 | 27257 |
| DIXDC1 | 150764 | 528399 | 5598 | N/A | |
| DIXDC1 | 150764 | 614104 | 5599 | 479434 | 27258 |
| DIXDC1 | 150764 | 615255 | 5600 | 480808 | 27259 |
| DIXDC1 | 150764 | 618522 | 5601 | N/A | |
| DIXDC1 | 150764 | 526500 | 5602 | N/A | |
| DIXDC1 | 150764 | 530645 | 5603 | N/A | |

| Symbol | ENSG | ENST | SEQ ID | ENSP | SEQ ID |
|---|---|---|---|---|---|
| DIXDC1 | 150764 | 526418 | 5604 | N/A | |
| DKK4 | 104371 | 220812 | 5605 | 220812 | 27260 |
| DLC1 | 164741 | 276297 | 5606 | 276297 | 27261 |
| DLC1 | 164741 | 358919 | 5607 | 351797 | 27262 |
| DLC1 | 164741 | 510318 | 5608 | N/A | |
| DLC1 | 164741 | 512044 | 5609 | 422595 | 27263 |
| DLC1 | 164741 | 520226 | 5610 | 428028 | 27264 |
| DLC1 | 164741 | 521730 | 5611 | N/A | |
| DLC1 | 164741 | 513883 | 5612 | N/A | |
| DLC1 | 164741 | 510250 | 5613 | N/A | |
| DLC1 | 164741 | 509922 | 5614 | N/A | |
| DLC1 | 164741 | 503161 | 5615 | 429537 | 27265 |
| DLC1 | 164741 | 515225 | 5616 | N/A | |
| DLC1 | 164741 | 506171 | 5617 | N/A | |
| DLC1 | 164741 | 316609 | 5618 | 321034 | 27266 |
| DLC1 | 164741 | 511869 | 5619 | 425878 | 27267 |
| DLC1 | 164741 | 517868 | 5620 | 473289 | 27268 |
| DLC1 | 164741 | 631382 | 5621 | 488100 | 27269 |
| DLC1 | 164741 | 517333 | 5622 | N/A | |
| DLC1 | 164741 | 529018 | 5623 | N/A | |
| DLG1 | 075711 | 346964 | 5624 | 345731 | 27270 |
| DLG1 | 075711 | 469371 | 5625 | N/A | |
| DLG1 | 075711 | 419354 | 5626 | 407531 | 27271 |
| DLG1 | 075711 | 452595 | 5627 | 398939 | 27272 |
| DLG1 | 075711 | 422288 | 5628 | 413238 | 27273 |
| DLG1 | 075711 | 448528 | 5629 | 391732 | 27274 |
| DLG1 | 075711 | 443183 | 5630 | 396658 | 27275 |
| DLG1 | 075711 | 450955 | 5631 | 411278 | 27276 |
| DLG1 | 075711 | 392382 | 5632 | 376187 | 27277 |
| DLG1 | 075711 | 475394 | 5633 | N/A | |
| DLG1 | 075711 | 470629 | 5634 | N/A | |
| DLG1 | 075711 | 419227 | 5635 | 396768 | 27278 |
| DLG1 | 075711 | 392381 | 5636 | 376186 | 27279 |
| DLG1 | 075711 | 471733 | 5637 | N/A | |
| DLG1 | 075711 | 493937 | 5638 | N/A | |
| DLG1 | 075711 | 447466 | 5639 | 398702 | 27280 |
| DLG1 | 075711 | 477312 | 5640 | N/A | |
| DLG1 | 075711 | 453607 | 5641 | 412579 | 27281 |
| DLG1 | 075711 | 456699 | 5642 | 396474 | 27282 |
| DLG1 | 075711 | 392380 | 5643 | 376185 | 27283 |
| DLG1 | 075711 | 485409 | 5644 | N/A | |
| DLG1 | 075711 | 419553 | 5645 | 414189 | 27284 |
| DLG1 | 075711 | 469073 | 5646 | N/A | |
| DLG1 | 075711 | 436682 | 5647 | 393771 | 27285 |
| DLG1 | 075711 | 486877 | 5648 | N/A | |
| DLG1 | 075711 | 412364 | 5649 | 390403 | 27286 |
| DLG1 | 075711 | 434148 | 5650 | 400169 | 27287 |
| DLG1 | 075711 | 357674 | 5651 | 350303 | 27288 |
| DLG4 | 132535 | 489885 | 5652 | N/A | |
| DLG4 | 132535 | 399506 | 5653 | 382425 | 27289 |
| DLG4 | 132535 | 302955 | 5654 | 307471 | 27290 |
| DLG4 | 132535 | 399510 | 5655 | 382428 | 27291 |
| DLG4 | 132535 | 491753 | 5656 | 467897 | 27292 |
| DLG4 | 132535 | 485100 | 5657 | 460625 | 27293 |
| DLG4 | 132535 | 451807 | 5658 | 407918 | 27294 |
| DLG4 | 132535 | 447163 | 5659 | 388122 | 27295 |
| DLG4 | 132535 | 486626 | 5660 | 465720 | 27296 |
| DLG4 | 132535 | 493294 | 5661 | 465789 | 27297 |
| DLGAP2 | 274161 | 620101 | 5662 | 478085 | 27298 |
| DLGAP2 | 274161 | 633183 | 5663 | 488195 | 27299 |
| DLGAP2 | 274161 | 632909 | 5664 | N/A | |
| DLGAP2 | 274161 | 633560 | 5665 | N/A | |
| DLGAP2 | 274161 | 632284 | 5666 | N/A | |
| DLGAP2 | 274161 | 633014 | 5667 | N/A | |
| DLGAP2 | 274161 | 620226 | 5668 | 483427 | 27300 |
| DLGAP2 | 282318 | 633645 | 5669 | 488273 | 27301 |
| DLGAP2 | 282318 | 633447 | 5670 | 488705 | 27302 |
| DLGAP2 | 282318 | 631606 | 5671 | N/A | |
| DLGAP2 | 282318 | 633079 | 5672 | 487701 | 27303 |
| DLGAP2 | 282318 | 631949 | 5673 | N/A | |
| DLGAP2 | 282318 | 632589 | 5674 | 488020 | 27304 |
| DLGAP2 | 282152 | 633655 | 5675 | 487728 | 27305 |
| DLGAP2 | 282152 | 633162 | 5676 | 488908 | 27306 |
| DLGAP2 | 282103 | 632928 | 5677 | N/A | |
| DLGAP2 | 282103 | 633950 | 5678 | N/A | |
| DLGAP2 | 282103 | 633407 | 5679 | N/A | |

| Symbol | ENSG | ENST | SEQ ID | ENSP | SEQ ID |
|---|---|---|---|---|---|
| DLGAP2 | 198010 | 637795 | 5680 | 489774 | 27307 |
| DLGAP2 | 198010 | 522092 | 5681 | N/A | |
| DLGAP2 | 198010 | 520816 | 5682 | N/A | |
| DLGAP2 | 198010 | 577187 | 5683 | N/A | |
| DLGAP2 | 198010 | 421627 | 5684 | 400258 | 27308 |
| DLGAP2 | 198010 | 524139 | 5685 | N/A | |
| DLGAP2 | 198010 | 578889 | 5686 | N/A | |
| DLGAP2 | 198010 | 520524 | 5687 | N/A | |
| DLGAP2 | 198010 | 522989 | 5688 | N/A | |
| DLGAP2 | 198010 | 522626 | 5689 | N/A | |
| DLGAP2 | 198010 | 520901 | 5690 | 430563 | 27309 |
| DLGAP2 | 198010 | 522499 | 5691 | 488645 | 27310 |
| DLGAP2 | 198010 | 524065 | 5692 | N/A | |
| DLGAP2 | 198010 | 518530 | 5693 | 488445 | 27311 |
| DLGAP2 | 198010 | 612087 | 5694 | 484215 | 27312 |
| DLGAP4 | 080845 | 373913 | 5695 | 363023 | 27313 |
| DLGAP4 | 080845 | 373907 | 5696 | 363014 | 27314 |
| DLGAP4 | 080845 | 475894 | 5697 | 477723 | 27315 |
| DLGAP4 | 080845 | 482872 | 5698 | 480166 | 27316 |
| DLGAP4 | 080845 | 495241 | 5699 | 484696 | 27317 |
| DLGAP4 | 080845 | 491207 | 5700 | N/A | |
| DLGAP4 | 080845 | 482037 | 5701 | N/A | |
| DLGAP4 | 080845 | 340491 | 5702 | 345700 | 27318 |
| DLGAP4 | 080845 | 479220 | 5703 | N/A | |
| DLGAP4 | 080845 | 489701 | 5704 | 419311 | 27319 |
| DLGAP4 | 080845 | 479951 | 5705 | N/A | |
| DLGAP4 | 080845 | 478910 | 5706 | N/A | |
| DLGAP4 | 080845 | 497862 | 5707 | N/A | |
| DLGAP4 | 080845 | 477195 | 5708 | N/A | |
| DLGAP4 | 080845 | 401952 | 5709 | 384954 | 27320 |
| DLGAP4 | 080845 | 339266 | 5710 | 341633 | 27321 |
| DMD | 198947 | 481143 | 5711 | N/A | |
| DMD | 198947 | 378723 | 5712 | 367997 | 27322 |
| DMD | 198947 | 358062 | 5713 | 350765 | 27323 |
| DMD | 198947 | 378677 | 5714 | 367948 | 27324 |
| DMD | 198947 | 357033 | 5715 | 354923 | 27325 |
| DMD | 198947 | 378702 | 5716 | 367974 | 27326 |
| DMD | 198947 | 474231 | 5717 | 417123 | 27327 |
| DMD | 198947 | 361471 | 5718 | 354464 | 27328 |
| DMD | 198947 | 378680 | 5719 | 367951 | 27329 |
| DMD | 198947 | 378705 | 5720 | 367977 | 27330 |
| DMD | 198947 | 475732 | 5721 | N/A | |
| DMD | 198947 | 469142 | 5722 | N/A | |
| DMD | 198947 | 634285 | 5723 | N/A | |
| DMD | 198947 | 634315 | 5724 | N/A | |
| DMD | 198947 | 445312 | 5725 | N/A | |
| DMD | 198947 | 471779 | 5726 | 417075 | 27331 |
| DMD | 198947 | 488902 | 5727 | N/A | |
| DMD | 198947 | 493412 | 5728 | 417725 | 27332 |
| DMD | 198947 | 420596 | 5729 | 399897 | 27333 |
| DMD | 198947 | 448370 | 5730 | 388559 | 27334 |
| DMD | 198947 | 288447 | 5731 | 288447 | 27335 |
| DMD | 198947 | 480751 | 5732 | N/A | |
| DMD | 198947 | 447523 | 5733 | 395904 | 27336 |
| DMD | 198947 | 472681 | 5734 | N/A | |
| DMD | 198947 | 472266 | 5735 | N/A | |
| DMD | 198947 | 463609 | 5736 | N/A | |
| DMD | 198947 | 378707 | 5737 | 367979 | 27337 |
| DMD | 198947 | 343523 | 5738 | 340057 | 27338 |
| DMD | 198947 | 541758 | 5739 | 444119 | 27339 |
| DMD | 198947 | 359836 | 5740 | 352894 | 27340 |
| DMD | 198947 | 619831 | 5741 | 479270 | 27341 |
| DMD | 198947 | 620010 | 5742 | 478150 | 27342 |
| DMGDH | 132837 | 255189 | 5743 | 255189 | 27343 |
| DMGDH | 132837 | 523732 | 5744 | 430972 | 27344 |
| DMGDH | 132837 | 518477 | 5745 | 427834 | 27345 |
| DMGDH | 132837 | 517853 | 5746 | 428995 | 27346 |
| DMGDH | 132837 | 523201 | 5747 | N/A | |
| DMGDH | 132837 | 521052 | 5748 | 430133 | 27347 |
| DMGDH | 132837 | 524206 | 5749 | 428092 | 27348 |
| DMGDH | 132837 | 520388 | 5750 | N/A | |
| DMGDH | 132837 | 518707 | 5751 | N/A | |
| DMGDH | 132837 | 520855 | 5752 | N/A | |
| DMP1 | 152592 | 339673 | 5753 | 340935 | 27349 |
| DMP1 | 152592 | 282479 | 5754 | 282479 | 27350 |
| DNAH5 | 039139 | 265104 | 5755 | 265104 | 27351 |

-continued

| Symbol | ENSG | ENST | SEQ ID | ENSP | SEQ ID |
|---|---|---|---|---|---|
| DNAH5 | 039139 | 501001 | 5756 | N/A | |
| DNAH5 | 039139 | 512443 | 5757 | N/A | |
| DNAH5 | 039139 | 508040 | 5758 | N/A | |
| DNAH6 | 115423 | 476689 | 5759 | N/A | |
| DNAH6 | 115423 | 468661 | 5760 | N/A | |
| DNAH6 | 115423 | 237449 | 5761 | 237449 | 27352 |
| DNAH6 | 115423 | 494025 | 5762 | N/A | |
| DNAH6 | 115423 | 602588 | 5763 | N/A | |
| DNAH6 | 115423 | 389394 | 5764 | 374045 | 27353 |
| DNAJA1 | 086061 | 330899 | 5765 | 369127 | 27354 |
| DNAJA1 | 086061 | 495015 | 5766 | N/A | |
| DNAJA1 | 086061 | 465677 | 5767 | N/A | |
| DNAJA4 | 140403 | 394855 | 5768 | 378324 | 27355 |
| DNAJA4 | 140403 | 489435 | 5769 | 438263 | 27356 |
| DNAJA4 | 140403 | 440911 | 5770 | 395191 | 27357 |
| DNAJA4 | 140403 | 423642 | 5771 | 407136 | 27358 |
| DNAJA4 | 140403 | 483802 | 5772 | 443962 | 27359 |
| DNAJA4 | 140403 | 343789 | 5773 | 339581 | 27360 |
| DNAJA4 | 140403 | 394852 | 5774 | 378321 | 27361 |
| DNAJA4 | 140403 | 542636 | 5775 | 441946 | 27362 |
| DNAJA4 | 140403 | 446172 | 5776 | 413499 | 27363 |
| DNAJA4 | 140403 | 485075 | 5777 | N/A | |
| DNAJA4 | 140403 | 493321 | 5778 | N/A | |
| DNAJA4 | 140403 | 480425 | 5779 | N/A | |
| DNAJB1 | 132002 | 254322 | 5780 | 254322 | 27364 |
| DNAJB1 | 132002 | 396969 | 5781 | 444212 | 27365 |
| DNAJB1 | 132002 | 598235 | 5782 | 471073 | 27366 |
| DNAJB1 | 132002 | 595139 | 5783 | 469221 | 27367 |
| DNAJB1 | 132002 | 596853 | 5784 | 470063 | 27368 |
| DNAJB1 | 132002 | 595992 | 5785 | 470596 | 27369 |
| DNAJB1 | 132002 | 594099 | 5786 | 470160 | 27370 |
| DNAJB1 | 132002 | 601533 | 5787 | 471798 | 27371 |
| DNAJB1 | 132002 | 598692 | 5788 | 472886 | 27372 |
| DNAJB1 | 132002 | 596075 | 5789 | 471603 | 27373 |
| DNAJB1 | 132002 | 601087 | 5790 | N/A | |
| DNAJB4 | 162616 | 487931 | 5791 | N/A | |
| DNAJB4 | 162616 | 477671 | 5792 | N/A | |
| DNAJB4 | 162616 | 484662 | 5793 | N/A | |
| DNAJB4 | 162616 | 426517 | 5794 | 399494 | 27374 |
| DNAJB4 | 162616 | 370763 | 5795 | 359799 | 27375 |
| DNAJB4 | 162616 | 476396 | 5796 | N/A | |
| DNAJB5 | 137094 | 541010 | 5797 | N/A | |
| DNAJB5 | 137094 | 454002 | 5798 | 413684 | 27376 |
| DNAJB5 | 137094 | 545841 | 5799 | 441999 | 27377 |
| DNAJB5 | 137094 | 539059 | 5800 | 445536 | 27378 |
| DNAJB5 | 137094 | 443266 | 5801 | 396332 | 27379 |
| DNAJB5 | 137094 | 537321 | 5802 | 439217 | 27380 |
| DNAJB5 | 137094 | 469798 | 5803 | 433640 | 27381 |
| DNAJB5 | 137094 | 458263 | 5804 | 393749 | 27382 |
| DNAJB5 | 137094 | 312316 | 5805 | 312517 | 27383 |
| DNAJB5 | 137094 | 453597 | 5806 | 404079 | 27384 |
| DNAJB6 | 105993 | 441561 | 5807 | 410643 | 27385 |
| DNAJB6 | 105993 | 429029 | 5808 | 397556 | 27386 |
| DNAJB6 | 105993 | 262177 | 5809 | 262177 | 27387 |
| DNAJB6 | 105993 | 486083 | 5810 | N/A | |
| DNAJB6 | 105993 | 417758 | 5811 | 400665 | 27388 |
| DNAJB6 | 105993 | 459889 | 5812 | 488263 | 27389 |
| DNAJB6 | 105993 | 488001 | 5813 | N/A | |
| DNAJB6 | 105993 | 443280 | 5814 | 396267 | 27390 |
| DNAJB6 | 105993 | 441291 | 5815 | 415201 | 27391 |
| DNAJB6 | 105993 | 437030 | 5816 | 391690 | 27392 |
| DNAJB6 | 105993 | 412557 | 5817 | 403407 | 27393 |
| DNAJB6 | 105993 | 453383 | 5818 | 396240 | 27394 |
| DNAJB6 | 105993 | 439402 | 5819 | 389599 | 27395 |
| DNAJB6 | 105993 | 634080 | 5820 | 488740 | 27396 |
| DNAJB6 | 105993 | 468928 | 5821 | N/A | |
| DNAJB6 | 105993 | 465908 | 5822 | N/A | |
| DNAJB6 | 105993 | 487480 | 5823 | N/A | |
| DNAJB6 | 105993 | 486247 | 5824 | N/A | |
| DNAJC27 | 115137 | 264711 | 5825 | 264711 | 27397 |
| DNAJC27 | 115137 | 380809 | 5826 | 370187 | 27398 |
| DNAJC27 | 115137 | 494239 | 5827 | N/A | |
| DNAJC27 | 115137 | 468467 | 5828 | N/A | |
| DNAJC27 | 115137 | 468750 | 5829 | N/A | |
| DNAJC27 | 115137 | 492985 | 5830 | N/A | |
| DNAJC27 | 115137 | 534855 | 5831 | 440086 | 27399 |

-continued

| Symbol | ENSG | ENST | SEQ ID | ENSP | SEQ ID |
|---|---|---|---|---|---|
| DNAJC7 | 168259 | 457167 | 5832 | 406463 | 27400 |
| DNAJC7 | 168259 | 587727 | 5833 | 467702 | 27401 |
| DNAJC7 | 168259 | 426588 | 5834 | 394327 | 27402 |
| DNAJC7 | 168259 | 588814 | 5835 | 466114 | 27403 |
| DNAJC7 | 168259 | 316603 | 5836 | 313311 | 27404 |
| DNAJC7 | 168259 | 585693 | 5837 | N/A | |
| DNAJC7 | 168259 | 586335 | 5838 | 464993 | 27405 |
| DNAJC7 | 168259 | 590197 | 5839 | N/A | |
| DNAJC7 | 168259 | 590847 | 5840 | N/A | |
| DNAJC7 | 168259 | 589810 | 5841 | 467477 | 27406 |
| DNAJC7 | 168259 | 588641 | 5842 | 468805 | 27407 |
| DNAJC7 | 168259 | 590348 | 5843 | 464756 | 27408 |
| DNAJC7 | 168259 | 591153 | 5844 | N/A | |
| DNAJC7 | 168259 | 589576 | 5845 | 468102 | 27409 |
| DNAJC7 | 168259 | 590774 | 5846 | 465340 | 27410 |
| DNAJC7 | 168259 | 589586 | 5847 | 466748 | 27411 |
| DNAJC7 | 168259 | 585866 | 5848 | 466877 | 27412 |
| DNAJC7 | 168259 | 589773 | 5849 | 465228 | 27413 |
| DNAJC7 | 168259 | 590886 | 5850 | 465399 | 27414 |
| DNAJC7 | 168259 | 591787 | 5851 | 465140 | 27415 |
| DNAJC7 | 168259 | 589547 | 5852 | N/A | |
| DNAJC7 | 168259 | 587380 | 5853 | N/A | |
| DNAJC7 | 168259 | 586240 | 5854 | N/A | |
| DNER | 187957 | 341772 | 5855 | 345229 | 27416 |
| DNER | 187957 | 482831 | 5856 | N/A | |
| DNMBP | 107554 | 543621 | 5857 | 443657 | 27417 |
| DNMBP | 107554 | 636706 | 5858 | 489875 | 27418 |
| DNMBP | 107554 | 324109 | 5859 | 315659 | 27419 |
| DNMBP | 107554 | 472036 | 5860 | N/A | |
| DOC2B | 272670 | 496357 | 5861 | 417238 | 27420 |
| DOC2B | 272670 | 633410 | 5862 | N/A | |
| DOC2B | 272670 | 633635 | 5863 | N/A | |
| DOC2B | 272636 | 613549 | 5864 | 482950 | 27421 |
| DOC2B | 272636 | 343572 | 5865 | N/A | |
| DOC2B | 272636 | 609727 | 5866 | N/A | |
| DOCK1 | 150760 | 280333 | 5867 | 280333 | 27422 |
| DOCK1 | 150760 | 623213 | 5868 | 485033 | 27423 |
| DOCK1 | 150760 | 473861 | 5869 | N/A | |
| DOCK1 | 150760 | 484400 | 5870 | N/A | |
| DOCK1 | 150760 | 495574 | 5871 | N/A | |
| DOCK1 | 150760 | 464466 | 5872 | N/A | |
| DOCK5 | 147459 | 410074 | 5873 | 387036 | 27424 |
| DOCK5 | 147459 | 481100 | 5874 | 429737 | 27425 |
| DOCK5 | 147459 | 276440 | 5875 | 276440 | 27426 |
| DOCK5 | 147459 | 495236 | 5876 | N/A | |
| DOCK5 | 147459 | 444569 | 5877 | 414125 | 27427 |
| DOCK5 | 147459 | 478099 | 5878 | N/A | |
| DOCK5 | 147459 | 487948 | 5879 | N/A | |
| DOCK5 | 147459 | 467709 | 5880 | 428479 | 27428 |
| DOCK5 | 147459 | 481728 | 5881 | N/A | |
| DOCK5 | 147459 | 463457 | 5882 | N/A | |
| DOCK5 | 147459 | 521405 | 5883 | N/A | |
| DOCK5 | 147459 | 479547 | 5884 | N/A | |
| DOCK6 | 130158 | 586702 | 5885 | N/A | |
| DOCK6 | 130158 | 294618 | 5886 | 294618 | 27429 |
| DOCK6 | 130158 | 587734 | 5887 | 468291 | 27430 |
| DOCK6 | 130158 | 587656 | 5888 | 468638 | 27431 |
| DOCK6 | 130158 | 588666 | 5889 | 467231 | 27432 |
| DOCK6 | 130158 | 592463 | 5890 | N/A | |
| DOCK6 | 130158 | 588429 | 5891 | N/A | |
| DOCK6 | 130158 | 592403 | 5892 | N/A | |
| DOCK6 | 130158 | 592550 | 5893 | N/A | |
| DOCK6 | 130158 | 590680 | 5894 | 467191 | 27433 |
| DOCK6 | 130158 | 590452 | 5895 | N/A | |
| DOCK6 | 130158 | 585904 | 5896 | 465767 | 27434 |
| DOCK6 | 130158 | 591750 | 5897 | N/A | |
| DOCK6 | 130158 | 585609 | 5898 | N/A | |
| DOCK6 | 130158 | 586482 | 5899 | N/A | |
| DOCK6 | 130158 | 587572 | 5900 | N/A | |
| DOCK7 | 116641 | 634495 | 5901 | N/A | |
| DOCK7 | 116641 | 251157 | 5902 | 251157 | 27435 |
| DOCK7 | 116641 | 454575 | 5903 | 413583 | 27436 |
| DOCK7 | 116641 | 635348 | 5904 | N/A | |
| DOCK7 | 116641 | 635983 | 5905 | N/A | |
| DOCK7 | 116641 | 340370 | 5906 | 340742 | 27437 |
| DOCK7 | 116641 | 637255 | 5907 | 490888 | 27438 |

| Symbol | ENSG | ENST | SEQ ID | ENSP | SEQ ID |
|---|---|---|---|---|---|
| DOCK7 | 116641 | 634264 | 5908 | 489284 | 27439 |
| DOCK7 | 116641 | 635123 | 5909 | 489499 | 27440 |
| DOCK7 | 116641 | 635253 | 5910 | 489124 | 27441 |
| DOCK7 | 116641 | 637306 | 5911 | N/A | |
| DOCK7 | 116641 | 489185 | 5912 | N/A | |
| DOCK7 | 116641 | 467758 | 5913 | N/A | |
| DOCK7 | 116641 | 637487 | 5914 | N/A | |
| DOCK7 | 116641 | 635088 | 5915 | 489412 | 27442 |
| DOCK7 | 116641 | 637839 | 5916 | N/A | |
| DOCK7 | 116641 | 638042 | 5917 | N/A | |
| DOCK7 | 116641 | 636370 | 5918 | N/A | |
| DOCK7 | 116641 | 636746 | 5919 | N/A | |
| DOCK7 | 116641 | 637735 | 5920 | N/A | |
| DOCK7 | 116641 | 637208 | 5921 | 490079 | 27443 |
| DOCK7 | 116641 | 479983 | 5922 | N/A | |
| DOCK7 | 116641 | 637144 | 5923 | N/A | |
| DOCK7 | 116641 | 635286 | 5924 | N/A | |
| DOCK7 | 116641 | 634929 | 5925 | 489037 | 27444 |
| DOCK7 | 116641 | 634652 | 5926 | 489450 | 27445 |
| DOCK7 | 116641 | 635027 | 5927 | N/A | |
| DOCK7 | 116641 | 637431 | 5928 | N/A | |
| DOCK7 | 116641 | 634223 | 5929 | 488988 | 27446 |
| DOCK7 | 116641 | 404627 | 5930 | 384446 | 27447 |
| DOCK7 | 116641 | 614472 | 5931 | 483062 | 27448 |
| DOCK7 | 116641 | 637227 | 5932 | N/A | |
| DOCK7 | 116641 | 464312 | 5933 | 489164 | 27449 |
| DOCK7 | 116641 | 635827 | 5934 | 490677 | 27450 |
| DOCK7 | 116641 | 634912 | 5935 | N/A | |
| DOCK7 | 116641 | 636167 | 5936 | N/A | |
| DOCK7 | 116641 | 636635 | 5937 | N/A | |
| DOCK8 | 107099 | 469197 | 5938 | 418587 | 27451 |
| DOCK8 | 107099 | 524396 | 5939 | 436628 | 27452 |
| DOCK8 | 107099 | 432829 | 5940 | 394888 | 27453 |
| DOCK8 | 107099 | 454469 | 5941 | N/A | |
| DOCK8 | 107099 | 479404 | 5942 | 417082 | 27454 |
| DOCK8 | 107099 | 487230 | 5943 | 418318 | 27455 |
| DOCK8 | 107099 | 382341 | 5944 | N/A | |
| DOCK8 | 107099 | 483757 | 5945 | 417691 | 27456 |
| DOCK8 | 107099 | 478380 | 5946 | N/A | |
| DOCK8 | 107099 | 469391 | 5947 | 419438 | 27457 |
| DOCK8 | 107099 | 495184 | 5948 | N/A | |
| DOCK8 | 107099 | 474772 | 5949 | N/A | |
| DOCK8 | 107099 | 382331 | 5950 | 371768 | 27458 |
| DOCK8 | 107099 | 382329 | 5951 | 371766 | 27459 |
| DOCK8 | 107099 | 493666 | 5952 | N/A | |
| DOCK8 | 107099 | 462618 | 5953 | N/A | |
| DOCK8 | 107099 | 453981 | 5954 | 408464 | 27460 |
| DOK6 | 206052 | 382713 | 5955 | 372160 | 27461 |
| DOK6 | 206052 | 582172 | 5956 | N/A | |
| DOK6 | 206052 | 584435 | 5957 | N/A | |
| DOK6 | 206052 | 582992 | 5958 | 462984 | 27462 |
| DOK6 | 206052 | 577609 | 5959 | N/A | |
| DOPEY2 | 142197 | 270190 | 5960 | 270190 | 27463 |
| DOPEY2 | 142197 | 399151 | 5961 | 382104 | 27464 |
| DOPEY2 | 142197 | 492760 | 5962 | N/A | |
| DOPEY2 | 142197 | 463668 | 5963 | N/A | |
| DPF3 | 205683 | 556509 | 5964 | 450518 | 27465 |
| DPF3 | 205683 | 557704 | 5965 | N/A | |
| DPF3 | 205683 | 366353 | 5966 | 381791 | 27466 |
| DPF3 | 205683 | 381216 | 5967 | 370614 | 27467 |
| DPF3 | 205683 | 546183 | 5968 | 444662 | 27468 |
| DPF3 | 205683 | 556891 | 5969 | N/A | |
| DPF3 | 205683 | 556997 | 5970 | N/A | |
| DPF3 | 205683 | 556238 | 5971 | N/A | |
| DPF3 | 205683 | 554594 | 5972 | N/A | |
| DPF3 | 205683 | 555781 | 5973 | N/A | |
| DPF3 | 205683 | 553608 | 5974 | N/A | |
| DPF3 | 205683 | 556902 | 5975 | N/A | |
| DPF3 | 205683 | 555469 | 5976 | N/A | |
| DPF3 | 205683 | 541685 | 5977 | 441640 | 27469 |
| DPF3 | 205683 | 610283 | 5978 | 479526 | 27470 |
| DPF3 | 205683 | 614862 | 5979 | 481992 | 27471 |
| DPP10 | 175497 | 436732 | 5980 | 391092 | 27472 |
| DPP10 | 175497 | 410059 | 5981 | 386565 | 27473 |
| DPP10 | 175497 | 461250 | 5982 | N/A | |
| DPP10 | 175497 | 409163 | 5983 | 387038 | 27474 |

| Symbol | ENSG | ENST | SEQ ID | ENSP | SEQ ID |
|---|---|---|---|---|---|
| DPP10 | 175497 | 492708 | 5984 | N/A | |
| DPP10 | 175497 | 393146 | 5985 | 376854 | 27475 |
| DPP10 | 175497 | 393147 | 5986 | 376855 | 27476 |
| DPP10 | 175497 | 310323 | 5987 | 309066 | 27477 |
| DPP10 | 175497 | 486885 | 5988 | N/A | |
| DPP10 | 175497 | 429914 | 5989 | 408535 | 27478 |
| DPP10 | 175497 | 419287 | 5990 | 402499 | 27479 |
| DPP10 | 175497 | 488208 | 5991 | N/A | |
| DPP10 | 175497 | 473362 | 5992 | N/A | |
| DPY19L1 | 173852 | 638088 | 5993 | 490722 | 27480 |
| DPY19L1 | 173852 | 310974 | 5994 | 308695 | 27481 |
| DPY19L1 | 173852 | 428054 | 5995 | 412745 | 27482 |
| DPY19L1 | 173852 | 446375 | 5996 | 400510 | 27483 |
| DPY19L1 | 173852 | 493989 | 5997 | N/A | |
| DPY19L1 | 173852 | 462134 | 5998 | N/A | |
| DPY19L1 | 173852 | 463538 | 5999 | N/A | |
| DPY19L1 | 173852 | 481923 | 6000 | N/A | |
| DPY19L1 | 173852 | 612226 | 6001 | 478865 | 27484 |
| DPY19L2 | 177990 | 324472 | 6002 | 315988 | 27485 |
| DPY19L2 | 177990 | 541911 | 6003 | N/A | |
| DPY19L2 | 177990 | 413230 | 6004 | N/A | |
| DPY19L2 | 177990 | 439061 | 6005 | 437474 | 27486 |
| DPY19L2 | 177990 | 306389 | 6006 | 445878 | 27487 |
| DPY19L2 | 177990 | 541083 | 6007 | 443126 | 27488 |
| DPY19L2 | 177990 | 536494 | 6008 | N/A | |
| DPY19L2 | 177990 | 538147 | 6009 | 439567 | 27489 |
| DPY19L2 | 177990 | 542209 | 6010 | 444932 | 27490 |
| DPY19L4 | 156162 | 522422 | 6011 | 428762 | 27491 |
| DPY19L4 | 156162 | 520774 | 6012 | 430162 | 27492 |
| DPY19L4 | 156162 | 414645 | 6013 | 389630 | 27493 |
| DPY19L4 | 156162 | 519353 | 6014 | 428041 | 27494 |
| DPY19L4 | 156162 | 519176 | 6015 | 430417 | 27495 |
| DPY19L4 | 156162 | 521525 | 6016 | 429559 | 27496 |
| DPY19L4 | 156162 | 523020 | 6017 | 429785 | 27497 |
| DPY19L4 | 156162 | 522669 | 6018 | 429711 | 27498 |
| DPYD | 188641 | 370192 | 6019 | 359211 | 27499 |
| DPYD | 188641 | 474241 | 6020 | N/A | |
| DPYD | 188641 | 306031 | 6021 | 307107 | 27500 |
| DPYD | 188641 | 460019 | 6022 | N/A | |
| DPYSL3 | 113657 | 398514 | 6023 | 381526 | 27501 |
| DPYSL3 | 113657 | 343218 | 6024 | 343690 | 27502 |
| DPYSL3 | 113657 | 520473 | 6025 | 430267 | 27503 |
| DPYSL3 | 113657 | 507309 | 6026 | N/A | |
| DPYSL3 | 113657 | 523458 | 6027 | 428958 | 27504 |
| DPYSL3 | 113657 | 508042 | 6028 | N/A | |
| DPYSL3 | 113657 | 519672 | 6029 | N/A | |
| DPYSL3 | 113657 | 512722 | 6030 | 426720 | 27505 |
| DPYSL3 | 113657 | 504965 | 6031 | N/A | |
| DPYSL4 | 151640 | 338492 | 6032 | 339850 | 27506 |
| DPYSL4 | 151640 | 493927 | 6033 | N/A | |
| DPYSL4 | 151640 | 493882 | 6034 | N/A | |
| DPYSL4 | 151640 | 368627 | 6035 | 357616 | 27507 |
| DPYSL4 | 151640 | 471544 | 6036 | N/A | |
| DRD1 | 184845 | 393752 | 6037 | 377353 | 27508 |
| DRD2 | 149295 | 346454 | 6038 | 278597 | 27509 |
| DRD2 | 149295 | 362072 | 6039 | 354859 | 27510 |
| DRD2 | 149295 | 544518 | 6040 | 441068 | 27511 |
| DRD2 | 149295 | 542968 | 6041 | 442172 | 27512 |
| DRD2 | 149295 | 538967 | 6042 | 438215 | 27513 |
| DRD2 | 149295 | 540600 | 6043 | N/A | |
| DRD2 | 149295 | 535984 | 6044 | N/A | |
| DRD2 | 149295 | 539420 | 6045 | N/A | |
| DRD2 | 149295 | 543292 | 6046 | 438419 | 27514 |
| DRD2 | 149295 | 542616 | 6047 | 441474 | 27515 |
| DSCAML1 | 177103 | 527706 | 6048 | 434335 | 27516 |
| DSCAML1 | 177103 | 321322 | 6049 | 315465 | 27517 |
| DSCAML1 | 177103 | 525836 | 6050 | 436387 | 27518 |
| DTX4 | 110042 | 532982 | 6051 | 434055 | 27519 |
| DTX4 | 110042 | 227451 | 6052 | 227451 | 27520 |
| DTX4 | 110042 | 531902 | 6053 | N/A | |
| DTX4 | 110042 | 527475 | 6054 | N/A | |
| DUS3L | 141994 | 590343 | 6055 | 466351 | 27521 |
| DUS3L | 141994 | 320699 | 6056 | 315558 | 27522 |
| DUS3L | 141994 | 589085 | 6057 | N/A | |
| DUS3L | 141994 | 309061 | 6058 | 311977 | 27523 |
| DUS3L | 141994 | 589841 | 6059 | N/A | |

-continued

-continued

| Symbol | ENSG | ENST | SEQ ID | ENSP | SEQ ID |
|---|---|---|---|---|---|
| DUS3L | 141994 | 592468 | 6060 | 468075 | 27524 |
| DUS3L | 141994 | 591560 | 6061 | 467987 | 27525 |
| DUS3L | 141994 | 592673 | 6062 | N/A | |
| DUS3L | 141994 | 590087 | 6063 | N/A | |
| DUS3L | 141994 | 593229 | 6064 | N/A | |
| DUS3L | 141994 | 590110 | 6065 | 465369 | 27526 |
| DUS3L | 141994 | 592491 | 6066 | 467302 | 27527 |
| DUS3L | 141994 | 585587 | 6067 | 468233 | 27528 |
| DUS3L | 141994 | 590681 | 6068 | N/A | |
| DUS3L | 141994 | 589854 | 6069 | N/A | |
| DUSP1 | 120129 | 239223 | 6070 | 239223 | 27529 |
| DUSP16 | 111266 | 298573 | 6071 | 298573 | 27530 |
| DUSP16 | 111266 | 545864 | 6072 | N/A | |
| DUSP16 | 111266 | 539940 | 6073 | 443039 | 27531 |
| DUSP16 | 111266 | 541207 | 6074 | 441250 | 27532 |
| DUSP16 | 111266 | 536236 | 6075 | N/A | |
| DUSP16 | 111266 | 228862 | 6076 | 228862 | 27533 |
| DUSP16 | 280962 | 626413 | 6077 | 487512 | 27534 |
| DUSP16 | 280962 | 628303 | 6078 | 487034 | 27535 |
| DUSP16 | 280962 | 630190 | 6079 | N/A | |
| DUSP16 | 280962 | 626461 | 6080 | 485919 | 27536 |
| DUSP16 | 280962 | 629698 | 6081 | 487493 | 27537 |
| DUSP16 | 280962 | 627160 | 6082 | N/A | |
| DUSP22 | 112679 | 603296 | 6083 | 474082 | 27538 |
| DUSP22 | 112679 | 344450 | 6084 | 345281 | 27539 |
| DUSP22 | 112679 | 603453 | 6085 | 474646 | 27540 |
| DUSP22 | 112679 | 605315 | 6086 | 474827 | 27541 |
| DUSP22 | 112679 | 603881 | 6087 | 474450 | 27542 |
| DUSP22 | 112679 | 603795 | 6088 | 475106 | 27543 |
| DUSP22 | 112679 | 419235 | 6089 | 397459 | 27544 |
| DUSP22 | 112679 | 605035 | 6090 | 475061 | 27545 |
| DUSP22 | 112679 | 605863 | 6091 | 474000 | 27546 |
| DUSP22 | 112679 | 603005 | 6092 | N/A | |
| DUSP22 | 112679 | 603726 | 6093 | 474330 | 27547 |
| DUSP22 | 112679 | 603290 | 6094 | N/A | |
| DUSP22 | 112679 | 605391 | 6095 | N/A | |
| DUSP22 | 112679 | 604971 | 6096 | 474505 | 27548 |
| DUSP22 | 112679 | 604914 | 6097 | N/A | |
| DUSP22 | 112679 | 604988 | 6098 | N/A | |
| DUSP26 | 133878 | 256261 | 6099 | 256261 | 27549 |
| DUSP26 | 133878 | 523956 | 6100 | 429176 | 27550 |
| DUSP26 | 133878 | 522982 | 6101 | 430922 | 27551 |
| DUSP5 | 138166 | 369583 | 6102 | 358596 | 27552 |
| DUSP5 | 138166 | 468749 | 6103 | N/A | |
| DYNLT3 | 165169 | 378581 | 6104 | 367844 | 27553 |
| DYNLT3 | 165169 | 378578 | 6105 | 367841 | 27554 |
| DYNLT3 | 165169 | 432389 | 6106 | 402695 | 27555 |
| DYRK1B | 105204 | 593685 | 6107 | 469863 | 27556 |
| DYRK1B | 105204 | 323039 | 6108 | 312789 | 27557 |
| DYRK1B | 105204 | 597639 | 6109 | 472941 | 27558 |
| DYRK1B | 105204 | 430012 | 6110 | 403182 | 27559 |
| DYRK1B | 105204 | 601696 | 6111 | N/A | |
| DYRK1B | 105204 | 600611 | 6112 | 471609 | 27560 |
| DYRK1B | 105204 | 601972 | 6113 | 472861 | 27561 |
| DYRK1B | 105204 | 348817 | 6114 | 221803 | 27562 |
| DYRK1B | 281320 | 631090 | 6115 | 486377 | 27563 |
| DYRK1B | 281320 | 625757 | 6116 | 485915 | 27564 |
| DYRK1B | 281320 | 625388 | 6117 | 486839 | 27565 |
| DYRK1B | 281320 | 625438 | 6118 | 487313 | 27566 |
| DYRK1B | 281320 | 627034 | 6119 | 487539 | 27567 |
| DYRK1B | 281320 | 629412 | 6120 | N/A | |
| DYRK1B | 281320 | 626964 | 6121 | 486913 | 27568 |
| DYRK1B | 281320 | 630714 | 6122 | 486264 | 27569 |
| DYRK4 | 010219 | 543431 | 6123 | 439697 | 27570 |
| DYRK4 | 010219 | 539701 | 6124 | 441996 | 27571 |
| DYRK4 | 010219 | 537719 | 6125 | 444842 | 27572 |
| DYRK4 | 010219 | 539309 | 6126 | 439168 | 27573 |
| DYRK4 | 010219 | 538520 | 6127 | N/A | |
| DYRK4 | 010219 | 539490 | 6128 | N/A | |
| DYRK4 | 010219 | 540757 | 6129 | 441755 | 27574 |
| DYRK4 | 010219 | 536157 | 6130 | N/A | |
| DYRK4 | 010219 | 542905 | 6131 | N/A | |
| DYRK4 | 010219 | 536645 | 6132 | N/A | |
| DYRK4 | 010219 | 540644 | 6133 | N/A | |
| DYRK4 | 010219 | 545571 | 6134 | N/A | |
| DYRK4 | 010219 | 536137 | 6135 | N/A | |

| Symbol | ENSG | ENST | SEQ ID | ENSP | SEQ ID |
|---|---|---|---|---|---|
| DYRK4 | 010219 | 541024 | 6136 | N/A | |
| DYRK4 | 010219 | 544671 | 6137 | 438769 | 27575 |
| DYRK4 | 010219 | 544050 | 6138 | N/A | |
| DYRK4 | 010219 | 010132 | 6139 | 010132 | 27576 |
| DYSF | 135636 | 409762 | 6140 | 387137 | 27577 |
| DYSF | 135636 | 409582 | 6141 | 386547 | 27578 |
| DYSF | 135636 | 429174 | 6142 | 398305 | 27579 |
| DYSF | 135636 | 413539 | 6143 | 407046 | 27580 |
| DYSF | 135636 | 258104 | 6144 | 258104 | 27581 |
| DYSF | 135636 | 409651 | 6145 | 386683 | 27582 |
| DYSF | 135636 | 394120 | 6146 | 377678 | 27583 |
| DYSF | 135636 | 409744 | 6147 | 386285 | 27584 |
| DYSF | 135636 | 409366 | 6148 | 386512 | 27585 |
| DYSF | 135636 | 410020 | 6149 | 386881 | 27586 |
| DYSF | 135636 | 410041 | 6150 | 386617 | 27587 |
| DYSF | 135636 | 461565 | 6151 | N/A | |
| DYSF | 135636 | 475076 | 6152 | N/A | |
| DYSF | 135636 | 479049 | 6153 | N/A | |
| DYSF | 135636 | 493767 | 6154 | N/A | |
| DYSF | 135636 | 472873 | 6155 | N/A | |
| DYSF | 135636 | 494501 | 6156 | N/A | |
| DYSF | 135636 | 487180 | 6157 | N/A | |
| DYSF | 135636 | 468173 | 6158 | N/A | |
| DZANK1 | 089091 | 476058 | 6159 | 479439 | 27588 |
| DZANK1 | 089091 | 377630 | 6160 | 366857 | 27589 |
| DZANK1 | 089091 | 357236 | 6161 | 349774 | 27590 |
| DZANK1 | 089091 | 358866 | 6162 | 351734 | 27591 |
| DZANK1 | 089091 | 608192 | 6163 | 476391 | 27592 |
| DZANK1 | 089091 | 609267 | 6164 | 477046 | 27593 |
| DZANK1 | 089091 | 480488 | 6165 | 484666 | 27594 |
| DZANK1 | 089091 | 460891 | 6166 | 477872 | 27595 |
| DZANK1 | 089091 | 470526 | 6167 | N/A | |
| DZANK1 | 089091 | 262547 | 6168 | 262547 | 27596 |
| DZANK1 | 089091 | 329494 | 6169 | 328866 | 27597 |
| DZIP1L | 158163 | 327532 | 6170 | 332148 | 27598 |
| DZIP1L | 158163 | 486487 | 6171 | 417228 | 27599 |
| DZIP1L | 158163 | 488595 | 6172 | N/A | |
| DZIP1L | 158163 | 469243 | 6173 | 419486 | 27600 |
| DZIP1L | 158163 | 466301 | 6174 | N/A | |
| DZIP1L | 158163 | 473850 | 6175 | N/A | |
| DZIP1L | 158163 | 490472 | 6176 | N/A | |
| DZIP1L | 158163 | 467030 | 6177 | 420600 | 27601 |
| DZIP1L | 158163 | 492010 | 6178 | 420051 | 27602 |
| E2F3 | 112242 | 346618 | 6179 | 262904 | 27603 |
| E2F3 | 112242 | 535432 | 6180 | 443418 | 27604 |
| E2F3 | 112242 | 613242 | 6181 | 483249 | 27605 |
| EBF1 | 164330 | 519890 | 6182 | N/A | |
| EBF1 | 164330 | 519739 | 6183 | N/A | |
| EBF1 | 164330 | 518836 | 6184 | N/A | |
| EBF1 | 164330 | 313708 | 6185 | 322898 | 27606 |
| EBF1 | 164330 | 518323 | 6186 | N/A | |
| EBF1 | 164330 | 380654 | 6187 | 370029 | 27607 |
| EBF1 | 164330 | 517373 | 6188 | 428020 | 27608 |
| EBF1 | 164330 | 522192 | 6189 | N/A | |
| EBF1 | 164330 | 523464 | 6190 | N/A | |
| EBF1 | 164330 | 523315 | 6191 | N/A | |
| EBF1 | 164330 | 622875 | 6192 | 477809 | 27609 |
| EBF2 | 221818 | 520164 | 6193 | 430241 | 27610 |
| EBF2 | 221818 | 408929 | 6194 | 386178 | 27611 |
| EBF2 | 221818 | 517825 | 6195 | N/A | |
| EBF2 | 221818 | 535548 | 6196 | 437909 | 27612 |
| EBF3 | 108001 | 368648 | 6197 | 357637 | 27613 |
| EBF3 | 108001 | 355311 | 6198 | 347463 | 27614 |
| EBF3 | 108001 | 440978 | 6199 | 387543 | 27615 |
| EBF4 | 088881 | 449079 | 6200 | 405003 | 27616 |
| EBF4 | 088881 | 497450 | 6201 | N/A | |
| EBF4 | 088881 | 342725 | 6202 | 345030 | 27617 |
| EBF4 | 088881 | 609451 | 6203 | 477023 | 27618 |
| EBF4 | 088881 | 609967 | 6204 | N/A | |
| EBF4 | 088881 | 469251 | 6205 | N/A | |
| EBF4 | 088881 | 463145 | 6206 | 477107 | 27619 |
| EBF4 | 088881 | 491472 | 6207 | N/A | |
| EBF4 | 088881 | 481662 | 6208 | N/A | |
| EBF4 | 088881 | 477287 | 6209 | N/A | |
| EBF4 | 088881 | 380648 | 6210 | 370022 | 27620 |
| ECD | 122882 | 494307 | 6211 | 475102 | 27621 |

| Symbol | ENSG | ENST | SEQ ID | ENSP | SEQ ID |
|---|---|---|---|---|---|
| ECD | 122882 | 372979 | 6212 | 362070 | 27622 |
| ECD | 122882 | 484976 | 6213 | 433778 | 27623 |
| ECD | 122882 | 454759 | 6214 | 395786 | 27624 |
| ECD | 122882 | 430082 | 6215 | 401566 | 27625 |
| ECD | 122882 | 453402 | 6216 | 391367 | 27626 |
| ECD | 122882 | 413026 | 6217 | 416288 | 27627 |
| ECD | 122882 | 610256 | 6218 | N/A | |
| ECE1 | 117298 | 415912 | 6219 | 405088 | 27628 |
| ECE1 | 117298 | 357071 | 6220 | 349581 | 27629 |
| ECE1 | 117298 | 531334 | 6221 | N/A | |
| ECE1 | 117298 | 374893 | 6222 | 364028 | 27630 |
| ECE1 | 117298 | 436918 | 6223 | 388439 | 27631 |
| ECE1 | 117298 | 264205 | 6224 | 264205 | 27632 |
| ECE1 | 117298 | 526194 | 6225 | N/A | |
| ECE1 | 117298 | 470394 | 6226 | N/A | |
| ECE1 | 117298 | 528294 | 6227 | N/A | |
| ECE1 | 117298 | 473505 | 6228 | 431856 | 27633 |
| ECE1 | 117298 | 481130 | 6229 | 436633 | 27634 |
| ECE1 | 117298 | 527991 | 6230 | 432860 | 27635 |
| ECE1 | 117298 | 463334 | 6231 | N/A | |
| ECHDC2 | 121310 | 371522 | 6232 | 360577 | 27636 |
| ECHDC2 | 121310 | 460612 | 6233 | N/A | |
| ECHDC2 | 121310 | 539680 | 6234 | N/A | |
| ECHDC2 | 121310 | 479183 | 6235 | N/A | |
| ECHDC2 | 121310 | 543419 | 6236 | N/A | |
| ECHDC2 | 121310 | 463923 | 6237 | N/A | |
| ECHDC2 | 121310 | 371520 | 6238 | 360575 | 27637 |
| ECHDC2 | 121310 | 358358 | 6239 | 351125 | 27638 |
| ECHDC2 | 121310 | 498544 | 6240 | N/A | |
| ECHDC2 | 121310 | 476477 | 6241 | 446190 | 27639 |
| ECHDC2 | 121310 | 479593 | 6242 | N/A | |
| ECHDC2 | 121310 | 467988 | 6243 | 441962 | 27640 |
| ECHDC2 | 121310 | 487866 | 6244 | N/A | |
| ECHDC2 | 121310 | 486170 | 6245 | N/A | |
| ECHDC2 | 121310 | 487851 | 6246 | N/A | |
| ECHDC2 | 121310 | 488268 | 6247 | N/A | |
| ECHDC2 | 121310 | 544365 | 6248 | 439906 | 27641 |
| ECHDC2 | 121310 | 495920 | 6249 | N/A | |
| ECHDC2 | 121310 | 492992 | 6250 | N/A | |
| ECHDC2 | 121310 | 480312 | 6251 | N/A | |
| ECHDC2 | 121310 | 544531 | 6252 | N/A | |
| ECHDC2 | 121310 | 493896 | 6253 | N/A | |
| ECHDC2 | 121310 | 487040 | 6254 | N/A | |
| ECHDC2 | 121310 | 542552 | 6255 | 438535 | 27642 |
| ECHDC2 | 121310 | 474789 | 6256 | N/A | |
| ECHDC2 | 121310 | 536120 | 6257 | 439264 | 27643 |
| EDEM1 | 134109 | 434243 | 6258 | 393659 | 27644 |
| EDEM1 | 134109 | 256497 | 6259 | 256497 | 27645 |
| EDEM1 | 134109 | 465369 | 6260 | N/A | |
| EDEM1 | 134109 | 443790 | 6261 | 394615 | 27646 |
| EDEM1 | 134109 | 465187 | 6262 | N/A | |
| EDEM1 | 134109 | 445686 | 6263 | 394099 | 27647 |
| EDEM1 | 134109 | 492751 | 6264 | N/A | |
| EDIL3 | 164176 | 296591 | 6265 | 296591 | 27648 |
| EDIL3 | 164176 | 380138 | 6266 | 369483 | 27649 |
| EDIL3 | 164176 | 510271 | 6267 | N/A | |
| EDIL3 | 164176 | 507663 | 6268 | N/A | |
| EDNRB | 136160 | 377211 | 6269 | 366416 | 27650 |
| EDNRB | 136160 | 334286 | 6270 | 335311 | 27651 |
| EDNRB | 136160 | 626030 | 6271 | 486202 | 27652 |
| EDNRB | 136160 | 475537 | 6272 | 487082 | 27653 |
| SLC13A1 | 081800 | 194130 | 6273 | 194130 | 27654 |
| SLC13A1 | 081800 | 427975 | 6274 | 388403 | 27655 |
| SLC13A1 | 081800 | 439260 | 6275 | 401417 | 27656 |
| SLC13A1 | 081800 | 539873 | 6276 | 441309 | 27657 |
| EFEMP1 | 115380 | 394555 | 6277 | 378058 | 27658 |
| EFEMP1 | 115380 | 635671 | 6278 | 489578 | 27659 |
| EFEMP1 | 115380 | 355426 | 6279 | 347596 | 27660 |
| EFEMP1 | 115380 | 634374 | 6280 | 489183 | 27661 |
| EFEMP1 | 115380 | 438672 | 6281 | 392055 | 27662 |
| EFEMP1 | 115380 | 452161 | 6282 | N/A | |
| EFEMP1 | 115380 | 439193 | 6283 | 408195 | 27663 |
| EFEMP1 | 115380 | 440439 | 6284 | 398345 | 27664 |
| EFEMP1 | 115380 | 429909 | 6285 | 389319 | 27665 |
| EFEMP1 | 115380 | 452337 | 6286 | 399480 | 27666 |
| EFEMP1 | 115380 | 421664 | 6287 | 405686 | 27667 |

| Symbol | ENSG | ENST | SEQ ID | ENSP | SEQ ID |
|---|---|---|---|---|---|
| EFEMP1 | 115380 | 480016 | 6288 | N/A | |
| EFEMP1 | 115380 | 424207 | 6289 | 398387 | 27668 |
| EFEMP1 | 115380 | 497698 | 6290 | N/A | |
| EFHC2 | 183690 | 343571 | 6291 | N/A | |
| EFHC2 | 183690 | 420999 | 6292 | 404232 | 27669 |
| EFHD1 | 115468 | 409613 | 6293 | 386556 | 27670 |
| EFHD1 | 115468 | 264059 | 6294 | 264059 | 27671 |
| EFHD1 | 115468 | 442845 | 6295 | 395119 | 27672 |
| EFHD1 | 115468 | 409708 | 6296 | 386243 | 27673 |
| EFHD1 | 115468 | 427698 | 6297 | 401073 | 27674 |
| EFHD1 | 115468 | 410095 | 6298 | 386685 | 27675 |
| EFHD1 | 115468 | 611312 | 6299 | 484568 | 27676 |
| EFHD2 | 142634 | 375980 | 6300 | 365147 | 27677 |
| EFHD2 | 142634 | 445566 | 6301 | 395153 | 27678 |
| EFNA5 | 184349 | 505499 | 6302 | N/A | |
| EFNA5 | 184349 | 611503 | 6303 | 484681 | 27679 |
| EFNA5 | 184349 | 333274 | 6304 | 328777 | 27680 |
| EFNA5 | 184349 | 510359 | 6305 | N/A | |
| EFNA5 | 184349 | 504941 | 6306 | N/A | |
| EFNA5 | 184349 | 509503 | 6307 | 426989 | 27681 |
| EFNB3 | 108947 | 226091 | 6308 | 226091 | 27682 |
| EFR3B | 084710 | 401432 | 6309 | 386082 | 27683 |
| EFR3B | 084710 | 403714 | 6310 | 384081 | 27684 |
| EFR3B | 084710 | 402191 | 6311 | 385832 | 27685 |
| EFR3B | 084710 | 405108 | 6312 | 384454 | 27686 |
| EFR3B | 084710 | 264719 | 6313 | 264719 | 27687 |
| EGF | 138798 | 509793 | 6314 | 424316 | 27688 |
| EGF | 138798 | 265171 | 6315 | 265171 | 27689 |
| EGF | 138798 | 503392 | 6316 | 421384 | 27690 |
| EGF | 138798 | 502723 | 6317 | N/A | |
| EGF | 138798 | 504633 | 6318 | N/A | |
| EGF | 138798 | 502579 | 6319 | N/A | |
| EGF | 138798 | 541061 | 6320 | N/A | |
| EGF | 138798 | 511228 | 6321 | N/A | |
| EGF | 138798 | 509996 | 6322 | N/A | |
| EGF | 138798 | 544918 | 6323 | N/A | |
| EGF | 138798 | 537316 | 6324 | N/A | |
| EGF | 138798 | 540840 | 6325 | N/A | |
| EGFR | 146648 | 459688 | 6326 | N/A | |
| EGFR | 146648 | 463948 | 6327 | N/A | |
| EGFR | 146648 | 450046 | 6328 | 413354 | 27691 |
| EGFR | 146648 | 485503 | 6329 | N/A | |
| EGFR | 146648 | 638463 | 6330 | 492462 | 27692 |
| EGFR | 146648 | 454757 | 6331 | 395243 | 27693 |
| EGFR | 146648 | 455089 | 6332 | 415559 | 27694 |
| EGFR | 146648 | 342916 | 6333 | 342376 | 27695 |
| EGFR | 146648 | 344576 | 6334 | 345973 | 27696 |
| EGFR | 146648 | 420316 | 6335 | 413843 | 27697 |
| EGFR | 146648 | 275493 | 6336 | 275493 | 27698 |
| EGLN3 | 129521 | 250457 | 6337 | 250457 | 27699 |
| EGLN3 | 129521 | 553215 | 6338 | 447470 | 27700 |
| EGLN3 | 129521 | 556785 | 6339 | N/A | |
| EGLN3 | 129521 | 487915 | 6340 | 451316 | 27701 |
| EGLN3 | 129521 | 547327 | 6341 | 446572 | 27702 |
| EGLN3 | 129521 | 550114 | 6342 | N/A | |
| EGLN3 | 129521 | 551935 | 6343 | N/A | |
| EGLN3 | 129521 | 548285 | 6344 | N/A | |
| EGLN3 | 129521 | 546681 | 6345 | N/A | |
| EGLN3 | 129521 | 464521 | 6346 | N/A | |
| EGLN3 | 129521 | 557521 | 6347 | N/A | |
| EGR1 | 120738 | 239938 | 6348 | 239938 | 27703 |
| EGR3 | 179388 | 317216 | 6349 | 318057 | 27704 |
| EGR3 | 179388 | 522910 | 6350 | 430310 | 27705 |
| EGR3 | 179388 | 519492 | 6351 | 429370 | 27706 |
| EGR3 | 179388 | 524088 | 6352 | N/A | |
| EGR3 | 179388 | 518773 | 6353 | N/A | |
| EHD3 | 013016 | 322054 | 6354 | 327116 | 27707 |
| EIF2AK3 | 172071 | 419748 | 6355 | 408325 | 27708 |
| EIF2AK3 | 172071 | 303236 | 6356 | 307235 | 27709 |
| EIF2AK3 | 172071 | 415570 | 6357 | 412076 | 27710 |
| EIF2AK3 | 172071 | 470706 | 6358 | N/A | |
| EIF2AK3 | 172071 | 478003 | 6359 | N/A | |
| EIF2AK3 | 172071 | 477083 | 6360 | N/A | |
| EIF2S3 | 130741 | 253039 | 6361 | 253039 | 27711 |
| EIF2S3 | 130741 | 487075 | 6362 | N/A | |
| EIF2S3 | 130741 | 423068 | 6363 | 391383 | 27712 |

-continued

-continued

| Symbol | ENSG | ENST | SEQ ID | ENSP | SEQ ID |
|---|---|---|---|---|---|
| EIF2S3 | 130741 | 460032 | 6364 | N/A | |
| EIF2S3 | 130741 | 457332 | 6365 | N/A | |
| EIF4A3 | 141543 | 269349 | 6366 | 269349 | 27713 |
| EIF4A3 | 141543 | 575978 | 6367 | N/A | |
| EIF4A3 | 141543 | 570625 | 6368 | N/A | |
| EIF4A3 | 141543 | 576573 | 6369 | N/A | |
| EIF4A3 | 141543 | 575668 | 6370 | N/A | |
| EIF4A3 | 141543 | 570837 | 6371 | N/A | |
| EIF4A3 | 141543 | 576547 | 6372 | 460439 | 27714 |
| EIF4A3 | 141543 | 575957 | 6373 | N/A | |
| ELAVL2 | 107105 | 380110 | 6374 | 369453 | 27715 |
| ELAVL2 | 107105 | 223951 | 6375 | 223951 | 27716 |
| ELAVL2 | 107105 | 380117 | 6376 | 369460 | 27717 |
| ELAVL2 | 107105 | 423281 | 6377 | 391757 | 27718 |
| ELAVL2 | 107105 | 440102 | 6378 | 412602 | 27719 |
| ELAVL2 | 107105 | 462649 | 6379 | N/A | |
| ELAVL2 | 107105 | 397312 | 6380 | 380479 | 27720 |
| ELAVL2 | 107105 | 544538 | 6381 | 440998 | 27721 |
| ELAVL3 | 196361 | 359227 | 6382 | 352162 | 27722 |
| ELAVL3 | 196361 | 438662 | 6383 | 390878 | 27723 |
| ELAVL3 | 196361 | 588853 | 6384 | 467314 | 27724 |
| ELAVL3 | 196361 | 592218 | 6385 | N/A | |
| ELAVL4 | 162374 | 371827 | 6386 | 360892 | 27725 |
| ELAVL4 | 162374 | 463650 | 6387 | N/A | |
| ELAVL4 | 162374 | 357083 | 6388 | 349594 | 27726 |
| ELAVL4 | 162374 | 371824 | 6389 | 360889 | 27727 |
| ELAVL4 | 162374 | 371823 | 6390 | 360888 | 27728 |
| ELAVL4 | 162374 | 371821 | 6391 | 360886 | 27729 |
| ELAVL4 | 162374 | 371819 | 6392 | 360884 | 27730 |
| ELAVL4 | 162374 | 494555 | 6393 | N/A | |
| ELAVL4 | 162374 | 492299 | 6394 | N/A | |
| ELAVL4 | 162374 | 474675 | 6395 | N/A | |
| ELAVL4 | 162374 | 448907 | 6396 | 399939 | 27731 |
| ELF2 | 109381 | 379549 | 6397 | 368867 | 27732 |
| ELF2 | 109381 | 379550 | 6398 | 368868 | 27733 |
| ELF2 | 109381 | 514606 | 6399 | N/A | |
| ELF2 | 109381 | 504314 | 6400 | N/A | |
| ELF2 | 109381 | 514577 | 6401 | N/A | |
| ELF2 | 109381 | 512627 | 6402 | 426087 | 27734 |
| ELF2 | 109381 | 515489 | 6403 | N/A | |
| ELF2 | 109381 | 511006 | 6404 | N/A | |
| ELF2 | 109381 | 511184 | 6405 | 421278 | 27735 |
| ELF2 | 109381 | 420916 | 6406 | 397796 | 27736 |
| ELF2 | 109381 | 510408 | 6407 | 426997 | 27737 |
| ELF2 | 109381 | 358635 | 6408 | 351458 | 27738 |
| ELF2 | 109381 | 394235 | 6409 | 377782 | 27739 |
| ELFN1 | 225968 | 424383 | 6410 | 456548 | 27740 |
| ELFN1 | 225968 | 561626 | 6411 | 457193 | 27741 |
| ELMO1 | 155849 | 396045 | 6412 | 379360 | 27742 |
| ELMO1 | 155849 | 310758 | 6413 | 312185 | 27743 |
| ELMO1 | 155849 | 396040 | 6414 | 379355 | 27744 |
| ELMO1 | 155849 | 442504 | 6415 | 406952 | 27745 |
| ELMO1 | 155849 | 497024 | 6416 | N/A | |
| ELMO1 | 155849 | 487843 | 6417 | N/A | |
| ELMO1 | 155849 | 448602 | 6418 | 394458 | 27746 |
| ELMO1 | 155849 | 464262 | 6419 | N/A | |
| ELMO1 | 155849 | 420636 | 6420 | 396465 | 27747 |
| ELMO1 | 155849 | 472359 | 6421 | N/A | |
| ELMO1 | 155849 | 433246 | 6422 | 413108 | 27748 |
| ELMO1 | 155849 | 487336 | 6423 | N/A | |
| ELMO1 | 155849 | 424212 | 6424 | 395933 | 27749 |
| ELMO1 | 155849 | 455119 | 6425 | 406610 | 27750 |
| ELMO1 | 155849 | 455879 | 6426 | 416090 | 27751 |
| ELMO1 | 155849 | 463390 | 6427 | N/A | |
| ELMO1 | 155849 | 453399 | 6428 | 391734 | 27752 |
| ELMO1 | 155849 | 445322 | 6429 | 397857 | 27753 |
| ELMO1 | 155849 | 479447 | 6430 | N/A | |
| ELMO2 | 062598 | 290246 | 6431 | 290246 | 27754 |
| ELMO2 | 062598 | 467800 | 6432 | 431972 | 27755 |
| ELMO2 | 062598 | 372176 | 6433 | 361249 | 27756 |
| ELMO2 | 062598 | 452857 | 6434 | 414329 | 27757 |
| ELMO2 | 062598 | 352077 | 6435 | 326172 | 27758 |
| ELMO2 | 062598 | 464448 | 6436 | N/A | |
| ELMO2 | 062598 | 425546 | 6437 | 388962 | 27759 |
| ELMO2 | 062598 | 462491 | 6438 | N/A | |
| ELMO2 | 062598 | 481852 | 6439 | N/A | |

| Symbol | ENSG | ENST | SEQ ID | ENSP | SEQ ID |
|---|---|---|---|---|---|
| ELMO2 | 062598 | 488853 | 6440 | N/A | |
| ELMO2 | 062598 | 450812 | 6441 | 416181 | 27760 |
| ELMO2 | 062598 | 480042 | 6442 | N/A | |
| ELMO2 | 062598 | 469801 | 6443 | N/A | |
| ELMO2 | 062598 | 460474 | 6444 | N/A | |
| ELMO2 | 062598 | 497412 | 6445 | N/A | |
| ELMO2 | 062598 | 487583 | 6446 | N/A | |
| ELMO2 | 062598 | 462593 | 6447 | N/A | |
| ELMO2 | 062598 | 396391 | 6448 | 379673 | 27761 |
| ELMOD1 | 110675 | 531234 | 6449 | 433232 | 27762 |
| ELMOD1 | 110675 | 265840 | 6450 | 265840 | 27763 |
| ELMOD1 | 110675 | 443271 | 6451 | 412257 | 27764 |
| ELMOD1 | 110675 | 524378 | 6452 | N/A | |
| ELMOD1 | 110675 | 529675 | 6453 | N/A | |
| ELMOD1 | 110675 | 527036 | 6454 | N/A | |
| ELMOD1 | 110675 | 534236 | 6455 | N/A | |
| ELN | 049540 | 445912 | 6456 | 389857 | 27765 |
| ELN | 049540 | 252034 | 6457 | 252034 | 27766 |
| ELN | 049540 | 431562 | 6458 | 394549 | 27767 |
| ELN | 049540 | 320492 | 6459 | 315607 | 27768 |
| ELN | 049540 | 438906 | 6460 | 406949 | 27769 |
| ELN | 049540 | 494160 | 6461 | N/A | |
| ELN | 049540 | 492003 | 6462 | N/A | |
| ELN | 049540 | 468517 | 6463 | N/A | |
| ELN | 049540 | 438880 | 6464 | 389206 | 27770 |
| ELN | 049540 | 414324 | 6465 | 392575 | 27771 |
| ELN | 049540 | 380562 | 6466 | 369936 | 27772 |
| ELN | 049540 | 480728 | 6467 | N/A | |
| ELN | 049540 | 380575 | 6468 | 369949 | 27773 |
| ELN | 049540 | 380584 | 6469 | 369958 | 27774 |
| ELN | 049540 | 458204 | 6470 | 403162 | 27775 |
| ELN | 049540 | 357036 | 6471 | 349540 | 27776 |
| ELN | 049540 | 462506 | 6472 | N/A | |
| ELN | 049540 | 479432 | 6473 | N/A | |
| ELN | 049540 | 417091 | 6474 | 411092 | 27777 |
| ELN | 049540 | 429192 | 6475 | 391129 | 27778 |
| ELN | 049540 | 416107 | 6476 | 404138 | 27779 |
| ELN | 049540 | 442310 | 6477 | 403961 | 27780 |
| ELN | 049540 | 380553 | 6478 | 369926 | 27781 |
| ELN | 049540 | 380576 | 6479 | 369950 | 27782 |
| ELN | 049540 | 473323 | 6480 | N/A | |
| ELN | 049540 | 428787 | 6481 | 399499 | 27783 |
| ELN | 049540 | 320399 | 6482 | 313565 | 27784 |
| ELN | 049540 | 419398 | 6483 | 412262 | 27785 |
| ELN | 049540 | 477397 | 6484 | N/A | |
| ELN | 049540 | 493839 | 6485 | N/A | |
| ELN | 049540 | 466878 | 6486 | N/A | |
| ELN | 049540 | 492210 | 6487 | N/A | |
| ELN | 049540 | 621115 | 6488 | 480955 | 27786 |
| ELN | 049540 | 358929 | 6489 | 351807 | 27787 |
| ELOVL1 | 066322 | 372458 | 6490 | 361536 | 27788 |
| ELOVL1 | 066322 | 468865 | 6491 | N/A | |
| ELOVL1 | 066322 | 464204 | 6492 | N/A | |
| ELOVL1 | 066322 | 470968 | 6493 | N/A | |
| ELOVL1 | 066322 | 487209 | 6494 | N/A | |
| ELOVL1 | 066322 | 470769 | 6495 | N/A | |
| ELOVL1 | 066322 | 497569 | 6496 | N/A | |
| ELOVL1 | 066322 | 482302 | 6497 | N/A | |
| ELOVL1 | 066322 | 497050 | 6498 | N/A | |
| ELOVL1 | 066322 | 478481 | 6499 | N/A | |
| ELOVL1 | 066322 | 479439 | 6500 | N/A | |
| ELOVL1 | 066322 | 465321 | 6501 | N/A | |
| ELOVL1 | 066322 | 479686 | 6502 | N/A | |
| ELOVL1 | 066322 | 496932 | 6503 | N/A | |
| ELOVL1 | 066322 | 621943 | 6504 | 477602 | 27789 |
| ELOVL1 | 066322 | 413844 | 6505 | 416024 | 27790 |
| ELOVL2 | 197977 | 354666 | 6506 | 346693 | 27791 |
| ELOVL5 | 012660 | 304434 | 6507 | 306640 | 27792 |
| ELOVL5 | 012660 | 485336 | 6508 | N/A | |
| ELOVL5 | 012660 | 465983 | 6509 | N/A | |
| ELOVL5 | 012660 | 486973 | 6510 | N/A | |
| ELOVL5 | 012660 | 370913 | 6511 | 359951 | 27793 |
| ELOVL5 | 012660 | 370918 | 6512 | 359956 | 27794 |
| ELOVL5 | 012660 | 542638 | 6513 | 440728 | 27795 |
| ELOVL7 | 164181 | 508821 | 6514 | 424123 | 27796 |
| ELOVL7 | 164181 | 505959 | 6515 | 421043 | 27797 |

-continued

-continued

| Symbol | ENSG | ENST | SEQ ID | ENSP | SEQ ID |
|---|---|---|---|---|---|
| ELOVL7 | 164181 | 504455 | 6516 | 425127 | 27798 |
| ELOVL7 | 164181 | 511799 | 6517 | 424081 | 27799 |
| ELOVL7 | 164181 | 507047 | 6518 | 426400 | 27800 |
| ELOVL7 | 164181 | 514809 | 6519 | 422602 | 27801 |
| ELOVL7 | 164181 | 425382 | 6520 | 402634 | 27802 |
| EME2 | 197774 | 568449 | 6521 | 457353 | 27803 |
| EME2 | 197774 | 570069 | 6522 | N/A | |
| EME2 | 197774 | 561564 | 6523 | N/A | |
| EME2 | 197774 | 565326 | 6524 | N/A | |
| EME2 | 197774 | 561903 | 6525 | 457966 | 27804 |
| EME2 | 197774 | 564182 | 6526 | 456946 | 27805 |
| EMLIN2 | 132205 | 254528 | 6527 | 254528 | 27806 |
| EMLIN2 | 132205 | 308080 | 6528 | N/A | |
| EMLIN2 | 132205 | 583776 | 6529 | N/A | |
| EML5 | 165521 | 554922 | 6530 | 451998 | 27807 |
| EML5 | 165521 | 553973 | 6531 | N/A | |
| EML5 | 165521 | 553526 | 6532 | 450965 | 27808 |
| EML5 | 165521 | 380664 | 6533 | 370039 | 27809 |
| EML5 | 165521 | 555823 | 6534 | 452030 | 27810 |
| EML5 | 165521 | 553320 | 6535 | N/A | |
| EML5 | 165521 | 553281 | 6536 | 452360 | 27811 |
| EML5 | 165521 | 553962 | 6537 | N/A | |
| EMP2 | 213853 | 359543 | 6538 | 352540 | 27812 |
| EMP2 | 213853 | 536829 | 6539 | 445712 | 27813 |
| EMP2 | 213853 | 342147 | 6540 | N/A | |
| EN2 | 164778 | 297375 | 6541 | 297375 | 27814 |
| ENAH | 154380 | 366844 | 6542 | 355809 | 27815 |
| ENAH | 154380 | 358675 | 6543 | N/A | |
| ENAH | 154380 | 635051 | 6544 | 489607 | 27816 |
| ENAH | 154380 | 366843 | 6545 | 355808 | 27817 |
| ENAH | 154380 | 498108 | 6546 | N/A | |
| ENAH | 154380 | 483952 | 6547 | N/A | |
| ENAH | 154380 | 497899 | 6548 | 489106 | 27818 |
| ENAH | 154380 | 391874 | 6549 | N/A | |
| ENAH | 154380 | 284563 | 6550 | 284563 | 27819 |
| ENC1 | 171617 | 302351 | 6551 | 306356 | 27820 |
| ENC1 | 171617 | 510316 | 6552 | 423804 | 27821 |
| ENC1 | 171617 | 509284 | 6553 | N/A | |
| ENC1 | 171617 | 508331 | 6554 | 422943 | 27822 |
| ENC1 | 171617 | 509127 | 6555 | 426889 | 27823 |
| ENC1 | 171617 | 537006 | 6556 | 446289 | 27824 |
| ENC1 | 171617 | 618628 | 6557 | 479101 | 27825 |
| ENOX1 | 120658 | 261488 | 6558 | 261488 | 27826 |
| ENOX1 | 120658 | 482207 | 6559 | N/A | |
| ENPP1 | 197594 | 486853 | 6560 | N/A | |
| ENPP1 | 197594 | 360971 | 6561 | 354238 | 27827 |
| ENPP1 | 197594 | 513998 | 6562 | 422424 | 27828 |
| ENPP1 | 197594 | 459624 | 6563 | N/A | |
| ENPP2 | 136960 | 259486 | 6564 | 259486 | 27829 |
| ENPP2 | 136960 | 427067 | 6565 | 403315 | 27830 |
| ENPP2 | 136960 | 523861 | 6566 | N/A | |
| ENPP2 | 136960 | 522167 | 6567 | 429476 | 27831 |
| ENPP2 | 136960 | 522826 | 6568 | 428291 | 27832 |
| ENPP2 | 136960 | 075322 | 6569 | 075322 | 27833 |
| ENPP2 | 136960 | 518109 | 6570 | N/A | |
| ENPP2 | 136960 | 520066 | 6571 | 428304 | 27834 |
| ENPP2 | 136960 | 518958 | 6572 | 429447 | 27835 |
| ENPP4 | 001561 | 321037 | 6573 | 318066 | 27836 |
| ENPP6 | 164303 | 296741 | 6574 | 296741 | 27837 |
| ENPP6 | 164303 | 510054 | 6575 | N/A | |
| ENPP6 | 164303 | 512353 | 6576 | 423497 | 27838 |
| ENPP6 | 164303 | 505644 | 6577 | N/A | |
| ENTPD2 | 054179 | 355097 | 6578 | 347213 | 27839 |
| ENTPD2 | 054179 | 460614 | 6579 | N/A | |
| ENTPD2 | 054179 | 312665 | 6580 | 312494 | 27840 |
| ENTPD2 | 054179 | 469106 | 6581 | N/A | |
| EPB41L1 | 088367 | 202028 | 6582 | 202028 | 27841 |
| EPB41L1 | 088367 | 432589 | 6583 | 393106 | 27842 |
| EPB41L1 | 088367 | 406771 | 6584 | 385244 | 27843 |
| EPB41L1 | 088367 | 430276 | 6585 | 404341 | 27844 |
| EPB41L1 | 088367 | 373950 | 6586 | 363061 | 27845 |
| EPB41L1 | 088367 | 628415 | 6587 | 487049 | 27846 |
| EPB41L1 | 088367 | 452261 | 6588 | 413262 | 27847 |
| EPB41L1 | 088367 | 447825 | 6589 | 396366 | 27848 |
| EPB41L1 | 088367 | 427533 | 6590 | 408877 | 27849 |
| EPB41L1 | 088367 | 373945 | 6591 | 363056 | 27850 |

| Symbol | ENSG | ENST | SEQ ID | ENSP | SEQ ID |
|---|---|---|---|---|---|
| EPB41L1 | 088367 | 338074 | 6592 | 337168 | 27851 |
| EPB41L1 | 088367 | 373941 | 6593 | 363052 | 27852 |
| EPB41L1 | 088367 | 451082 | 6594 | 406464 | 27853 |
| EPB41L1 | 088367 | 454226 | 6595 | 388281 | 27854 |
| EPB41L1 | 088367 | 636016 | 6596 | 489867 | 27855 |
| EPB41L1 | 088367 | 479336 | 6597 | N/A | |
| EPB41L1 | 088367 | 432603 | 6598 | 390262 | 27856 |
| EPB41L1 | 088367 | 441639 | 6599 | 399214 | 27857 |
| EPB41L1 | 088367 | 373946 | 6600 | 363057 | 27858 |
| EPB41L4B | 095203 | 374566 | 6601 | 363694 | 27859 |
| EPB41L4B | 095203 | 374557 | 6602 | 363685 | 27860 |
| EPHA3 | 044524 | 336596 | 6603 | 337451 | 27861 |
| EPHA3 | 044524 | 452448 | 6604 | 399926 | 27862 |
| EPHA3 | 044524 | 494014 | 6605 | 419190 | 27863 |
| EPHA4 | 116106 | 469354 | 6606 | N/A | |
| EPHA4 | 116106 | 472696 | 6607 | N/A | |
| EPHA4 | 116106 | 409854 | 6608 | 386276 | 27864 |
| EPHA4 | 116106 | 409938 | 6609 | 386829 | 27865 |
| EPHA4 | 116106 | 424339 | 6610 | 408145 | 27866 |
| EPHA4 | 116106 | 495693 | 6611 | N/A | |
| EPHA4 | 116106 | 443796 | 6612 | 395917 | 27867 |
| EPHA4 | 116106 | 441679 | 6613 | 401405 | 27868 |
| EPHA4 | 116106 | 463046 | 6614 | N/A | |
| EPHA4 | 116106 | 415749 | 6615 | 391517 | 27869 |
| EPHA4 | 116106 | 419964 | 6616 | 410158 | 27870 |
| EPHA4 | 116106 | 541600 | 6617 | 444085 | 27871 |
| EPHA4 | 116106 | 434266 | 6618 | 404089 | 27872 |
| EPHA4 | 116106 | 281821 | 6619 | 281821 | 27873 |
| EPHA6 | 080224 | 470610 | 6620 | 420598 | 27874 |
| EPHA6 | 080224 | 389672 | 6621 | 374323 | 27875 |
| EPHA6 | 080224 | 506569 | 6622 | 425132 | 27876 |
| EPHA6 | 080224 | 503760 | 6623 | 421260 | 27877 |
| EPHA6 | 080224 | 477384 | 6624 | 419470 | 27878 |
| EPHA6 | 080224 | 514100 | 6625 | 421711 | 27879 |
| EPHA6 | 080224 | 508345 | 6626 | 424638 | 27880 |
| EPHA6 | 080224 | 502694 | 6627 | 423950 | 27881 |
| EPHA6 | 080224 | 506349 | 6628 | 421353 | 27882 |
| EPHB1 | 154928 | 467013 | 6629 | N/A | |
| EPHB1 | 154928 | 472904 | 6630 | N/A | |
| EPHB1 | 154928 | 467708 | 6631 | N/A | |
| EPHB1 | 154928 | 460895 | 6632 | 417435 | 27883 |
| EPHB1 | 154928 | 482618 | 6633 | 420338 | 27884 |
| EPHB1 | 154928 | 398015 | 6634 | 381097 | 27885 |
| EPHB1 | 154928 | 488154 | 6635 | N/A | |
| EPHB1 | 154928 | 497173 | 6636 | 419688 | 27886 |
| EPHB1 | 154928 | 473867 | 6637 | 417216 | 27887 |
| EPHB1 | 154928 | 474732 | 6638 | 418352 | 27888 |
| EPHB1 | 154928 | 493838 | 6639 | 419574 | 27889 |
| EPHB1 | 154928 | 488992 | 6640 | N/A | |
| EPHB4 | 196411 | 360620 | 6641 | 353833 | 27890 |
| EPHB4 | 196411 | 358173 | 6642 | 350896 | 27891 |
| EPHB4 | 196411 | 487222 | 6643 | N/A | |
| EPHB4 | 196411 | 492403 | 6644 | N/A | |
| EPHB4 | 196411 | 478459 | 6645 | N/A | |
| EPHB4 | 196411 | 467515 | 6646 | N/A | |
| EPHB4 | 196411 | 477446 | 6647 | N/A | |
| EPHB4 | 196411 | 489808 | 6648 | N/A | |
| EPHB4 | 196411 | 492878 | 6649 | N/A | |
| EPHB4 | 196411 | 616502 | 6650 | 482702 | 27892 |
| EPN1 | 063245 | 270460 | 6651 | 270460 | 27893 |
| EPN1 | 063245 | 085079 | 6652 | 085079 | 27894 |
| EPN1 | 063245 | 411543 | 6653 | 406209 | 27895 |
| EPN1 | 063245 | 591743 | 6654 | N/A | |
| EPN1 | 063245 | 586194 | 6655 | N/A | |
| EPN1 | 063245 | 589704 | 6656 | 466593 | 27896 |
| EPN1 | 063245 | 587937 | 6657 | N/A | |
| EPS15 | 085832 | 371730 | 6658 | 360795 | 27897 |
| EPS15 | 085832 | 371733 | 6659 | 360798 | 27898 |
| EPS15 | 085832 | 486505 | 6660 | N/A | |
| EPS15 | 085832 | 478657 | 6661 | N/A | |
| EPS15 | 085832 | 493793 | 6662 | N/A | |
| EPS15 | 085832 | 371727 | 6663 | N/A | |
| EPS15 | 085832 | 464478 | 6664 | N/A | |
| EPS15 | 085832 | 471391 | 6665 | N/A | |
| EPS15 | 085832 | 465467 | 6666 | 474739 | 27899 |
| ERBB3 | 065361 | 549282 | 6667 | 448636 | 27900 |

-continued

-continued

| Symbol | ENSG | ENST | SEQ ID | ENSP | SEQ ID |
|---|---|---|---|---|---|
| ERBB3 | 065361 | 549061 | 6668 | 449138 | 27901 |
| ERBB3 | 065361 | 267101 | 6669 | 267101 | 27902 |
| ERBB3 | 065361 | 411731 | 6670 | 415753 | 27903 |
| ERBB3 | 065361 | 550869 | 6671 | 448671 | 27904 |
| ERBB3 | 065361 | 551085 | 6672 | 448483 | 27905 |
| ERBB3 | 065361 | 546884 | 6673 | N/A | |
| ERBB3 | 065361 | 551242 | 6674 | 447510 | 27906 |
| ERBB3 | 065361 | 549672 | 6675 | 449713 | 27907 |
| ERBB3 | 065361 | 415288 | 6676 | 408340 | 27908 |
| ERBB3 | 065361 | 549472 | 6677 | N/A | |
| ERBB3 | 065361 | 546748 | 6678 | N/A | |
| ERBB3 | 065361 | 551176 | 6679 | N/A | |
| ERBB3 | 065361 | 549205 | 6680 | N/A | |
| ERBB3 | 065361 | 550828 | 6681 | 482073 | 27909 |
| ERBB3 | 065361 | 550070 | 6682 | 448946 | 27910 |
| ERBB3 | 065361 | 549644 | 6683 | N/A | |
| ERBB3 | 065361 | 553131 | 6684 | 449129 | 27911 |
| ERBB3 | 065361 | 548709 | 6685 | N/A | |
| ERBB3 | 065361 | 549832 | 6686 | 448729 | 27912 |
| ERBB3 | 065361 | 552691 | 6687 | N/A | |
| ERBB4 | 178568 | 342788 | 6688 | 342235 | 27913 |
| ERBB4 | 178568 | 436443 | 6689 | 403204 | 27914 |
| ERBB4 | 178568 | 484594 | 6690 | N/A | |
| ERBB4 | 178568 | 260943 | 6691 | 260943 | 27915 |
| ERBB4 | 178568 | 463121 | 6692 | N/A | |
| ERBB4 | 178568 | 484474 | 6693 | N/A | |
| ERBB4 | 178568 | 435846 | 6694 | 405564 | 27916 |
| ERBB4 | 178568 | 459774 | 6695 | N/A | |
| ERBB4 | 178568 | 402597 | 6696 | 385565 | 27917 |
| ERBIN | 112851 | 284037 | 6697 | 284037 | 27918 |
| ERBIN | 112851 | 380943 | 6698 | 370330 | 27919 |
| ERBIN | 112851 | 507490 | 6699 | N/A | |
| ERBIN | 112851 | 416865 | 6700 | 397833 | 27920 |
| ERBIN | 112851 | 380938 | 6701 | 370325 | 27921 |
| ERBIN | 112851 | 511297 | 6702 | 422766 | 27922 |
| ERBIN | 112851 | 506030 | 6703 | 426632 | 27923 |
| ERBIN | 112851 | 508515 | 6704 | 422015 | 27924 |
| ERBIN | 112851 | 507128 | 6705 | N/A | |
| ERBIN | 112851 | 515185 | 6706 | N/A | |
| ERBIN | 112851 | 511671 | 6707 | 425728 | 27925 |
| ERBIN | 112851 | 503913 | 6708 | N/A | |
| ERBIN | 112851 | 512354 | 6709 | 423959 | 27926 |
| ERBIN | 112851 | 505822 | 6710 | N/A | |
| ERBIN | 112851 | 509946 | 6711 | N/A | |
| ERBIN | 112851 | 506744 | 6712 | N/A | |
| ERBIN | 112851 | 380935 | 6713 | 370322 | 27927 |
| ERC2 | 187672 | 288221 | 6714 | 288221 | 27928 |
| ERC2 | 187672 | 486496 | 6715 | N/A | |
| ERC2 | 187672 | 484530 | 6716 | N/A | |
| ERC2 | 187672 | 473469 | 6717 | N/A | |
| ERC2 | 187672 | 469720 | 6718 | N/A | |
| ERC2 | 187672 | 460849 | 6719 | 417445 | 27929 |
| ERC2 | 187672 | 468118 | 6720 | N/A | |
| ERC2 | 187672 | 487287 | 6721 | N/A | |
| ERC2 | 187672 | 466358 | 6722 | N/A | |
| ERC2 | 187672 | 492584 | 6723 | 417280 | 27930 |
| ERC2 | 187672 | 484857 | 6724 | N/A | |
| ERC2 | 187672 | 477381 | 6725 | N/A | |
| ERC2 | 187672 | 472917 | 6726 | N/A | |
| ERC2 | 187672 | 612797 | 6727 | 483127 | 27931 |
| ERGIC1 | 113719 | 393784 | 6728 | 377374 | 27932 |
| ERGIC1 | 113719 | 519860 | 6729 | 489795 | 27933 |
| ERGIC1 | 113719 | 520326 | 6730 | N/A | |
| ERGIC1 | 113719 | 520642 | 6731 | 428064 | 27934 |
| ERGIC1 | 113719 | 523291 | 6732 | 427713 | 27935 |
| ERGIC1 | 113719 | 518247 | 6733 | 429501 | 27936 |
| ERGIC1 | 113719 | 326654 | 6734 | 325127 | 27937 |
| ERGIC1 | 113719 | 519567 | 6735 | N/A | |
| ERGIC1 | 113719 | 519796 | 6736 | 428116 | 27938 |
| ERGIC1 | 113719 | 523650 | 6737 | N/A | |
| ERGIC1 | 113719 | 521392 | 6738 | N/A | |
| ERGIC1 | 113719 | 523366 | 6739 | N/A | |
| ERGIC1 | 113719 | 520399 | 6740 | N/A | |
| ERGIC1 | 113719 | 523215 | 6741 | N/A | |
| ERICH5 | 177459 | 318528 | 6742 | 315614 | 27939 |
| ERICH5 | 177459 | 545282 | 6743 | 440297 | 27940 |

| Symbol | ENSG | ENST | SEQ ID | ENSP | SEQ ID |
|---|---|---|---|---|---|
| ERMN | 136541 | 410096 | 6744 | 387047 | 27941 |
| ERMN | 136541 | 397283 | 6745 | 380453 | 27942 |
| ERMN | 136541 | 409395 | 6746 | 387339 | 27943 |
| ERMN | 136541 | 420719 | 6747 | 410646 | 27944 |
| ERMN | 136541 | 420317 | 6748 | 398149 | 27945 |
| ERMN | 136541 | 411762 | 6749 | 389595 | 27946 |
| ERMN | 136541 | 409216 | 6750 | 387049 | 27947 |
| ERMN | 136541 | 409925 | 6751 | 387325 | 27948 |
| ERMN | 136541 | 419116 | 6752 | 410934 | 27949 |
| ESRRB | 119715 | 512784 | 6753 | 424992 | 27950 |
| ESRRB | 119715 | 505752 | 6754 | 423004 | 27951 |
| ESRRB | 119715 | 507951 | 6755 | N/A | |
| ESRRB | 119715 | 380887 | 6756 | 370270 | 27952 |
| ESRRB | 119715 | 556177 | 6757 | 451658 | 27953 |
| ESRRB | 119715 | 509323 | 6758 | N/A | |
| ESRRB | 119715 | 611036 | 6759 | N/A | |
| ESRRB | 119715 | 509242 | 6760 | 422488 | 27954 |
| ERRFI1 | 116285 | 474874 | 6761 | 466958 | 27955 |
| ERRFI1 | 116285 | 377482 | 6762 | 366702 | 27956 |
| ERRFI1 | 116285 | 467067 | 6763 | 465100 | 27957 |
| ERRFI1 | 116285 | 469499 | 6764 | 466454 | 27958 |
| ERRFI1 | 116285 | 487559 | 6765 | 467030 | 27959 |
| ESRRG | 196482 | 366940 | 6766 | 355907 | 27960 |
| ESRRG | 196482 | 366937 | 6767 | 355904 | 27961 |
| ESRRG | 196482 | 408911 | 6768 | 386171 | 27962 |
| ESRRG | 196482 | 360012 | 6769 | 353108 | 27963 |
| ESRRG | 196482 | 361395 | 6770 | 354584 | 27964 |
| ESRRG | 196482 | 366938 | 6771 | 355905 | 27965 |
| ESRRG | 196482 | 359162 | 6772 | 352077 | 27966 |
| ESRRG | 196482 | 493603 | 6773 | 419594 | 27967 |
| ESRRG | 196482 | 463665 | 6774 | 418629 | 27968 |
| ESRRG | 196482 | 487276 | 6775 | 419155 | 27969 |
| ESRRG | 196482 | 493748 | 6776 | 417374 | 27970 |
| ESRRG | 196482 | 475275 | 6777 | 419514 | 27971 |
| ESRRG | 196482 | 586199 | 6778 | 466343 | 27972 |
| ESRRG | 196482 | 469486 | 6779 | 417900 | 27973 |
| ESRRG | 196482 | 459955 | 6780 | 420370 | 27974 |
| ESRRG | 196482 | 481543 | 6781 | 418895 | 27975 |
| ESRRG | 196482 | 469913 | 6782 | N/A | |
| ESRRG | 196482 | 477799 | 6783 | N/A | |
| ESRRG | 196482 | 471371 | 6784 | N/A | |
| ESRRG | 196482 | 488947 | 6785 | N/A | |
| ESRRG | 196482 | 459825 | 6786 | N/A | |
| ESRRG | 196482 | 616180 | 6787 | 481528 | 27976 |
| ESRRG | 196482 | 391890 | 6788 | 375761 | 27977 |
| ESRRG | 196482 | 361525 | 6789 | 355225 | 27978 |
| ESYT2 | 117868 | 251527 | 6790 | 251527 | 27979 |
| ESYT2 | 117868 | 275418 | 6791 | 275418 | 27980 |
| ESYT2 | 117868 | 435514 | 6792 | N/A | |
| ESYT2 | 117868 | 483958 | 6793 | N/A | |
| ESYT2 | 117868 | 497111 | 6794 | N/A | |
| ESYT2 | 117868 | 613624 | 6795 | 481296 | 27981 |
| ETF1 | 120705 | 499810 | 6796 | 421288 | 27982 |
| ETF1 | 120705 | 360541 | 6797 | 353741 | 27983 |
| ETF1 | 120705 | 503014 | 6798 | 422203 | 27984 |
| ETF1 | 120705 | 506345 | 6799 | N/A | |
| ETF1 | 120705 | 512198 | 6800 | 422272 | 27985 |
| ETF1 | 120705 | 503183 | 6801 | N/A | |
| ETF1 | 120705 | 572514 | 6802 | 461082 | 27986 |
| ETF1 | 120705 | 507939 | 6803 | 425689 | 27987 |
| ETF1 | 120705 | 514005 | 6804 | N/A | |
| KIAA1217 | 120549 | 376462 | 6805 | 365645 | 27988 |
| KIAA1217 | 120549 | 481700 | 6806 | N/A | |
| KIAA1217 | 120549 | 636305 | 6807 | 489926 | 27989 |
| KIAA1217 | 120549 | 376456 | 6808 | 365639 | 27990 |
| KIAA1217 | 120549 | 376454 | 6809 | 365637 | 27991 |
| KIAA1217 | 120549 | 635504 | 6810 | 489052 | 27992 |
| KIAA1217 | 120549 | 438429 | 6811 | 404798 | 27993 |
| KIAA1217 | 120549 | 307544 | 6812 | 302343 | 27994 |
| KIAA1217 | 120549 | 396494 | 6813 | 379723 | 27995 |
| KIAA1217 | 120549 | 396445 | 6814 | 379722 | 27996 |
| KIAA1217 | 120549 | 376451 | 6815 | 365634 | 27997 |
| KIAA1217 | 120549 | 460373 | 6816 | N/A | |
| KIAA1217 | 120549 | 635163 | 6817 | 489575 | 27998 |
| KIAA1217 | 120549 | 492009 | 6818 | N/A | |
| KIAA1217 | 120549 | 458595 | 6819 | 392625 | 27999 |

-continued

-continued

| Symbol | ENSG | ENST | SEQ ID | ENSP | SEQ ID |
|---|---|---|---|---|---|
| KIAA1217 | 120549 | 376452 | 6820 | 365635 | 28000 |
| KIAA1217 | 120549 | 430453 | 6821 | 389680 | 28001 |
| ETNPPL | 164089 | 296486 | 6822 | 296486 | 28002 |
| ETNPPL | 164089 | 411864 | 6823 | 392269 | 28003 |
| ETNPPL | 164089 | 512646 | 6824 | 427065 | 28004 |
| ETNPPL | 164089 | 510706 | 6825 | 423240 | 28005 |
| ETNPPL | 164089 | 503912 | 6826 | N/A | |
| ETNPPL | 164089 | 505233 | 6827 | 422050 | 28006 |
| ETNPPL | 164089 | 511923 | 6828 | N/A | |
| ETNPPL | 164089 | 509402 | 6829 | 426871 | 28007 |
| ETNPPL | 164089 | 512320 | 6830 | 421217 | 28008 |
| ETNPPL | 164089 | 510723 | 6831 | 426525 | 28009 |
| ETS1 | 134954 | 392668 | 6832 | 376436 | 28010 |
| ETS1 | 134954 | 526145 | 6833 | 433500 | 28011 |
| ETS1 | 134954 | 531611 | 6834 | 435666 | 28012 |
| ETS1 | 134954 | 319397 | 6835 | 324578 | 28013 |
| ETS1 | 134954 | 530924 | 6836 | N/A | |
| ETS1 | 134954 | 608978 | 6837 | 476649 | 28014 |
| ETS1 | 134954 | 525404 | 6838 | N/A | |
| ETS1 | 134954 | 527676 | 6839 | N/A | |
| ETS1 | 134954 | 535549 | 6840 | 441430 | 28015 |
| ETV1 | 006468 | 430479 | 6841 | 405327 | 28016 |
| ETV1 | 006468 | 405192 | 6842 | 385381 | 28017 |
| ETV1 | 006468 | 405358 | 6843 | 384085 | 28018 |
| ETV1 | 006468 | 403527 | 6844 | 384138 | 28019 |
| ETV1 | 006468 | 405218 | 6845 | 385551 | 28020 |
| ETV1 | 006468 | 443137 | 6846 | 413836 | 28021 |
| ETV1 | 006468 | 403685 | 6847 | 385686 | 28022 |
| ETV1 | 006468 | 493831 | 6848 | N/A | |
| ETV1 | 006468 | 472931 | 6849 | N/A | |
| ETV1 | 006468 | 438956 | 6850 | 393078 | 28023 |
| ETV1 | 006468 | 476720 | 6851 | N/A | |
| ETV1 | 006468 | 443608 | 6852 | 394710 | 28024 |
| ETV1 | 006468 | 497115 | 6853 | N/A | |
| ETV1 | 006468 | 476355 | 6854 | N/A | |
| ETV1 | 006468 | 421381 | 6855 | 391043 | 28025 |
| ETV1 | 006468 | 431887 | 6856 | 410819 | 28026 |
| ETV1 | 006468 | 460438 | 6857 | N/A | |
| ETV1 | 006468 | 483075 | 6858 | N/A | |
| ETV1 | 006468 | 433547 | 6859 | 406931 | 28027 |
| ETV1 | 006468 | 485475 | 6860 | N/A | |
| ETV1 | 006468 | 420159 | 6861 | 411626 | 28028 |
| ETV1 | 006468 | 242066 | 6862 | 242066 | 28029 |
| ETV1 | 006468 | 399357 | 6863 | 382293 | 28030 |
| ETV3 | 117036 | 326786 | 6864 | 327316 | 28031 |
| ETV3 | 117036 | 460850 | 6865 | N/A | |
| ETV3 | 117036 | 368192 | 6866 | 357175 | 28032 |
| ETV4 | 175832 | 319349 | 6867 | 321835 | 28033 |
| ETV4 | 175832 | 393664 | 6868 | 377273 | 28034 |
| ETV4 | 175832 | 545954 | 6869 | 440023 | 28035 |
| ETV4 | 175832 | 545089 | 6870 | 441749 | 28036 |
| ETV4 | 175832 | 591713 | 6871 | 465718 | 28037 |
| ETV4 | 175832 | 586826 | 6872 | 468636 | 28038 |
| ETV4 | 175832 | 590236 | 6873 | N/A | |
| ETV4 | 175832 | 585508 | 6874 | N/A | |
| ETV4 | 175832 | 587151 | 6875 | N/A | |
| ETV4 | 175832 | 586764 | 6876 | 466673 | 28039 |
| ETV4 | 175832 | 538265 | 6877 | 443846 | 28040 |
| ETV5 | 244405 | 306376 | 6878 | 306894 | 28041 |
| ETV5 | 244405 | 434744 | 6879 | 413755 | 28042 |
| ETV5 | 244405 | 480706 | 6880 | N/A | |
| ETV5 | 244405 | 433149 | 6881 | 399707 | 28043 |
| ETV5 | 244405 | 489830 | 6882 | N/A | |
| ETV5 | 244405 | 484223 | 6883 | N/A | |
| ETV5 | 244405 | 472868 | 6884 | N/A | |
| ETV5 | 244405 | 440773 | 6885 | 389707 | 28044 |
| ETV5 | 244405 | 421809 | 6886 | 412171 | 28045 |
| ETV5 | 244405 | 413301 | 6887 | 405157 | 28016 |
| ETV5 | 244405 | 422039 | 6888 | 388737 | 28047 |
| ETV5 | 244405 | 476890 | 6889 | N/A | |
| ETV5 | 244405 | 475484 | 6890 | N/A | |
| ETV5 | 244405 | 495808 | 6891 | N/A | |
| EVA1A | 115363 | 490746 | 6892 | N/A | |
| EVA1A | 115363 | 485891 | 6893 | N/A | |
| EVA1A | 115363 | 393913 | 6894 | 377490 | 28048 |
| EVA1A | 115363 | 410113 | 6895 | 386435 | 28049 |

| Symbol | ENSG | ENST | SEQ ID | ENSP | SEQ ID |
|---|---|---|---|---|---|
| EVA1A | 115363 | 410010 | 6896 | 386835 | 28050 |
| EVA1A | 115363 | 410071 | 6897 | 386930 | 28051 |
| EVA1A | 115363 | 432649 | 6898 | 398249 | 28052 |
| EVA1A | 115363 | 452003 | 6899 | 388105 | 28053 |
| EVA1A | 115363 | 486696 | 6900 | N/A | |
| EVA1A | 115363 | 486489 | 6901 | N/A | |
| EVA1A | 115363 | 233712 | 6902 | 233712 | 28054 |
| EXOSC4 | 178896 | 316052 | 6903 | 315476 | 28055 |
| EXOSC4 | 178896 | 525936 | 6904 | 432661 | 28056 |
| EXOSC4 | 178896 | 527954 | 6905 | 436539 | 28057 |
| EXPH5 | 110723 | 265843 | 6906 | 265843 | 28058 |
| EXPH5 | 110723 | 525344 | 6907 | 432546 | 28059 |
| EXPH5 | 110723 | 526312 | 6908 | 432683 | 28060 |
| EXPH5 | 110723 | 533052 | 6909 | 446434 | 28061 |
| EXPH5 | 110723 | 524840 | 6910 | 482691 | 28062 |
| EXPH5 | 110723 | 531386 | 6911 | 433909 | 28063 |
| EXTL2 | 162694 | 370113 | 6912 | 359131 | 28064 |
| EXTL2 | 162694 | 370114 | 6913 | 359132 | 28065 |
| EXTL2 | 162694 | 450240 | 6914 | 403363 | 28066 |
| EXTL2 | 162694 | 416479 | 6915 | 392255 | 28067 |
| EXTL2 | 162694 | 494907 | 6916 | N/A | |
| EXTL2 | 162694 | 480774 | 6917 | N/A | |
| EXTL2 | 162694 | 535414 | 6918 | 444385 | 28068 |
| EYA1 | 104313 | 388742 | 6919 | 373394 | 28069 |
| EYA1 | 104313 | 465115 | 6920 | 428391 | 28070 |
| EYA1 | 104313 | 340726 | 6921 | 342626 | 28071 |
| EYA1 | 104313 | 303824 | 6922 | 303221 | 28072 |
| EYA1 | 104313 | 388741 | 6923 | 373393 | 28073 |
| EYA1 | 104313 | 388743 | 6924 | 373395 | 28074 |
| EYA1 | 104313 | 496494 | 6925 | N/A | |
| EYA1 | 104313 | 419131 | 6926 | 410176 | 28075 |
| EYA1 | 104313 | 493349 | 6927 | 428517 | 28076 |
| EYA1 | 104313 | 422295 | 6928 | N/A | |
| EYA1 | 104313 | 388740 | 6929 | 373392 | 28077 |
| EYS | 188107 | 503581 | 6930 | 424243 | 28078 |
| EYS | 188107 | 370621 | 6931 | 359655 | 28079 |
| EYS | 188107 | 398580 | 6932 | 381585 | 28080 |
| EYS | 188107 | 486069 | 6933 | N/A | |
| EYS | 188107 | 330816 | 6934 | N/A | |
| EYS | 188107 | 370615 | 6935 | N/A | |
| EYS | 188107 | 447127 | 6936 | N/A | |
| EYS | 188107 | 393380 | 6937 | 377042 | 28081 |
| EYS | 188107 | 342421 | 6938 | 341818 | 28082 |
| EYS | 188107 | 489873 | 6939 | N/A | |
| EYS | 188107 | 471279 | 6940 | 420530 | 28083 |
| F3 | 117525 | 334047 | 6941 | 334145 | 28084 |
| F3 | 117525 | 370207 | 6942 | 359226 | 28085 |
| F3 | 117525 | 478217 | 6943 | N/A | |
| F3 | 117525 | 480356 | 6944 | N/A | |
| FA2H | 103089 | 562145 | 6945 | N/A | |
| FA2H | 103089 | 219368 | 6946 | 219368 | 28086 |
| FA2H | 103089 | 567683 | 6947 | 455126 | 28087 |
| FA2H | 103089 | 569949 | 6948 | 464576 | 28088 |
| FA2H | 103089 | 618933 | 6949 | 479548 | 28089 |
| FAM102A | 167106 | 373095 | 6950 | 362187 | 28090 |
| FAM102A | 167106 | 465821 | 6951 | N/A | |
| FAM102A | 167106 | 373084 | 6952 | 362176 | 28091 |
| FAM102A | 167106 | 300434 | 6953 | N/A | |
| FAM102A | 167106 | 479828 | 6954 | N/A | |
| FAM102A | 167106 | 493175 | 6955 | N/A | |
| FAM102A | 167106 | 494606 | 6956 | N/A | |
| FAM102B | 162636 | 370035 | 6957 | 359052 | 28092 |
| FAM102B | 162636 | 405454 | 6958 | 386084 | 28093 |
| FAM102B | 162636 | 483371 | 6959 | N/A | |
| FAM107A | 168309 | 360997 | 6960 | 354270 | 28094 |
| FAM107A | 168309 | 394481 | 6961 | 377991 | 28095 |
| FAM107A | 168309 | 464064 | 6962 | 419529 | 28096 |
| FAM107A | 168309 | 474531 | 6963 | 419124 | 28097 |
| FAM107A | 168309 | 447756 | 6964 | 400858 | 28098 |
| FAM107A | 168309 | 465970 | 6965 | 418038 | 28099 |
| FAM107A | 168309 | 497310 | 6966 | N/A | |
| FAM107B | 065809 | 378470 | 6967 | 367731 | 28100 |
| FAM107B | 065809 | 181796 | 6968 | 181796 | 28101 |
| FAM107B | 065809 | 468747 | 6969 | 418120 | 28102 |
| FAM107B | 065809 | 378467 | 6970 | 367728 | 28103 |
| FAM107B | 065809 | 487335 | 6971 | 420273 | 28104 |

-continued

-continued

| Symbol | ENSG | ENST | SEQ ID | ENSP | SEQ ID |
|---|---|---|---|---|---|
| FAM107B | 065809 | 378465 | 6972 | 367726 | 28105 |
| FAM107B | 065809 | 378458 | 6973 | 367719 | 28106 |
| FAM107B | 065809 | 478076 | 6974 | 417782 | 28107 |
| FAM107B | 065809 | 378462 | 6975 | 367723 | 28108 |
| FAM107B | 065809 | 481209 | 6976 | 418365 | 28109 |
| FAM107B | 065809 | 475858 | 6977 | N/A | |
| FAM107B | 065809 | 496330 | 6978 | 418330 | 28110 |
| FAM107B | 065809 | 492700 | 6979 | N/A | |
| FAM107B | 065809 | 479731 | 6980 | 419603 | 28111 |
| FAM107B | 065809 | 468492 | 6981 | 420444 | 28112 |
| FAM107B | 065809 | 452706 | 6982 | 413676 | 28113 |
| FAM107B | 065809 | 489100 | 6983 | 420249 | 28114 |
| FAM107B | 065809 | 494865 | 6984 | 418395 | 28115 |
| FAM107B | 065809 | 475786 | 6985 | 417242 | 28116 |
| FAM107B | 065809 | 488576 | 6986 | 420314 | 28117 |
| FAM107B | 065809 | 474143 | 6987 | N/A | |
| FAM107B | 065809 | 442012 | 6988 | 397949 | 28118 |
| FAM107B | 065809 | 482277 | 6989 | 417845 | 28119 |
| FAM107B | 065809 | 472095 | 6990 | 419064 | 28120 |
| FAM107B | 065809 | 471815 | 6991 | N/A | |
| FAM107B | 065809 | 464952 | 6992 | N/A | |
| FAM107B | 065809 | 495292 | 6993 | N/A | |
| FAM107B | 065809 | 491458 | 6994 | N/A | |
| FAM107B | 065809 | 622567 | 6995 | 479842 | 28121 |
| FAM114A1 | 197712 | 510213 | 6996 | 422965 | 28122 |
| FAM114A1 | 197712 | 515037 | 6997 | 424115 | 28123 |
| FAM114A1 | 197712 | 358869 | 6998 | 351740 | 28124 |
| FAM114A1 | 197712 | 512889 | 6999 | N/A | |
| FAM114A1 | 197712 | 508737 | 7000 | N/A | |
| FAM114A1 | 197712 | 513966 | 7001 | N/A | |
| FAM117A | 121104 | 240364 | 7002 | 240364 | 28125 |
| FAM117A | 121104 | 513602 | 7003 | 465808 | 28126 |
| FAM117A | 121104 | 503573 | 7004 | 467070 | 28127 |
| FAM117A | 121104 | 511743 | 7005 | 427326 | 28128 |
| FAM117A | 121104 | 503855 | 7006 | N/A | |
| FAM117A | 121104 | 514018 | 7007 | N/A | |
| FAM117A | 121104 | 505159 | 7008 | N/A | |
| FAM117A | 121104 | 506156 | 7009 | 421412 | 28129 |
| FAM117A | 121104 | 515240 | 7010 | N/A | |
| FAM117A | 121104 | 509347 | 7011 | N/A | |
| FAM117A | 121104 | 503720 | 7012 | N/A | |
| FAM117A | 121104 | 514841 | 7013 | N/A | |
| FAM122C | 156500 | 495147 | 7014 | N/A | |
| FAM122C | 156500 | 370785 | 7015 | 359821 | 28130 |
| FAM122C | 156500 | 482240 | 7016 | N/A | |
| FAM122C | 156500 | 475361 | 7017 | N/A | |
| FAM122C | 156500 | 494709 | 7018 | N/A | |
| FAM122C | 156500 | 470657 | 7019 | N/A | |
| FAM122C | 156500 | 460216 | 7020 | N/A | |
| FAM122C | 156500 | 463842 | 7021 | N/A | |
| FAM122C | 156500 | 623326 | 7022 | 485120 | 28131 |
| FAM122C | 156500 | 370784 | 7023 | 359820 | 28132 |
| FAM122C | 156500 | 414371 | 7024 | 402477 | 28133 |
| FAM124A | 150510 | 615498 | 7025 | 481212 | 28134 |
| FAM124A | 150510 | 322475 | 7026 | 324625 | 28135 |
| FAM124A | 150510 | 280057 | 7027 | 280057 | 28136 |
| FAM124A | 150510 | 497449 | 7028 | N/A | |
| FAM131A | 175182 | 450976 | 7029 | 388551 | 28137 |
| FAM131A | 175182 | 418281 | 7030 | 414050 | 28138 |
| FAM131A | 175182 | 340957 | 7031 | 340974 | 28139 |
| FAM131A | 175182 | 433578 | 7032 | 399875 | 28140 |
| FAM131A | 175182 | 418768 | 7033 | 414913 | 28141 |
| FAM131A | 175182 | 639617 | 7034 | 491845 | 28142 |
| FAM131A | 175182 | 383847 | 7035 | 373360 | 28143 |
| FAM131A | 175182 | 497070 | 7036 | N/A | |
| FAM131A | 175182 | 453072 | 7037 | 390588 | 28144 |
| FAM131A | 175182 | 310585 | 7038 | 310135 | 28145 |
| FAM131A | 175182 | 487702 | 7039 | N/A | |
| RETREG1 | 154153 | 510362 | 7040 | 425089 | 28146 |
| RETREG1 | 154153 | 399793 | 7041 | 382691 | 28147 |
| RETREG1 | 154153 | 306320 | 7042 | 304642 | 28148 |
| RETREG1 | 154153 | 509977 | 7043 | N/A | |
| RETREG1 | 154153 | 506441 | 7044 | N/A | |
| RETREG1 | 154153 | 509048 | 7045 | N/A | |
| FAM135B | 147724 | 395297 | 7046 | 378710 | 28149 |
| FAM135B | 147724 | 482951 | 7047 | 429874 | 28150 |

| Symbol | ENSG | ENST | SEQ ID | ENSP | SEQ ID |
|---|---|---|---|---|---|
| FAM135B | 147724 | 276737 | 7048 | 276737 | 28151 |
| FAM135B | 147724 | 467365 | 7049 | 430088 | 28152 |
| FAM135B | 147724 | 395295 | 7050 | N/A | |
| FAM135B | 147724 | 160713 | 7051 | 160713 | 28153 |
| FAM135B | 147724 | 517849 | 7052 | N/A | |
| FAM135B | 147724 | 520380 | 7053 | 428017 | 28154 |
| FAM135B | 147724 | 520954 | 7054 | N/A | |
| FAM135B | 147724 | 520283 | 7055 | N/A | |
| FAM135B | 147724 | 523049 | 7056 | N/A | |
| FAM167A | 154319 | 284486 | 7057 | 284486 | 28155 |
| FAM167A | 154319 | 531564 | 7058 | N/A | |
| FAM167A | 154319 | 534308 | 7059 | 432232 | 28156 |
| FAM167A | 154319 | 527445 | 7060 | N/A | |
| FAM167A | 154319 | 528897 | 7061 | 436655 | 28157 |
| FAM167A | 154319 | 531804 | 7062 | 431951 | 28158 |
| FAM167A | 154319 | 528111 | 7063 | N/A | |
| FAM171B | 144369 | 304698 | 7064 | 304108 | 28159 |
| FAM171B | 144369 | 612606 | 7065 | 478477 | 28160 |
| TOGARAM2 | 189350 | 401723 | 7066 | 384897 | 28161 |
| TOGARAM2 | 189350 | 420297 | 7067 | 402415 | 28162 |
| TOGARAM2 | 189350 | 379558 | 7068 | 368876 | 28163 |
| TOGARAM2 | 189350 | 465300 | 7069 | N/A | |
| TOGARAM2 | 189350 | 440012 | 7070 | 396739 | 28164 |
| TOGARAM2 | 189350 | 460951 | 7071 | N/A | |
| TOGARAM2 | 189350 | 475900 | 7072 | N/A | |
| FAM196A | 188916 | 522781 | 7073 | 429763 | 28165 |
| FAM196A | 188916 | 424811 | 7074 | 428730 | 28166 |
| FAM196A | 188916 | 614311 | 7075 | 479733 | 28167 |
| FAM198B | 164125 | 585682 | 7076 | 465976 | 28168 |
| FAM198B | 164125 | 296530 | 7077 | 296530 | 28169 |
| FAM198B | 164125 | 393807 | 7078 | 377396 | 28170 |
| FAM198B | 164125 | 590648 | 7079 | 466811 | 28171 |
| FAM198B | 164125 | 592586 | 7080 | 465491 | 28172 |
| FAM198B | 164125 | 593260 | 7081 | 468648 | 28173 |
| FAM198B | 164125 | 589306 | 7082 | N/A | |
| FAM198B | 164125 | 592057 | 7083 | 466873 | 28174 |
| FAM198B | 164125 | 587787 | 7084 | 466595 | 28175 |
| FAM19A1 | 183662 | 478136 | 7085 | 418575 | 28176 |
| FAM19A1 | 183662 | 496687 | 7086 | 417496 | 28177 |
| FAM19A1 | 183662 | 491017 | 7087 | N/A | |
| FAM19A1 | 183662 | 617084 | 7088 | 485030 | 28178 |
| FAM19A4 | 163377 | 295569 | 7089 | 295569 | 28179 |
| FAM19A4 | 163377 | 495737 | 7090 | 419439 | 28180 |
| FAM19A4 | 163377 | 634242 | 7091 | 489092 | 28181 |
| FAM20A | 108950 | 226094 | 7092 | N/A | |
| FAM20A | 108950 | 592554 | 7093 | 468308 | 28182 |
| FAM20A | 108950 | 590873 | 7094 | 467884 | 28183 |
| FAM20A | 108950 | 375556 | 7095 | N/A | |
| FAM20A | 108950 | 590074 | 7096 | 464910 | 28184 |
| FAM20A | 108950 | 592847 | 7097 | N/A | |
| FAM20A | 108950 | 619787 | 7098 | 481085 | 28185 |
| FAM212B | 197852 | 527570 | 7099 | N/A | |
| FAM212B | 197852 | 357260 | 7100 | 349805 | 28186 |
| FAM212B | 197852 | 534365 | 7101 | 436075 | 28187 |
| FAM212B | 197852 | 444059 | 7102 | 408238 | 28188 |
| FAM212B | 197852 | 527621 | 7103 | 437205 | 28189 |
| FAM212B | 197852 | 412270 | 7104 | N/A | |
| FAM212B | 197852 | 527660 | 7105 | N/A | |
| FAM212B | 197852 | 625113 | 7106 | N/A | |
| FAM222B | 173065 | 577513 | 7107 | 463642 | 28190 |
| FAM222B | 173065 | 583522 | 7108 | 462540 | 28191 |
| FAM222B | 173065 | 581381 | 7109 | 463136 | 28192 |
| FAM222B | 173065 | 584059 | 7110 | 464019 | 28193 |
| FAM222B | 173065 | 579381 | 7111 | 464291 | 28194 |
| FAM222B | 173065 | 341217 | 7112 | 343115 | 28195 |
| FAM222B | 173065 | 577376 | 7113 | 464355 | 28196 |
| FAM222B | 173065 | 577682 | 7114 | 463278 | 28197 |
| FAM222B | 173065 | 581229 | 7115 | 464299 | 28198 |
| FAM222B | 173065 | 452648 | 7116 | 413645 | 28199 |
| FAM222B | 173065 | 583307 | 7117 | 463296 | 28200 |
| FAM222B | 173065 | 582059 | 7118 | 462251 | 28201 |
| FAM222B | 173065 | 583953 | 7119 | 463753 | 28202 |
| FAM222B | 173065 | 582266 | 7120 | 462534 | 28203 |
| FAM222B | 173065 | 581407 | 7121 | 462419 | 28204 |
| FAM43A | 185112 | 329759 | 7122 | 371397 | 28205 |
| FAM46A | 112773 | 412306 | 7123 | 401884 | 28206 |

-continued

-continued

| Symbol | ENSG | ENST | SEQ ID | ENSP | SEQ ID |
|---|---|---|---|---|---|
| EAM46A | 112773 | 369754 | 7124 | 358769 | 28207 |
| FAM46A | 112773 | 320172 | 7125 | 318298 | 28208 |
| FAM46A | 112773 | 369756 | 7126 | 358771 | 28209 |
| FAM46A | 112773 | 423467 | 7127 | 404872 | 28210 |
| FAM46C | 183508 | 369448 | 7128 | 358458 | 28211 |
| FAM49B | 153310 | 519824 | 7129 | 429150 | 28212 |
| FAM49B | 153310 | 522746 | 7130 | 428117 | 28213 |
| FAM49B | 153310 | 523509 | 7131 | 429802 | 28214 |
| FAM49B | 153310 | 401979 | 7132 | 384880 | 28215 |
| FAM49B | 153310 | 519110 | 7133 | 429078 | 28216 |
| FAM49B | 153310 | 523288 | 7134 | N/A | |
| FAM49B | 153310 | 522250 | 7135 | 429978 | 28217 |
| FAM49B | 153310 | 517654 | 7136 | 430674 | 28218 |
| FAM49B | 153310 | 519540 | 7137 | 429499 | 28219 |
| FAM49B | 153310 | 522941 | 7138 | 430433 | 28220 |
| FAM49B | 153310 | 520887 | 7139 | N/A | |
| FAM49B | 153310 | 517801 | 7140 | N/A | |
| FAM49B | 153310 | 519142 | 7141 | 430806 | 28221 |
| FAM49B | 153310 | 518879 | 7142 | N/A | |
| FAM49B | 153310 | 522702 | 7143 | N/A | |
| FAM49B | 153310 | 521223 | 7144 | N/A | |
| FAM49B | 153310 | 520204 | 7145 | 429051 | 28222 |
| FAM49B | 153310 | 518283 | 7146 | 430694 | 28223 |
| FAM49B | 153310 | 523993 | 7147 | 429074 | 28224 |
| FAM49B | 153310 | 520254 | 7148 | 430127 | 28225 |
| FAM49B | 153310 | 519020 | 7149 | 429659 | 28226 |
| FAM49B | 153310 | 518167 | 7150 | 427994 | 28227 |
| FAM49B | 153310 | 517672 | 7151 | 430434 | 28228 |
| FAM49B | 153310 | 519070 | 7152 | 429860 | 28229 |
| FAM49B | 153310 | 522361 | 7153 | 430412 | 28230 |
| FAM49B | 153310 | 518344 | 7154 | N/A | |
| FAM49B | 153310 | 523514 | 7155 | N/A | |
| FAM49B | 153310 | 518285 | 7156 | N/A | |
| FAM49B | 153310 | 615041 | 7157 | 483964 | 28231 |
| FAM49B | 153310 | 639004 | 7158 | 492779 | 28232 |
| FAM53A | 174137 | 489029 | 7159 | 423987 | 28233 |
| FAM53A | 174137 | 489363 | 7160 | 419044 | 28234 |
| FAM53A | 174137 | 461064 | 7161 | 418243 | 28235 |
| FAM53A | 174137 | 472884 | 7162 | 426260 | 28236 |
| FAM53A | 174137 | 467215 | 7163 | N/A | |
| FAM53A | 174137 | 463238 | 7164 | 417615 | 28237 |
| FAM53A | 174137 | 308132 | 7165 | 310057 | 28238 |
| FAM69A | 154511 | 370310 | 7166 | 359333 | 28239 |
| FAM69A | 154511 | 616709 | 7167 | 482718 | 28240 |
| FAM69A | 154511 | 613902 | 7168 | 484866 | 28241 |
| FAM69A | 154511 | 615519 | 7169 | 483279 | 28242 |
| FAM69A | 154511 | 613017 | 7170 | 482478 | 28243 |
| FAM83D | 101447 | 619301 | 7171 | 481110 | 28244 |
| FAM83D | 101447 | 619850 | 7172 | 481465 | 28245 |
| FAM84A | 162981 | 295092 | 7173 | 295092 | 28246 |
| FAM84A | 162981 | 331243 | 7174 | 330681 | 28247 |
| FAM84A | 162981 | 497769 | 7175 | N/A | |
| FAM84A | 162981 | 464947 | 7176 | N/A | |
| FAM89A | 182118 | 366654 | 7177 | 355614 | 28248 |
| FAM89A | 182118 | 494111 | 7178 | N/A | |
| FAM89A | 182118 | 466258 | 7179 | N/A | |
| FAM8A4P | 232730 | 435433 | 7180 | N/A | |
| FAM92B | 153789 | 539556 | 7181 | 443411 | 28249 |
| FAM92B | 153789 | 618669 | 7182 | 478373 | 28250 |
| FAM92B | 153789 | 629253 | 7183 | 487117 | 28251 |
| FAR2 | 064763 | 551451 | 7184 | 450117 | 28252 |
| FAR2 | 064763 | 536681 | 7185 | 443291 | 28253 |
| FAR2 | 064763 | 549080 | 7186 | N/A | |
| FAR2 | 064763 | 547411 | 7187 | N/A | |
| FAR2 | 064763 | 550541 | 7188 | N/A | |
| FAR2 | 064763 | 182377 | 7189 | 182377 | 28254 |
| FAR2 | 064763 | 547116 | 7190 | 449349 | 28255 |
| FAR2 | 064763 | 552137 | 7191 | 449436 | 28256 |
| FAR2 | 064763 | 551193 | 7192 | 449187 | 28257 |
| FAR2 | 064763 | 547759 | 7193 | 447467 | 28258 |
| FARP1 | 152767 | 595437 | 7194 | 471242 | 28259 |
| FARP1 | 152767 | 600648 | 7195 | N/A | |
| FARP1 | 152767 | 319562 | 7196 | 322926 | 28260 |
| FARP1 | 152767 | 596580 | 7197 | 490391 | 28261 |
| FARP1 | 152767 | 376581 | 7198 | 365765 | 28262 |
| FARP1 | 152767 | 598389 | 7199 | 469712 | 28263 |

| Symbol | ENSG | ENST | SEQ ID | ENSP | SEQ ID |
|---|---|---|---|---|---|
| FARP1 | 152767 | 601361 | 7200 | N/A | |
| FARP1 | 152767 | 595817 | 7201 | N/A | |
| FARP1 | 152767 | 427404 | 7202 | N/A | |
| FARP1 | 152767 | 601656 | 7203 | N/A | |
| FARP1 | 152767 | 602015 | 7204 | N/A | |
| FARP1 | 152767 | 598698 | 7205 | N/A | |
| FARP1 | 152767 | 599151 | 7206 | N/A | |
| FARP1 | 152767 | 601762 | 7207 | N/A | |
| FARP1 | 152767 | 595366 | 7208 | N/A | |
| FARP1 | 152767 | 596545 | 7209 | N/A | |
| FARP1 | 152767 | 602272 | 7210 | N/A | |
| FARP1 | 152767 | 598346 | 7211 | N/A | |
| FARP1 | 152767 | 602171 | 7212 | N/A | |
| FARP1 | 152767 | 596613 | 7213 | N/A | |
| FARP1 | 152767 | 601853 | 7214 | N/A | |
| FARP1 | 152767 | 600032 | 7215 | N/A | |
| FARP1 | 152767 | 596467 | 7216 | N/A | |
| FARP1 | 152767 | 595380 | 7217 | N/A | |
| FARP1 | 152767 | 601133 | 7218 | N/A | |
| FARP1 | 152767 | 593990 | 7219 | N/A | |
| FARP1 | 152767 | 594657 | 7220 | N/A | |
| FARP1 | 152767 | 457431 | 7221 | N/A | |
| FARP1 | 152767 | 599040 | 7222 | N/A | |
| FARP1 | 152767 | 602263 | 7223 | N/A | |
| FARP1 | 152767 | 601009 | 7224 | 472346 | 28264 |
| FARP1 | 152767 | 593548 | 7225 | N/A | |
| FARP1 | 152767 | 490389 | 7226 | N/A | |
| FARP1 | 152767 | 600190 | 7227 | N/A | |
| FARP1 | 152767 | 457029 | 7228 | N/A | |
| FARP1 | 152767 | 423063 | 7229 | 410930 | 28265 |
| FARP1 | 152767 | 596256 | 7230 | 469365 | 28266 |
| FARP1 | 152767 | 597777 | 7231 | N/A | |
| FARP1 | 152767 | 594346 | 7232 | N/A | |
| FARP1 | 152767 | 600380 | 7233 | N/A | |
| FARP1 | 152767 | 597596 | 7234 | N/A | |
| FARP1 | 152767 | 627049 | 7235 | 486285 | 28267 |
| FAT1 | 083857 | 441802 | 7236 | 406229 | 28268 |
| FAT1 | 083857 | 500085 | 7237 | N/A | |
| FAT1 | 083857 | 512772 | 7238 | 424157 | 28269 |
| FAT1 | 083857 | 507105 | 7239 | 423801 | 28270 |
| FAT1 | 083857 | 509537 | 7240 | 421003 | 28271 |
| FAT1 | 083857 | 509927 | 7241 | 420869 | 28272 |
| FAT1 | 083857 | 507662 | 7242 | N/A | |
| FAT1 | 083857 | 512347 | 7243 | N/A | |
| FAT1 | 083857 | 503253 | 7244 | N/A | |
| FAT1 | 083857 | 508035 | 7245 | N/A | |
| FAT1 | 083857 | 509647 | 7246 | 423736 | 28273 |
| FAT1 | 083857 | 614102 | 7247 | 479573 | 28274 |
| FAT2 | 086570 | 520200 | 7248 | 429678 | 28275 |
| FAT2 | 086570 | 261800 | 7249 | 261800 | 28276 |
| FAT3 | 165323 | 525166 | 7250 | 432586 | 28277 |
| FAT3 | 165323 | 528921 | 7251 | N/A | |
| FAT3 | 165323 | 533797 | 7252 | 436399 | 28278 |
| FAT3 | 165323 | 489716 | 7253 | N/A | |
| FAT3 | 165323 | 469900 | 7254 | N/A | |
| FAT3 | 165323 | 409404 | 7255 | 387040 | 28279 |
| FAT3 | 282908 | 634703 | 7256 | 489369 | 28280 |
| FAT3 | 282908 | 634649 | 7257 | 489343 | 28281 |
| FAT3 | 282908 | 634625 | 7258 | N/A | |
| FAT3 | 282908 | 634743 | 7259 | 488913 | 28282 |
| FAT3 | 282908 | 634894 | 7260 | N/A | |
| FAT3 | 282908 | 634756 | 7261 | N/A | |
| FBLN2 | 163520 | 404922 | 7262 | 384169 | 28283 |
| FBLN2 | 163520 | 295760 | 7263 | 295760 | 28284 |
| FBLN2 | 163520 | 465610 | 7264 | 420164 | 28285 |
| FBLN2 | 163520 | 492059 | 7265 | 420042 | 28286 |
| FBLN2 | 163520 | 477845 | 7266 | N/A | |
| FBLN2 | 163520 | 295761 | 7267 | 295761 | 28287 |
| FBLN2 | 163520 | 421373 | 7268 | 399224 | 28288 |
| FBN1 | 166147 | 316623 | 7269 | 325527 | 28289 |
| FBN1 | 166147 | 559133 | 7270 | 453958 | 28290 |
| FBN1 | 166147 | 561429 | 7271 | N/A | |
| FBN1 | 166147 | 560720 | 7272 | N/A | |
| FBN1 | 166147 | 537463 | 7273 | 440294 | 28291 |
| FBN1 | 166147 | 560820 | 7274 | N/A | |
| FBN1 | 166147 | 560355 | 7275 | 453901 | 28292 |

-continued

| Symbol | ENSG | ENST | SEQ ID | ENSP | SEQ ID |
|---|---|---|---|---|---|
| FBN1 | 166147 | 558230 | 7276 | N/A | |
| FBN2 | 138829 | 508053 | 7277 | 424571 | 28293 |
| FBN2 | 138829 | 507835 | 7278 | 426839 | 28294 |
| FBN2 | 138829 | 508989 | 7279 | 425596 | 28295 |
| FBN2 | 138829 | 511489 | 7280 | N/A | |
| FBN2 | 138829 | 502468 | 7281 | 424753 | 28296 |
| FBN2 | 138829 | 514742 | 7282 | N/A | |
| FBN2 | 138829 | 262464 | 7283 | 262464 | 28297 |
| FBN2 | 138829 | 619499 | 7284 | 482132 | 28298 |
| FBXL21 | 164616 | 495672 | 7285 | N/A | |
| FBXL21 | 161616 | 635168 | 7286 | N/A | |
| FBXL21 | 164616 | 475169 | 7287 | N/A | |
| FBXL21 | 164616 | 472159 | 7288 | N/A | |
| FBXL21 | 164616 | 467490 | 7289 | N/A | |
| FBXL21 | 164616 | 297158 | 7290 | N/A | |
| FBXL21 | 164616 | 478939 | 7291 | N/A | |
| FBXL21 | 164616 | 498734 | 7292 | N/A | |
| FBXO24 | 106336 | 461079 | 7293 | 419587 | 28299 |
| FBXO24 | 106336 | 498195 | 7294 | N/A | |
| FBXO24 | 106336 | 241071 | 7295 | 241071 | 28300 |
| FBXO24 | 106336 | 488079 | 7296 | 418814 | 28301 |
| FBXO24 | 106336 | 474649 | 7297 | N/A | |
| FBXO24 | 106336 | 465843 | 7298 | 419602 | 28302 |
| FBXO24 | 106336 | 466053 | 7299 | 417179 | 28303 |
| FBXO24 | 106336 | 468962 | 7300 | 420239 | 28304 |
| FBXO24 | 106336 | 427939 | 7301 | 416558 | 28305 |
| FBXO32 | 156804 | 517956 | 7302 | 428205 | 28306 |
| FBXO32 | 156804 | 524000 | 7303 | N/A | |
| FBXO32 | 156804 | 287396 | 7304 | N/A | |
| FBXO32 | 156804 | 443022 | 7305 | 390790 | 28307 |
| FBXO32 | 156804 | 521719 | 7306 | N/A | |
| FBXO32 | 156804 | 520511 | 7307 | N/A | |
| FBXW5 | 159069 | 487794 | 7308 | 485109 | 28308 |
| FBXW5 | 159069 | 325285 | 7309 | 313034 | 28309 |
| FBXW5 | 159069 | 483559 | 7310 | N/A | |
| FBXW5 | 159069 | 459905 | 7311 | N/A | |
| FBXW5 | 159069 | 480818 | 7312 | N/A | |
| FBXW5 | 159069 | 491246 | 7313 | 485322 | 28310 |
| FBXW5 | 159069 | 428398 | 7314 | 404829 | 28311 |
| FBXW5 | 159069 | 443788 | 7315 | 394011 | 28312 |
| FBXW9 | 132004 | 587296 | 7316 | 465854 | 28313 |
| FBXW9 | 132004 | 393261 | 7317 | 376945 | 28314 |
| FBXW9 | 132004 | 587955 | 7318 | 465387 | 28315 |
| FCER2 | 104921 | 597312 | 7319 | N/A | |
| FCER2 | 104921 | 346664 | 7320 | 264072 | 28316 |
| FCER2 | 104921 | 597921 | 7321 | 471974 | 28317 |
| FCER2 | 104921 | 598803 | 7322 | N/A | |
| FCER2 | 104921 | 597934 | 7323 | N/A | |
| FCER2 | 104921 | 593418 | 7324 | 472067 | 28318 |
| FCER2 | 104921 | 360067 | 7325 | 353178 | 28319 |
| FCHSD2 | 137478 | 311172 | 7326 | 308978 | 28320 |
| FCHSD2 | 137478 | 409314 | 7327 | 386987 | 28321 |
| FCHSD2 | 137478 | 409418 | 7328 | 386722 | 28322 |
| FCHSD2 | 137478 | 409263 | 7329 | 386903 | 28323 |
| FCHSD2 | 137478 | 458644 | 7330 | 402972 | 28324 |
| FCHSD2 | 137478 | 409853 | 7331 | 386314 | 28325 |
| FCHSD2 | 137478 | 432043 | 7332 | 406420 | 28326 |
| FCHSD2 | 137478 | 543644 | 7333 | 441616 | 28327 |
| FCHSD2 | 137478 | 422375 | 7334 | 408706 | 28328 |
| FDFT1 | 079459 | 530337 | 7335 | 431852 | 28329 |
| FDFT1 | 079459 | 220584 | 7336 | 220584 | 28330 |
| FDFT1 | 079459 | 446331 | 7337 | N/A | |
| FDFT1 | 079459 | 443614 | 7338 | 390367 | 28331 |
| FDFT1 | 079459 | 525283 | 7339 | 433985 | 28332 |
| FDFT1 | 079459 | 525607 | 7340 | 432551 | 28333 |
| FDFT1 | 079459 | 529464 | 7341 | 434770 | 28334 |
| FDFT1 | 079459 | 525900 | 7342 | 434714 | 28335 |
| FDFT1 | 079459 | 525571 | 7343 | N/A | |
| FDFT1 | 079459 | 527045 | 7344 | N/A | |
| FDFT1 | 079459 | 528812 | 7345 | 431749 | 28336 |
| FDFT1 | 079459 | 525551 | 7346 | N/A | |
| FDFT1 | 079459 | 530664 | 7347 | 432331 | 28337 |
| FDFT1 | 079459 | 525954 | 7348 | 491537 | 28338 |
| FDFT1 | 079459 | 531733 | 7349 | N/A | |
| FDFT1 | 079459 | 531249 | 7350 | N/A | |
| FDFT1 | 079459 | 532266 | 7351 | 435900 | 28339 |

-continued

| Symbol | ENSG | ENST | SEQ ID | ENSP | SEQ ID |
|---|---|---|---|---|---|
| FDFT1 | 079459 | 528643 | 7352 | 431649 | 28340 |
| FDFT1 | 079459 | 525777 | 7353 | 436069 | 28341 |
| FDFT1 | 079459 | 528729 | 7354 | N/A | |
| FDFT1 | 079459 | 529521 | 7355 | N/A | |
| FDFT1 | 079459 | 623368 | 7356 | 485229 | 28342 |
| FDFT1 | 079459 | 538689 | 7357 | 444248 | 28343 |
| FDFT1 | 079459 | 618539 | 7358 | 480828 | 28344 |
| FDFT1 | 079459 | 615631 | 7359 | 481481 | 28345 |
| FDFT1 | 079459 | 622850 | 7360 | 484122 | 28346 |
| FEM1C | 145780 | 274457 | 7361 | 274457 | 28347 |
| FERMT1 | 101311 | 478194 | 7362 | N/A | |
| FERMT1 | 101311 | 217289 | 7363 | 217289 | 28348 |
| FERMT1 | 101311 | 378844 | 7364 | 368121 | 28349 |
| FERMT1 | 101311 | 536936 | 7365 | 441063 | 28350 |
| FEZF2 | 153266 | 486811 | 7366 | 418589 | 28351 |
| FEZF2 | 153266 | 283268 | 7367 | 283268 | 28352 |
| FEZF2 | 153266 | 475839 | 7368 | 418804 | 28353 |
| FGD3 | 127084 | 375482 | 7369 | 364631 | 28354 |
| FGD3 | 127084 | 468206 | 7370 | N/A | |
| FGD3 | 127084 | 494669 | 7371 | N/A | |
| FGD3 | 127084 | 467786 | 7372 | 432310 | 28355 |
| FGD3 | 127084 | 494553 | 7373 | N/A | |
| FGD3 | 127084 | 488407 | 7374 | N/A | |
| FGD3 | 127084 | 416701 | 7375 | 413833 | 28356 |
| FGD3 | 127084 | 337352 | 7376 | 336914 | 28357 |
| FGD4 | 139132 | 534526 | 7377 | 449273 | 28358 |
| FGD4 | 139132 | 550091 | 7378 | N/A | |
| FGD4 | 139132 | 531134 | 7379 | 431323 | 28359 |
| FGD4 | 139132 | 472289 | 7380 | 434356 | 28360 |
| FGD4 | 139132 | 494275 | 7381 | N/A | |
| FGD4 | 139132 | 497153 | 7382 | N/A | |
| FGD4 | 139132 | 493087 | 7383 | 437109 | 28361 |
| FGD4 | 139132 | 551984 | 7384 | 449614 | 28362 |
| FGD4 | 139132 | 427716 | 7385 | 394487 | 28363 |
| FGD4 | 139132 | 473513 | 7386 | N/A | |
| FGD4 | 139132 | 395740 | 7387 | 379089 | 28364 |
| FGD4 | 139132 | 479023 | 7388 | N/A | |
| FGD4 | 139132 | 546442 | 7389 | 446695 | 28365 |
| FGD4 | 139132 | 583694 | 7390 | 462623 | 28366 |
| FGD4 | 139132 | 525053 | 7391 | 433666 | 28367 |
| FGD4 | 139132 | 494977 | 7392 | 434062 | 28368 |
| FGD6 | 180263 | 343958 | 7393 | 344446 | 28369 |
| FGD6 | 180263 | 548069 | 7394 | 448350 | 28370 |
| FGD6 | 180263 | 451107 | 7395 | 408291 | 28371 |
| FGD6 | 180263 | 546711 | 7396 | 450342 | 28372 |
| FGD6 | 180263 | 551521 | 7397 | 450240 | 28373 |
| FGD6 | 180263 | 549499 | 7398 | 449005 | 28374 |
| FGD6 | 180263 | 550368 | 7399 | N/A | |
| FGF13 | 129682 | 315930 | 7400 | 322390 | 28375 |
| FGF13 | 129682 | 305414 | 7401 | 303391 | 28376 |
| FGF13 | 129682 | 441825 | 7402 | 409276 | 28377 |
| FGF13 | 129682 | 626909 | 7403 | 487411 | 28378 |
| FGF13 | 129682 | 436198 | 7404 | 396198 | 28379 |
| FGF13 | 129682 | 455663 | 7405 | 406916 | 28380 |
| FGF13 | 129682 | 448673 | 7406 | 411999 | 28381 |
| FGF13 | 129682 | 421460 | 7407 | 388688 | 28382 |
| FGF3 | 186895 | 334134 | 7408 | 334122 | 28383 |
| FGF5 | 138675 | 312465 | 7409 | 311697 | 28384 |
| FGF5 | 138675 | 456523 | 7410 | 398353 | 28385 |
| FGF5 | 138675 | 380628 | 7411 | N/A | |
| FGF5 | 138675 | 507780 | 7412 | 423903 | 28386 |
| FGF5 | 138675 | 503413 | 7413 | N/A | |
| FGFBP3 | 174721 | 311575 | 7414 | 339067 | 28387 |
| FGFR1 | 077782 | 397091 | 7415 | 380280 | 28388 |
| FGFR1 | 077782 | 532791 | 7416 | 432972 | 28389 |
| FGFR1 | 077782 | 526688 | 7417 | N/A | |
| FGFR1 | 077782 | 397113 | 7418 | 380302 | 28390 |
| FGFR1 | 077782 | 356207 | 7419 | 348537 | 28391 |
| FGFR1 | 077782 | 335922 | 7420 | 337247 | 28392 |
| FGFR1 | 077782 | 326324 | 7421 | 327229 | 28393 |
| FGFR1 | 077782 | 526570 | 7422 | N/A | |
| FGFR1 | 077782 | 397103 | 7423 | 380292 | 28394 |
| FGFR1 | 077782 | 531196 | 7424 | 434800 | 28395 |
| FGFR1 | 077782 | 397108 | 7425 | 380297 | 28396 |
| FGFR1 | 077782 | 533619 | 7426 | N/A | |
| FGFR1 | 077782 | 527114 | 7427 | N/A | |

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| FGFR1 | 077782 | 487647 | 7428 | 435254 | 28397 | | FGGY | 172456 | 635297 | 7504 | 489549 | 28448 |
| FGFR1 | 077782 | 466021 | 7429 | N/A | | | FGGY | 172456 | 634399 | 7505 | 489146 | 28449 |
| FGFR1 | 077782 | 527745 | 7430 | N/A | | | FGGY | 172456 | 635156 | 7506 | 489417 | 28450 |
| FGFR1 | 077782 | 524528 | 7431 | N/A | | | FGGY | 172456 | 424725 | 7507 | 489345 | 28451 |
| FGFR1 | 077782 | 475621 | 7432 | N/A | | | FGGY | 172456 | 371212 | 7508 | 360256 | 28452 |
| FGFR1 | 077782 | 530701 | 7433 | N/A | | | FGGY | 172456 | 475949 | 7509 | N/A | |
| FGFR1 | 077782 | 464163 | 7434 | N/A | | | FGGY | 172456 | 485720 | 7510 | N/A | |
| FGFR1 | 077782 | 470826 | 7435 | N/A | | | FGGY | 172456 | 371210 | 7511 | 360254 | 28453 |
| FGFR1 | 077782 | 496296 | 7436 | N/A | | | FGGY | 172456 | 493891 | 7512 | N/A | |
| FGFR1 | 077782 | 527203 | 7437 | N/A | | | FGGY | 172456 | 466791 | 7513 | N/A | |
| FGFR1 | 077782 | 533668 | 7438 | 434869 | 28398 | | FGGY | 172456 | 476939 | 7514 | N/A | |
| FGFR1 | 077782 | 525001 | 7439 | 434712 | 28399 | | FGGY | 172456 | 472783 | 7515 | N/A | |
| FGFR1 | 077782 | 532386 | 7440 | N/A | | | FGGY | 172456 | 471169 | 7516 | N/A | |
| FGFR1 | 077782 | 474970 | 7441 | N/A | | | FGGY | 172456 | 480847 | 7517 | N/A | |
| FGFR1 | 077782 | 526742 | 7442 | 433569 | 28400 | | FHDC1 | 137460 | 511601 | 7518 | 427567 | 28454 |
| FGFR1 | 077782 | 529552 | 7443 | 435283 | 28401 | | FHDC1 | 137460 | 260008 | 7519 | 260008 | 28455 |
| FGFR1 | 077782 | 484370 | 7444 | 433163 | 28402 | | FHL3 | 183386 | 485803 | 7520 | N/A | |
| FGFR1 | 077782 | 530568 | 7445 | 434473 | 28403 | | FHL3 | 183386 | 373016 | 7521 | 362107 | 28456 |
| FGFR1 | 077782 | 434187 | 7446 | 392645 | 28404 | | FHL3 | 183386 | 475084 | 7522 | N/A | |
| FGFR1 | 077782 | 397090 | 7447 | N/A | | | FHL3 | 183386 | 477194 | 7523 | N/A | |
| FGFR1 | 077782 | 413133 | 7448 | 400708 | 28405 | | FHL3 | 183386 | 483132 | 7524 | N/A | |
| FGFR1 | 077782 | 440174 | 7449 | 398318 | 28406 | | FHL5 | 112214 | 450218 | 7525 | 396390 | 28457 |
| FGFR1 | 077782 | 496629 | 7450 | N/A | | | FHL5 | 112214 | 326771 | 7526 | 326022 | 28458 |
| FGFR1 | 077782 | 480571 | 7451 | N/A | | | FHL5 | 112214 | 541107 | 7527 | 442357 | 28459 |
| FGFR1 | 077782 | 425967 | 7452 | 393312 | 28407 | | FHOD3 | 134775 | 257209 | 7528 | 257209 | 28460 |
| FGFR1 | 077782 | 447712 | 7453 | 400162 | 28408 | | FHOD3 | 134775 | 589114 | 7529 | N/A | |
| FGFR1 | 077782 | 619564 | 7454 | 484553 | 28409 | | FHOD3 | 134775 | 590592 | 7530 | 466937 | 28461 |
| FGFR1 | 077782 | 341462 | 7455 | 340636 | 28410 | | FHOD3 | 134775 | 359247 | 7531 | 352186 | 28462 |
| FGFR2 | 066468 | 358487 | 7456 | 351276 | 28411 | | FHOD3 | 134775 | 591635 | 7532 | 467195 | 28463 |
| FGFR2 | 066468 | 478859 | 7457 | 474011 | 28412 | | FHOD3 | 134775 | 592930 | 7533 | 468163 | 28464 |
| FGFR2 | 066468 | 638709 | 7458 | 491912 | 28413 | | FHOD3 | 134775 | 587493 | 7534 | N/A | |
| FGFR2 | 066468 | 356226 | 7459 | 348559 | 28414 | | FHOD3 | 134775 | 592128 | 7535 | 467462 | 28465 |
| FGFR2 | 066468 | 369060 | 7460 | 358056 | 28415 | | FHOD3 | 134775 | 585579 | 7536 | 465843 | 28466 |
| FGFR2 | 066468 | 604236 | 7461 | 474109 | 28416 | | FIBIN | 176971 | 318627 | 7537 | 321962 | 28467 |
| FGFR2 | 066468 | 369059 | 7462 | 358055 | 28417 | | FIGN | 182263 | 409634 | 7538 | 386768 | 28468 |
| FGFR2 | 066468 | 467584 | 7463 | N/A | | | FIGN | 182263 | 333129 | 7539 | 333836 | 28469 |
| FGFR2 | 066468 | 429361 | 7464 | 404219 | 28418 | | FIGN | 182263 | 482917 | 7540 | N/A | |
| FGFR2 | 066468 | 346997 | 7465 | 263451 | 28419 | | FILIP1L | 168386 | 476723 | 7541 | N/A | |
| FGFR2 | 066468 | 457416 | 7466 | 410294 | 28420 | | FILIP1L | 168386 | 477258 | 7542 | 417617 | 28470 |
| FGFR2 | 066468 | 360144 | 7467 | 353262 | 28421 | | FILIP1L | 168386 | 354552 | 7543 | 346560 | 28471 |
| FGFR2 | 066468 | 369056 | 7468 | 358052 | 28422 | | FILIP1L | 168386 | 487087 | 7544 | 417774 | 28472 |
| FGFR2 | 066468 | 369058 | 7469 | 358054 | 28423 | | FILIP1L | 168386 | 471562 | 7545 | 419642 | 28473 |
| FGFR2 | 066468 | 336553 | 7470 | 337665 | 28424 | | FILIP1L | 168386 | 331335 | 7546 | 327880 | 28474 |
| FGFR2 | 066468 | 463870 | 7471 | N/A | | | FILIP1L | 168386 | 495625 | 7547 | 419874 | 28475 |
| FGFR2 | 066468 | 490349 | 7472 | N/A | | | FILIP1L | 168386 | 398326 | 7548 | 381371 | 28476 |
| FGFR2 | 066468 | 359354 | 7473 | 352309 | 28425 | | FILIP1L | 168386 | 468533 | 7549 | N/A | |
| FGFR2 | 066468 | 491475 | 7474 | N/A | | | FILIP1L | 168386 | 383694 | 7550 | 373192 | 28477 |
| FGFR2 | 066468 | 613324 | 7475 | 481464 | 28426 | | FJX1 | 179431 | 317811 | 7551 | 400223 | 28478 |
| FGFR2 | 066468 | 611527 | 7476 | 484892 | 28427 | | FJX1 | 179431 | 532914 | 7552 | N/A | |
| FGFR2 | 066468 | 636922 | 7477 | 490905 | 28428 | | FKBP4 | 004478 | 001008 | 7553 | 001008 | 28479 |
| FGFR2 | 066468 | 491111 | 7478 | N/A | | | FKBP4 | 004478 | 543769 | 7554 | 439703 | 28480 |
| FGFR2 | 066468 | 357555 | 7479 | 350166 | 28429 | | FKBP4 | 004478 | 540260 | 7555 | N/A | |
| FGFR2 | 066468 | 613048 | 7480 | 484154 | 28430 | | FKBP4 | 004478 | 538622 | 7556 | 446368 | 28481 |
| FGFR2 | 066468 | 369061 | 7481 | 358057 | 28431 | | FKBP4 | 004478 | 543037 | 7557 | N/A | |
| FGFR2 | 066468 | 351936 | 7482 | 309878 | 28432 | | FKBP4 | 004478 | 539181 | 7558 | 438491 | 28482 |
| FGFR3 | 068078 | 481110 | 7483 | 420533 | 28433 | | FKBP4 | 004478 | 544366 | 7559 | 442193 | 28483 |
| FGFR3 | 068078 | 260795 | 7484 | 260795 | 28434 | | FKBP4 | 004478 | 630279 | 7560 | 486800 | 28484 |
| FGFR3 | 068078 | 352904 | 7485 | 231803 | 28435 | | FKBP5 | 096060 | 357266 | 7561 | 349811 | 28485 |
| FGFR3 | 068078 | 507588 | 7486 | 427289 | 28436 | | FKBP5 | 096060 | 536438 | 7562 | 444810 | 28486 |
| FGFR3 | 068078 | 474521 | 7487 | N/A | | | FKBP5 | 096060 | 539068 | 7563 | 441205 | 28487 |
| FGFR3 | 068078 | 469068 | 7488 | N/A | | | FKBP5 | 096060 | 542713 | 7564 | 442340 | 28488 |
| FGFR3 | 068078 | 340107 | 7489 | 339824 | 28437 | | FLI1 | 151702 | 608303 | 7565 | 477262 | 28489 |
| FGFR3 | 068078 | 412135 | 7490 | 412903 | 28438 | | FLI1 | 151702 | 527767 | 7566 | 476428 | 28490 |
| FGFR3 | 068078 | 440486 | 7491 | 414914 | 28439 | | FLI1 | 151702 | 527786 | 7567 | 433488 | 28491 |
| FGFR3 | 068078 | 613647 | 7492 | 479472 | 28440 | | FLI1 | 151702 | 429175 | 7568 | 399985 | 28492 |
| FGGY | 172456 | 582567 | 7493 | 463260 | 28441 | | FLI1 | 151702 | 534087 | 7569 | 432950 | 28493 |
| FGGY | 172456 | 413489 | 7494 | 406607 | 28442 | | FLI1 | 151702 | 608055 | 7570 | N/A | |
| FGGY | 172456 | 634606 | 7495 | 489030 | 28443 | | FLI1 | 151702 | 528790 | 7571 | N/A | |
| FGGY | 172456 | 474476 | 7496 | N/A | | | FLI1 | 151702 | 344954 | 7572 | 339627 | 28494 |
| FGGY | 172456 | 462744 | 7497 | N/A | | | FLI1 | 151702 | 281428 | 7573 | 281428 | 28495 |
| FGGY | 172456 | 371218 | 7498 | 360262 | 28444 | | FLNB | 136068 | 490882 | 7574 | 420213 | 28496 |
| FGGY | 172456 | 495718 | 7499 | N/A | | | FLNB | 136068 | 295956 | 7575 | 295956 | 28497 |
| FGGY | 172456 | 583635 | 7500 | N/A | | | FLNB | 136068 | 358537 | 7576 | 351339 | 28498 |
| FGGY | 172456 | 303721 | 7501 | 305922 | 28445 | | FLNB | 136068 | 429972 | 7577 | 415599 | 28499 |
| FGGY | 172456 | 430447 | 7502 | 403425 | 28446 | | FLNB | 136068 | 493452 | 7578 | 418510 | 28500 |
| FGGY | 172456 | 634364 | 7503 | 489446 | 28447 | | FLNB | 136068 | 481470 | 7579 | N/A | |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| FLNB | 136068 | 491408 | 7580 | N/A | | 5 | FOSB | 125740 | 592811 | 7656 | 468482 | 28543 |
| FLNB | 136068 | 477629 | 7581 | N/A | | | FOSB | 125740 | 586113 | 7657 | N/A | |
| FLNB | 136068 | 466455 | 7582 | 420199 | 28501 | | FOSB | 125740 | 586615 | 7658 | 468207 | 28544 |
| FLNB | 136068 | 470231 | 7583 | 419954 | 28502 | | FOSB | 125740 | 589593 | 7659 | 465528 | 28545 |
| FLNB | 136068 | 468939 | 7584 | N/A | | | FOSB | 125740 | 587358 | 7660 | N/A | |
| FLNB | 136068 | 475487 | 7585 | N/A | | | FOSB | 125740 | 615753 | 7661 | 485018 | 28546 |
| FLNB | 136068 | 484981 | 7586 | N/A | | 10 | FOSL2 | 075426 | 460736 | 7662 | N/A | |
| FLNB | 136068 | 419752 | 7587 | 414532 | 28503 | | FOSL2 | 075426 | 379619 | 7663 | 368939 | 28547 |
| FLRT2 | 185070 | 330753 | 7588 | 332879 | 28504 | | FOSL2 | 075426 | 264716 | 7664 | 264716 | 28548 |
| FLRT2 | 185070 | 556335 | 7589 | N/A | | | FOSL2 | 075426 | 436647 | 7665 | 396497 | 28549 |
| FLRT2 | 185070 | 557419 | 7590 | N/A | | | FOXA1 | 129514 | 250448 | 7666 | 250448 | 28550 |
| FLRT2 | 185070 | 554746 | 7591 | 451050 | 28505 | | FOXA1 | 129514 | 545425 | 7667 | N/A | |
| FLRT2 | 185070 | 555398 | 7592 | N/A | | 15 | FOXA1 | 129514 | 553751 | 7668 | 451704 | 28551 |
| FLRT2 | 185070 | 553627 | 7593 | N/A | | | FOXA1 | 129514 | 554607 | 7669 | N/A | |
| FLRT2 | 185070 | 553650 | 7594 | N/A | | | FOXA1 | 129514 | 557418 | 7670 | N/A | |
| FLT3 | 122025 | 241453 | 7595 | 241453 | 28506 | | FOXA2 | 125798 | 419308 | 7671 | 400341 | 28552 |
| FLT3 | 122025 | 380987 | 7596 | 370374 | 28507 | | FOXA2 | 125798 | 377115 | 7672 | 366319 | 28553 |
| FLT3 | 122025 | 469894 | 7597 | N/A | | | FOXG1 | 176165 | 636604 | 7673 | N/A | |
| FMNL1 | 184922 | 592415 | 7598 | N/A | | 20 | FOXG1 | 176165 | 637220 | 7674 | N/A | |
| FMNL1 | 184922 | 331495 | 7599 | 329219 | 28508 | | FOXG1 | 176165 | 636893 | 7675 | N/A | |
| FMNL1 | 184922 | 585852 | 7600 | N/A | | | FOXG1 | 176165 | 637351 | 7676 | N/A | |
| FMNL1 | 184922 | 592006 | 7601 | N/A | | | FOXG1 | 176165 | 637817 | 7677 | N/A | |
| FMNL1 | 184922 | 592527 | 7602 | N/A | | | FOXG1 | 176165 | 636346 | 7678 | N/A | |
| FMNL1 | 184922 | 587856 | 7603 | N/A | | | FOXG1 | 176165 | 636353 | 7679 | N/A | |
| FMNL1 | 184922 | 591434 | 7604 | N/A | | 25 | FOXG1 | 176165 | 313071 | 7680 | 339004 | 28554 |
| FMNL1 | 184922 | 587489 | 7605 | 465474 | 28509 | | FOXH1 | 160973 | 377317 | 7681 | 366534 | 28555 |
| FMNL1 | 184922 | 586643 | 7606 | 465137 | 28510 | | FOXH1 | 160973 | 525197 | 7682 | N/A | |
| FMNL1 | 184922 | 589911 | 7607 | 466711 | 28511 | | FOXP4 | 137166 | 373063 | 7683 | 362154 | 28556 |
| FMNL1 | 184922 | 586092 | 7608 | 468301 | 28512 | | FOXP4 | 137166 | 409208 | 7684 | 386958 | 28557 |
| FMNL1 | 184922 | 328118 | 7609 | 327442 | 28513 | | FOXP4 | 137166 | 373057 | 7685 | 362148 | 28558 |
| FMNL3 | 161791 | 335154 | 7610 | 335655 | 28514 | | FOXP4 | 137166 | 307972 | 7686 | 309823 | 28559 |
| FMNL3 | 161791 | 550668 | 7611 | N/A | | 30 | FOXP4 | 137166 | 451305 | 7687 | 393704 | 28560 |
| FMNL3 | 161791 | 550488 | 7612 | 447479 | 28515 | | FOXP4 | 137166 | 373060 | 7688 | 362151 | 28561 |
| FMNL3 | 161791 | 549137 | 7613 | N/A | | | FRAS1 | 138759 | 325942 | 7689 | 326330 | 28562 |
| FMNL3 | 161791 | 352151 | 7614 | 344311 | 28516 | | FRAS1 | 138759 | 512123 | 7690 | 422834 | 28563 |
| FMNL3 | 161791 | 550970 | 7615 | N/A | | | FRAS1 | 138759 | 508909 | 7691 | 425583 | 28564 |
| FMNL3 | 161791 | 550424 | 7616 | 448939 | 28517 | | FRAS1 | 138759 | 502446 | 7692 | 423645 | 28565 |
| FMO3 | 007933 | 367755 | 7617 | 356729 | 28518 | 35 | FRAS1 | 138759 | 508900 | 7693 | 423809 | 28566 |
| FMO3 | 007933 | 530212 | 7618 | N/A | | | FRAS1 | 138759 | 510944 | 7694 | 422221 | 28567 |
| FMO3 | 007933 | 534514 | 7619 | N/A | | | FRAS1 | 138759 | 509802 | 7695 | N/A | |
| FMO3 | 007933 | 472784 | 7620 | 476963 | 28519 | | FREM1 | 164946 | 380894 | 7696 | 370278 | 28568 |
| FMO3 | 007933 | 479749 | 7621 | 477451 | 28520 | | FREM1 | 164946 | 380875 | 7697 | 370257 | 28569 |
| FMO3 | 007933 | 478457 | 7622 | N/A | | | FREM1 | 164946 | 427623 | 7698 | 412597 | 28570 |
| FNDC3B | 075420 | 421757 | 7623 | 408496 | 28521 | 40 | FREM1 | 164946 | 380880 | 7699 | 370262 | 28571 |
| FNDC3B | 075420 | 415807 | 7624 | 411242 | 28522 | | FREM1 | 164946 | 486223 | 7700 | N/A | |
| FNDC3B | 075420 | 469491 | 7625 | N/A | | | FREM1 | 164946 | 485068 | 7701 | N/A | |
| FNDC3B | 075420 | 336824 | 7626 | 338523 | 28523 | | FREM1 | 164946 | 466679 | 7702 | N/A | |
| FNDC3B | 075420 | 423424 | 7627 | 392471 | 28524 | | FREM1 | 164946 | 497634 | 7703 | N/A | |
| FNDC3B | 075420 | 416957 | 7628 | 389094 | 28525 | | FREM1 | 164946 | 422223 | 7704 | 412940 | 28572 |
| FNDC3B | 075420 | 478016 | 7629 | N/A | | | FRMD1 | 153303 | 283309 | 7705 | 283309 | 28573 |
| FNDC3B | 075420 | 443501 | 7630 | 389064 | 28526 | 45 | FRMD1 | 153303 | 432403 | 7706 | N/A | |
| FNDC3B | 075420 | 476794 | 7631 | N/A | | | FRMD1 | 153303 | 358587 | 7707 | N/A | |
| FNDC3B | 075420 | 483344 | 7632 | N/A | | | FRMD1 | 153303 | 440994 | 7708 | 414115 | 28574 |
| FNDC3B | 075420 | 494000 | 7633 | N/A | | | FRMD1 | 153303 | 468647 | 7709 | 427668 | 28575 |
| FNDC3B | 075420 | 490832 | 7634 | N/A | | | FRMD1 | 153303 | 509157 | 7710 | 423552 | 28576 |
| FOLH1 | 086205 | 458311 | 7635 | N/A | | | FRMD1 | 153303 | 336070 | 7711 | N/A | |
| FOLH1 | 086205 | 256999 | 7636 | 256999 | 28527 | 50 | FRMD1 | 153303 | 506415 | 7712 | N/A | |
| FOLH1 | 086205 | 356696 | 7637 | 349129 | 28528 | | FRMD1 | 153303 | 511714 | 7713 | 424439 | 28577 |
| FOLH1 | 086205 | 525826 | 7638 | 434928 | 28529 | | FRMD3 | 172159 | 328788 | 7714 | 328615 | 28578 |
| FOLH1 | 086205 | 340334 | 7639 | 344131 | 28530 | | FRMD3 | 172159 | 376434 | 7715 | 365617 | 28579 |
| FOLH1 | 086205 | 533034 | 7640 | 431463 | 28531 | | FRMD3 | 172159 | 376438 | 7716 | 365621 | 28580 |
| FOLH1 | 086205 | 532018 | 7641 | N/A | | | FRMD3 | 172159 | 304195 | 7717 | 303508 | 28581 |
| FOLH1 | 086205 | 525629 | 7642 | N/A | | 55 | FRMD3 | 172159 | 465485 | 7718 | N/A | |
| FOLH1 | 086205 | 526226 | 7643 | N/A | | | FRMD3 | 172159 | 431299 | 7719 | 412719 | 28582 |
| FOLH1 | 086205 | 529646 | 7644 | N/A | | | FRMD3 | 172159 | 621208 | 7720 | 484839 | 28583 |
| FOLH1 | 086205 | 533510 | 7645 | 436569 | 28532 | | FRMD4A | 151474 | 357447 | 7721 | 350032 | 28584 |
| FOLH1 | 086205 | 529117 | 7646 | 431577 | 28533 | | FRMD4A | 151474 | 475325 | 7722 | N/A | |
| FOLH1 | 086205 | 529648 | 7647 | 431263 | 28534 | | FRMD4A | 151474 | 495956 | 7723 | 488764 | 28585 |
| FOLH1 | 086205 | 343844 | 7648 | 344086 | 28535 | 60 | FRMD4A | 151474 | 264546 | 7724 | 264546 | 28586 |
| FOSB | 125740 | 585836 | 7649 | 467497 | 28536 | | FRMD4A | 151474 | 632570 | 7725 | 487974 | 28587 |
| FOSB | 125740 | 417353 | 7650 | 407207 | 28537 | | FRMD4A | 151474 | 632314 | 7726 | N/A | |
| FOSB | 125740 | 353609 | 7651 | 245919 | 28538 | | FRMD4A | 151474 | 492155 | 7727 | N/A | |
| FOSB | 125740 | 591858 | 7652 | 466530 | 28539 | | FRMD4A | 151474 | 342409 | 7728 | N/A | |
| FOSB | 125740 | 443841 | 7653 | 414177 | 28540 | | FRMD4A | 151474 | 477221 | 7729 | 488325 | 28588 |
| FOSB | 125740 | 590335 | 7654 | 465068 | 28541 | 65 | FRMD4A | 151474 | 640906 | 7730 | 492091 | 28589 |
| FOSB | 125740 | 592436 | 7655 | 465552 | 28542 | | FRMD4A | 151474 | 493380 | 7731 | 474863 | 28590 |

-continued

-continued

| Symbol | ENSG | ENST | SEQ ID | ENSP | SEQ ID |
|---|---|---|---|---|---|
| FRMD4A | 151474 | 475141 | 7732 | 473870 | 28591 |
| FRMD4B | 114541 | 398540 | 7733 | 381549 | 28592 |
| FRMD4B | 114541 | 478263 | 7734 | 418682 | 28593 |
| FRMD4B | 114541 | 462512 | 7735 | 419869 | 28594 |
| FRMD4B | 114541 | 497475 | 7736 | N/A | |
| FRMD4B | 114541 | 489817 | 7737 | 420735 | 28595 |
| FRMD4B | 114541 | 470070 | 7738 | N/A | |
| FRMD4B | 114541 | 483668 | 7739 | N/A | |
| FRMD4B | 114541 | 487751 | 7740 | N/A | |
| FRMD4B | 114541 | 493880 | 7741 | 418962 | 28596 |
| FRMD4B | 114541 | 473029 | 7742 | 418373 | 28597 |
| FRMD4B | 114541 | 460709 | 7743 | 418023 | 28598 |
| FRMD4B | 114541 | 473188 | 7744 | N/A | |
| FRMD4B | 114541 | 459638 | 7745 | 417550 | 28599 |
| FRMD4B | 114541 | 462308 | 7746 | N/A | |
| FRMD4B | 114541 | 497880 | 7747 | 417765 | 28600 |
| FRMD4B | 114541 | 497757 | 7748 | N/A | |
| FRMD4B | 114541 | 493127 | 7749 | N/A | |
| FRMD4B | 114541 | 462888 | 7750 | N/A | |
| FRMPD1 | 070601 | 377765 | 7751 | 366995 | 28601 |
| FRMPD1 | 070601 | 539465 | 7752 | 444411 | 28602 |
| FRMPD1 | 070601 | 359927 | 7753 | 439868 | 28603 |
| FRMPD2 | 170324 | 635925 | 7754 | N/A | |
| FRMPD2 | 170324 | 637395 | 7755 | 490362 | 28604 |
| FRMPD2 | 170324 | 636244 | 7756 | 490201 | 28605 |
| FRMPD2 | 170324 | 474573 | 7757 | N/A | |
| FRMPD2 | 170324 | 374201 | 7758 | 363317 | 28606 |
| FRMPD2 | 170324 | 305531 | 7759 | 307079 | 28607 |
| FRMPD2 | 170324 | 491130 | 7760 | N/A | |
| FRMPD2 | 170324 | 463706 | 7761 | N/A | |
| FRMPD2 | 170324 | 477710 | 7762 | N/A | |
| FRMPD2 | 170324 | 486151 | 7763 | N/A | |
| FRMPD2 | 170324 | 494505 | 7764 | N/A | |
| FRMPD2 | 170324 | 505547 | 7765 | N/A | |
| FRMPD2 | 170324 | 468556 | 7766 | N/A | |
| FRMPD2 | 170324 | 492045 | 7767 | N/A | |
| FRMPD4 | 169933 | 380682 | 7768 | 370057 | 28608 |
| FRMPD4 | 169933 | 640291 | 7769 | 492353 | 28609 |
| FRMPD4 | 169933 | 616992 | 7770 | 482182 | 28610 |
| FRRS1 | 156869 | 287474 | 7771 | 287474 | 28611 |
| FRRS1 | 156869 | 489209 | 7772 | N/A | |
| FRRS1 | 156869 | 492943 | 7773 | N/A | |
| FRRS1 | 156869 | 370176 | 7774 | N/A | |
| FRRS1L | 260230 | 561981 | 7775 | 477141 | 28612 |
| FRY | 073910 | 642010 | 7776 | 493189 | 28613 |
| FRY | 073910 | 542859 | 7777 | 445043 | 28614 |
| FRY | 073910 | 463566 | 7778 | N/A | |
| FRY | 073910 | 436016 | 7779 | 398010 | 28615 |
| FRY | 073910 | 641614 | 7780 | N/A | |
| FRY | 073910 | 477712 | 7781 | 434694 | 28616 |
| FRY | 073910 | 380217 | 7782 | N/A | |
| FRY | 073910 | 418076 | 7783 | N/A | |
| FRY | 073910 | 380250 | 7784 | 369600 | 28617 |
| FSD2 | 186628 | 334574 | 7785 | 335651 | 28618 |
| FSD2 | 186628 | 541889 | 7786 | 444078 | 28619 |
| FSD2 | 186628 | 561368 | 7787 | 453127 | 28620 |
| FSIP2 | 188738 | 424728 | 7788 | 401306 | 28621 |
| FSIP2 | 188738 | 465275 | 7789 | N/A | |
| FSIP2 | 188738 | 469367 | 7790 | N/A | |
| FSIP2 | 188738 | 429412 | 7791 | 395888 | 28622 |
| FSIP2 | 188738 | 415915 | 7792 | 390251 | 28623 |
| FSIP2 | 188738 | 611759 | 7793 | 478995 | 28624 |
| FSTL4 | 053108 | 265342 | 7794 | 265342 | 28625 |
| FSTL4 | 053108 | 509525 | 7795 | N/A | |
| FSTL4 | 053108 | 511375 | 7796 | N/A | |
| FSTL4 | 053108 | 507112 | 7797 | N/A | |
| FSTL4 | 053108 | 514998 | 7798 | N/A | |
| FSTL4 | 053108 | 510685 | 7799 | 427662 | 28626 |
| FSTL4 | 053108 | 621681 | 7800 | 484273 | 28627 |
| FSTL5 | 168843 | 379164 | 7801 | 368462 | 28628 |
| FSTL5 | 168843 | 427802 | 7802 | 389270 | 28629 |
| FSTL5 | 168843 | 511999 | 7803 | N/A | |
| FSTL5 | 168843 | 511170 | 7804 | N/A | |
| FSTL5 | 168843 | 306100 | 7805 | 305334 | 28630 |
| FTH1 | 167996 | 529191 | 7806 | 431659 | 28631 |
| FTH1 | 167996 | 529631 | 7807 | 431575 | 28632 |

| Symbol | ENSG | ENST | SEQ ID | ENSP | SEQ ID |
|---|---|---|---|---|---|
| FTH1 | 167996 | 530019 | 7808 | 433470 | 28633 |
| FTH1 | 167996 | 273550 | 7809 | 273550 | 28634 |
| FTH1 | 167996 | 532829 | 7810 | 432223 | 28635 |
| FTH1 | 167996 | 534180 | 7811 | 434403 | 28636 |
| FTH1 | 167996 | 526640 | 7812 | 433321 | 28637 |
| FTH1 | 167996 | 532601 | 7813 | 435111 | 28638 |
| FTH1 | 167996 | 534719 | 7814 | N/A | |
| FTH1 | 167996 | 533138 | 7815 | N/A | |
| FTH1 | 167996 | 529548 | 7816 | 436947 | 28639 |
| FTH1 | 167996 | 620041 | 7817 | 484477 | 28640 |
| FTL | 087086 | 331825 | 7818 | 366525 | 28641 |
| FXYD1 | 266964 | 351325 | 7819 | 343314 | 28642 |
| FXYD1 | 266964 | 592818 | 7820 | N/A | |
| FXYD1 | 266964 | 589209 | 7821 | 466398 | 28643 |
| FXYD1 | 266964 | 455515 | 7822 | 393611 | 28644 |
| FXYD1 | 266964 | 588715 | 7823 | 465289 | 28645 |
| FXYD1 | 266964 | 588607 | 7824 | 468535 | 28646 |
| FXYD1 | 266964 | 587056 | 7825 | N/A | |
| FXYD1 | 266964 | 588081 | 7826 | 467727 | 28647 |
| FXYD1 | 266964 | 589121 | 7827 | 467818 | 28648 |
| FXYD1 | 266964 | 590462 | 7828 | N/A | |
| FXYD1 | 266964 | 612146 | 7829 | 481244 | 28649 |
| FXYD7 | 221946 | 586063 | 7830 | 466915 | 28650 |
| FXYD7 | 221946 | 270310 | 7831 | 270310 | 28651 |
| FXYD7 | 221946 | 439441 | 7832 | N/A | |
| FXYD7 | 221946 | 588265 | 7833 | 465784 | 28652 |
| FZD7 | 155760 | 286201 | 7834 | 286201 | 28653 |
| FZD8 | 177283 | 374694 | 7835 | 363826 | 28654 |
| FZD9 | 188763 | 344575 | 7836 | 345785 | 28655 |
| FZR1 | 105325 | 441788 | 7837 | 410369 | 28656 |
| FZR1 | 105325 | 588327 | 7838 | N/A | |
| FZR1 | 105325 | 591290 | 7839 | 467967 | 28657 |
| FZR1 | 105325 | 395095 | 7840 | 378529 | 28658 |
| FZR1 | 105325 | 313639 | 7841 | 321800 | 28659 |
| FZR1 | 105325 | 592214 | 7842 | N/A | |
| FZR1 | 105325 | 586212 | 7843 | N/A | |
| FZR1 | 105325 | 588084 | 7844 | N/A | |
| GAB1 | 109458 | 262995 | 7845 | 262995 | 28660 |
| GAB1 | 109458 | 262994 | 7846 | 262994 | 28661 |
| GAB1 | 109458 | 514639 | 7847 | 427435 | 28662 |
| GAB1 | 109458 | 515366 | 7848 | 426668 | 28663 |
| GAB1 | 109458 | 505913 | 7849 | 424554 | 28664 |
| GAB1 | 109458 | 515388 | 7850 | N/A | |
| GAB1 | 109458 | 509992 | 7851 | 425921 | 28665 |
| GAB1 | 109458 | 511836 | 7852 | 420867 | 28666 |
| GAB1 | 109458 | 512843 | 7853 | 426297 | 28667 |
| GAB1 | 109458 | 507334 | 7854 | N/A | |
| GAB1 | 109458 | 507070 | 7855 | N/A | |
| GAB1 | 109458 | 510615 | 7856 | N/A | |
| GAB1 | 109458 | 508833 | 7857 | N/A | |
| GAB1 | 109458 | 511109 | 7858 | N/A | |
| GAB2 | 033327 | 340149 | 7859 | 343959 | 28668 |
| GAB2 | 033327 | 361507 | 7860 | 354952 | 28669 |
| GAB2 | 033327 | 528329 | 7861 | N/A | |
| GAB2 | 033327 | 526030 | 7862 | N/A | |
| GAB2 | 033327 | 528886 | 7863 | 433762 | 28670 |
| GAB2 | 033327 | 530915 | 7864 | 431868 | 28671 |
| GAB2 | 033327 | 534823 | 7865 | N/A | |
| GABARAPL1 | 139112 | 539408 | 7866 | 443122 | 28672 |
| GABARAPL1 | 139112 | 542722 | 7867 | 438029 | 28673 |
| GABARAPL1 | 139112 | 545859 | 7868 | 444108 | 28674 |
| GABARAPL1 | 139112 | 266458 | 7869 | 266458 | 28675 |
| GABARAPL1 | 139112 | 421801 | 7870 | 411256 | 28676 |
| GABARAPL1 | 139112 | 544284 | 7871 | 439734 | 28677 |
| GABARAPL1 | 139112 | 545047 | 7872 | 441165 | 28678 |
| GABARAPL1 | 139112 | 541453 | 7873 | 446297 | 28679 |
| GABARAPL1 | 139112 | 543602 | 7874 | 445857 | 28680 |
| GABARAPL1 | 139112 | 540424 | 7875 | 443720 | 28681 |
| GABARAPL1 | 139112 | 537201 | 7876 | 444055 | 28682 |
| GABARAPL1 | 139112 | 545887 | 7877 | 444186 | 28683 |
| GABARAPL1 | 139112 | 541960 | 7878 | 445709 | 28684 |
| GABARAPL1 | 139112 | 539289 | 7879 | N/A | |
| GABARAPL1 | 139112 | 546017 | 7880 | 446456 | 28685 |
| GABARAPL1 | 139112 | 535576 | 7881 | 444738 | 28686 |
| GABARAPL1 | 139112 | 539170 | 7882 | 444209 | 28687 |
| GABARAPL1 | 139112 | 545290 | 7883 | 437451 | 28688 |

401

-continued

| Symbol | ENSG | ENST | SEQ ID | ENSP | SEQ ID |
|---|---|---|---|---|---|
| GABARAPL1 | 139112 | 629504 | 7884 | 486133 | 28689 |
| GABBR1 | 237112 | 425097 | 7885 | 411286 | 28690 |
| GABBR1 | 237112 | 446436 | 7886 | 394528 | 28691 |
| GABBR1 | 237112 | 443440 | 7887 | 399318 | 28692 |
| GABBR1 | 237112 | 466282 | 7888 | N/A | |
| GABBR1 | 237112 | 492358 | 7889 | N/A | |
| GABBR1 | 237112 | 475099 | 7890 | N/A | |
| GABBR1 | 237112 | 493150 | 7891 | N/A | |
| GABBR1 | 237112 | 417759 | 7892 | 391572 | 28693 |
| GABBR1 | 237112 | 471103 | 7893 | N/A | |
| GABBR1 | 237112 | 497560 | 7894 | N/A | |
| GABBR1 | 237112 | 472409 | 7895 | N/A | |
| GABBR1 | 237112 | 481954 | 7896 | N/A | |
| GABBR1 | 237112 | 551140 | 7897 | 448654 | 28694 |
| GABBR1 | 204681 | 355973 | 7898 | 348248 | 28695 |
| GABBR1 | 201681 | 472823 | 7899 | 419356 | 28696 |
| GABBR1 | 201681 | 377016 | 7900 | 366215 | 28697 |
| GABBR1 | 201681 | 377012 | 7901 | 366211 | 28698 |
| GABBR1 | 201681 | 491829 | 7902 | 417478 | 28699 |
| GABBR1 | 201681 | 377034 | 7903 | 366233 | 28700 |
| GABBR1 | 201681 | 478931 | 7904 | N/A | |
| GABBR1 | 201681 | 494877 | 7905 | 419061 | 28701 |
| GABBR1 | 201681 | 488334 | 7906 | N/A | |
| GABBR1 | 201681 | 486434 | 7907 | N/A | |
| GABBR1 | 201681 | 473774 | 7908 | N/A | |
| GABBR1 | 201681 | 489839 | 7909 | N/A | |
| GABBR1 | 201681 | 494634 | 7910 | N/A | |
| GABBR1 | 201681 | 477029 | 7911 | N/A | |
| GABBR1 | 201681 | 485508 | 7912 | 417663 | 28702 |
| GABBR1 | 201681 | 489385 | 7913 | 420602 | 28703 |
| GABBR1 | 201681 | 467259 | 7914 | N/A | |
| GABBR1 | 201681 | 462632 | 7915 | 419755 | 28704 |
| GABBR1 | 201681 | 476670 | 7916 | 417332 | 28705 |
| GABBR1 | 201681 | 376977 | 7917 | 366176 | 28706 |
| GABBR1 | 206511 | 383638 | 7918 | 373134 | 28707 |
| GABBR1 | 206511 | 383636 | 7919 | 373132 | 28708 |
| GABBR1 | 206511 | 383637 | 7920 | 373133 | 28709 |
| GABBR1 | 206511 | 466873 | 7921 | N/A | |
| GABBR1 | 206511 | 473906 | 7922 | N/A | |
| GABBR1 | 206511 | 490214 | 7923 | N/A | |
| GABBR1 | 206511 | 486760 | 7924 | N/A | |
| GABBR1 | 206511 | 476629 | 7925 | N/A | |
| GABBR1 | 206511 | 495153 | 7926 | N/A | |
| GABBR1 | 206511 | 383639 | 7927 | 373135 | 28710 |
| GABBR1 | 206511 | 483838 | 7928 | N/A | |
| GABBR1 | 206511 | 475370 | 7929 | N/A | |
| GABBR1 | 206511 | 551423 | 7930 | 449342 | 28711 |
| GABBR1 | 232569 | 439457 | 7931 | 406066 | 28712 |
| GABBR1 | 232569 | 452300 | 7932 | 408938 | 28713 |
| GABBR1 | 232569 | 419674 | 7933 | 399861 | 28714 |
| GABBR1 | 232569 | 481198 | 7934 | N/A | |
| GABBR1 | 232569 | 491396 | 7935 | N/A | |
| GABBR1 | 232569 | 477417 | 7936 | N/A | |
| GABBR1 | 232569 | 486592 | 7937 | N/A | |
| GABBR1 | 232569 | 449163 | 7938 | 411263 | 28715 |
| GABBR1 | 232569 | 489750 | 7939 | N/A | |
| GABBR1 | 232569 | 461230 | 7940 | N/A | |
| GABBR1 | 232569 | 467296 | 7941 | N/A | |
| GABBR1 | 232569 | 481333 | 7942 | N/A | |
| GABBR1 | 232569 | 547410 | 7943 | 448531 | 28716 |
| GABBR1 | 232569 | 546913 | 7944 | 448999 | 28717 |
| GABBR1 | 206466 | 383542 | 7945 | 373034 | 28718 |
| GABBR1 | 206466 | 383537 | 7946 | 373029 | 28719 |
| GABBR1 | 206466 | 383541 | 7947 | 373033 | 28720 |
| GABBR1 | 206466 | 495291 | 7948 | N/A | |
| GABBR1 | 206466 | 489481 | 7949 | N/A | |
| GABBR1 | 206466 | 482350 | 7950 | N/A | |
| GABBR1 | 206466 | 498610 | 7951 | N/A | |
| GABBR1 | 206466 | 383543 | 7952 | 373035 | 28721 |
| GABBR1 | 206466 | 493602 | 7953 | N/A | |
| GABBR1 | 206466 | 471385 | 7954 | N/A | |
| GABBR1 | 206466 | 462863 | 7955 | N/A | |
| GABBR1 | 206466 | 478066 | 7956 | N/A | |
| GABBR1 | 206466 | 552399 | 7957 | 449449 | 28722 |
| GABBR1 | 232632 | 438094 | 7958 | 406285 | 28723 |
| GABBR1 | 232632 | 460735 | 7959 | N/A | |

402

-continued

| Symbol | ENSG | ENST | SEQ ID | ENSP | SEQ ID |
|---|---|---|---|---|---|
| GABBR1 | 232632 | 486623 | 7960 | N/A | |
| GABBR1 | 232632 | 434660 | 7961 | 412167 | 28724 |
| GABBR1 | 232632 | 423604 | 7962 | 388035 | 28725 |
| GABBR1 | 232632 | 414980 | 7963 | 406499 | 28726 |
| GABBR1 | 232632 | 483304 | 7964 | N/A | |
| GABBR1 | 232632 | 470098 | 7965 | N/A | |
| GABBR1 | 232632 | 487021 | 7966 | N/A | |
| GABBR1 | 232632 | 474366 | 7967 | N/A | |
| GABBR1 | 232632 | 468622 | 7968 | N/A | |
| GABBR1 | 232632 | 463819 | 7969 | N/A | |
| GABBR1 | 232632 | 548767 | 7970 | 446983 | 28727 |
| GABBR1 | 237051 | 418225 | 7971 | 416731 | 28728 |
| GABBR1 | 237051 | 458612 | 7972 | 416903 | 28729 |
| GABBR1 | 237051 | 440316 | 7973 | 412044 | 28730 |
| GABBR1 | 237051 | 496339 | 7974 | N/A | |
| GABBR1 | 237051 | 491155 | 7975 | N/A | |
| GABBR1 | 237051 | 475876 | 7976 | N/A | |
| GABBR1 | 237051 | 473033 | 7977 | N/A | |
| GABBR1 | 237051 | 448754 | 7978 | 405709 | 28731 |
| GABBR1 | 237051 | 464091 | 7979 | N/A | |
| GABBR1 | 237051 | 496077 | 7980 | N/A | |
| GABBR1 | 237051 | 460802 | 7981 | N/A | |
| GABBR1 | 237051 | 482516 | 7982 | N/A | |
| GABBR1 | 237051 | 550820 | 7983 | 448763 | 28732 |
| GABBR2 | 136928 | 259455 | 7984 | 259455 | 28733 |
| GABBR2 | 136928 | 637410 | 7985 | N/A | |
| GABBR2 | 136928 | 636575 | 7986 | N/A | |
| GABBR2 | 136928 | 634457 | 7987 | 489352 | 28734 |
| GABBR2 | 136928 | 634354 | 7988 | N/A | |
| GABBR2 | 136928 | 635462 | 7989 | N/A | |
| GABBR2 | 136928 | 634314 | 7990 | N/A | |
| GABBR2 | 136928 | 634919 | 7991 | N/A | |
| GABBR2 | 136928 | 477471 | 7992 | N/A | |
| GABBR2 | 136928 | 634227 | 7993 | N/A | |
| GABBR2 | 136928 | 637717 | 7994 | 490789 | 28735 |
| GABBR2 | 136928 | 638001 | 7995 | N/A | |
| GABRA2 | 151834 | 510861 | 7996 | 421828 | 28736 |
| GABRA2 | 151834 | 514090 | 7997 | 421300 | 28737 |
| GABRA2 | 151834 | 381620 | 7998 | 371033 | 28738 |
| GABRA2 | 151834 | 356504 | 7999 | 348897 | 28739 |
| GABRA2 | 151834 | 630416 | 8000 | 486333 | 28740 |
| GABRA2 | 151834 | 510233 | 8001 | 422642 | 28741 |
| GABRA2 | 151834 | 507069 | 8002 | 427603 | 28742 |
| GABRA2 | 151834 | 513005 | 8003 | 421639 | 28743 |
| GABRA2 | 151834 | 515082 | 8004 | 423840 | 28744 |
| GABRA2 | 151834 | 514236 | 8005 | 425240 | 28745 |
| GABRA2 | 151834 | 514193 | 8006 | 425526 | 28746 |
| GABRA2 | 151834 | 503806 | 8007 | 424362 | 28747 |
| GABRA2 | 151834 | 506961 | 8008 | 424093 | 28748 |
| GABRA2 | 151834 | 507460 | 8009 | 422805 | 28749 |
| GABRA2 | 151834 | 509716 | 8010 | N/A | |
| GABRA2 | 151834 | 540012 | 8011 | 444409 | 28750 |
| GABRA4 | 109158 | 264318 | 8012 | 264318 | 28751 |
| GABRA4 | 109158 | 511523 | 8013 | 422152 | 28752 |
| GABRA4 | 109158 | 508560 | 8014 | 425445 | 28753 |
| GABRA4 | 109158 | 502874 | 8015 | 424386 | 28754 |
| GABRA4 | 109158 | 509316 | 8016 | N/A | |
| GABRA6 | 145863 | 522269 | 8017 | N/A | |
| GABRA6 | 145863 | 518888 | 8018 | N/A | |
| GABRA6 | 145863 | 274545 | 8019 | 274545 | 28755 |
| GABRA6 | 145863 | 523217 | 8020 | 430527 | 28756 |
| GABRA6 | 145863 | 524220 | 8021 | N/A | |
| GABRA6 | 145863 | 520000 | 8022 | 429943 | 28757 |
| GABRA6 | 145863 | 517823 | 8023 | 430212 | 28758 |
| GABRA6 | 145863 | 523691 | 8024 | 427989 | 28759 |
| GABRA6 | 145863 | 521520 | 8025 | N/A | |
| GABRB1 | 163288 | 513567 | 8026 | 426753 | 28760 |
| GABRB1 | 163288 | 295454 | 8027 | 295454 | 28761 |
| GABRB1 | 163288 | 509366 | 8028 | N/A | |
| GABRB1 | 163288 | 381582 | 8029 | N/A | |
| GABRB1 | 163288 | 510909 | 8030 | 426766 | 28762 |
| GABRD | 187730 | 378585 | 8031 | 367848 | 28763 |
| GABRD | 187730 | 638411 | 8032 | 491632 | 28764 |
| GABRD | 187730 | 639045 | 8033 | 491997 | 28765 |
| GABRD | 187730 | 640067 | 8034 | 491844 | 28766 |
| GABRD | 187730 | 638604 | 8035 | N/A | |

| Symbol | ENSG | ENST | SEQ ID | ENSP | SEQ ID |
|---|---|---|---|---|---|
| GABRD | 187730 | 638771 | 8036 | 492435 | 28767 |
| GABRD | 187730 | 639935 | 8037 | N/A | |
| GABRD | 187730 | 640949 | 8038 | 492500 | 28768 |
| GABRD | 187730 | 640030 | 8039 | 491411 | 28769 |
| GABRD | 187730 | 640423 | 8040 | N/A | |
| GABRD | 187730 | 639625 | 8041 | N/A | |
| GABRD | 187730 | 639777 | 8042 | N/A | |
| GABRD | 187730 | 640981 | 8043 | 491287 | 28770 |
| GABRD | 187730 | 638763 | 8044 | 492352 | 28771 |
| GABRD | 187730 | 639070 | 8045 | N/A | |
| GABRD | 187730 | 640892 | 8046 | N/A | |
| GABRD | 187730 | 640317 | 8047 | N/A | |
| GABRD | 187730 | 638804 | 8048 | 491871 | 28772 |
| GABRD | 187730 | 640688 | 8049 | N/A | |
| GABRG2 | 113327 | 522053 | 8050 | N/A | |
| GABRG2 | 113327 | 640500 | 8051 | N/A | |
| GABRG2 | 113327 | 638253 | 8052 | N/A | |
| GABRG2 | 113327 | 639278 | 8053 | 491958 | 28773 |
| GABRG2 | 113327 | 638660 | 8054 | 492869 | 28774 |
| GABRG2 | 113327 | 638552 | 8055 | 491763 | 28775 |
| GABRG2 | 113327 | 640574 | 8056 | 491582 | 28776 |
| GABRG2 | 113327 | 639111 | 8057 | 492125 | 28777 |
| GABRG2 | 113327 | 639975 | 8058 | 492096 | 28778 |
| GABRG2 | 113327 | 639213 | 8059 | 491909 | 28779 |
| GABRG2 | 113327 | 639683 | 8060 | 492581 | 28780 |
| GABRG2 | 113327 | 639384 | 8061 | 491240 | 28781 |
| GABRG2 | 113327 | 640985 | 8062 | 492293 | 28782 |
| GABRG2 | 113327 | 638772 | 8063 | 491557 | 28783 |
| GABRG2 | 113327 | 639424 | 8064 | 491245 | 28784 |
| GABRG2 | 113327 | 414552 | 8065 | 410732 | 28785 |
| GABRG2 | 113327 | 639549 | 8066 | N/A | |
| GABRG2 | 113327 | 522990 | 8067 | 430732 | 28786 |
| GABRG2 | 113327 | 361925 | 8068 | 354651 | 28787 |
| GABRG2 | 113327 | 638782 | 8069 | N/A | |
| GABRG2 | 113327 | 641017 | 8070 | 493461 | 28788 |
| GABRG2 | 113327 | 640910 | 8071 | 492545 | 28789 |
| GABRG2 | 113327 | 523372 | 8072 | 430124 | 28790 |
| GABRG2 | 113327 | 356592 | 8073 | 349000 | 28791 |
| GABRG2 | 113327 | 639554 | 8074 | N/A | |
| GABRG2 | 113327 | 640739 | 8075 | N/A | |
| GABRG2 | 113327 | 638877 | 8076 | 491621 | 28792 |
| GABRG2 | 113327 | 639046 | 8077 | 492659 | 28793 |
| GABRG2 | 113327 | 640757 | 8078 | 492329 | 28794 |
| GABRG3 | 182256 | 615808 | 8079 | 479113 | 28795 |
| GABRG3 | 182256 | 555083 | 8080 | 452244 | 28796 |
| GABRG3 | 182256 | 553440 | 8081 | N/A | |
| GABRG3 | 182256 | 554786 | 8082 | N/A | |
| GABRG3 | 182256 | 554696 | 8083 | 451862 | 28797 |
| GABRG3 | 182256 | 557596 | 8084 | 450976 | 28798 |
| GABRG3 | 182256 | 451330 | 8085 | 390708 | 28799 |
| GABRG3 | 182256 | 333743 | 8086 | 331912 | 28800 |
| GACAT2 | 265962 | 579368 | 8087 | N/A | |
| GAD2 | 136750 | 376261 | 8088 | 365437 | 28801 |
| GAD2 | 136750 | 259271 | 8089 | 259271 | 28802 |
| GAD2 | 136750 | 428517 | 8090 | 390434 | 28803 |
| GAD2 | 136750 | 376248 | 8091 | 365424 | 28804 |
| GADD45A | 116717 | 370986 | 8092 | 360025 | 28805 |
| GADD45A | 116717 | 370985 | 8093 | 360024 | 28806 |
| GADD45A | 116717 | 460575 | 8094 | N/A | |
| GADD45A | 116717 | 484245 | 8095 | N/A | |
| GADD45A | 116717 | 617962 | 8096 | 482814 | 28807 |
| GAL3ST1 | 128242 | 406955 | 8097 | 385825 | 28808 |
| GAL3ST1 | 128242 | 402321 | 8098 | 385735 | 28809 |
| GAL3ST1 | 128242 | 402369 | 8099 | 384122 | 28810 |
| GAL3ST1 | 128242 | 401975 | 8100 | 384388 | 28811 |
| GAL3ST1 | 128242 | 406361 | 8101 | 385207 | 28812 |
| GAL3ST1 | 128242 | 441967 | 8102 | 390545 | 28813 |
| GAL3ST1 | 128242 | 431313 | 8103 | 395080 | 28814 |
| GAL3ST1 | 128242 | 452827 | 8104 | 405017 | 28815 |
| GAL3ST1 | 128242 | 437282 | 8105 | 401426 | 28816 |
| GAL3ST1 | 128242 | 416358 | 8106 | 391485 | 28817 |
| GAL3ST1 | 128242 | 427899 | 8107 | 397092 | 28818 |
| GAL3ST1 | 128242 | 423299 | 8108 | 391996 | 28819 |
| GAL3ST1 | 128242 | 443136 | 8109 | 405381 | 28820 |
| GAL3ST1 | 128242 | 423371 | 8110 | 401074 | 28821 |
| GAL3ST1 | 128242 | 428682 | 8111 | 389876 | 28822 |

| Symbol | ENSG | ENST | SEQ ID | ENSP | SEQ ID |
|---|---|---|---|---|---|
| GAL3ST1 | 128242 | 453479 | 8112 | 398380 | 28823 |
| GAL3ST1 | 128242 | 426220 | 8113 | 414542 | 28824 |
| GAL3ST1 | 128242 | 447224 | 8114 | 412995 | 28825 |
| GAL3ST1 | 128242 | 411821 | 8115 | 394912 | 28826 |
| GAL3ST1 | 128242 | 445645 | 8116 | 399649 | 28827 |
| GAL3ST1 | 128242 | 448604 | 8117 | 390068 | 28828 |
| GAL3ST1 | 128242 | 338911 | 8118 | 343234 | 28829 |
| GAL3ST4 | 197093 | 460995 | 8119 | 488800 | 28830 |
| GAL3ST4 | 197093 | 482469 | 8120 | 487594 | 28831 |
| GAL3ST4 | 197093 | 498000 | 8121 | 488586 | 28832 |
| GAL3ST4 | 197093 | 411994 | 8122 | 414733 | 28833 |
| GAL3ST4 | 197093 | 423751 | 8123 | 399066 | 28834 |
| GAL3ST4 | 197093 | 360039 | 8124 | 353142 | 28835 |
| GAL3ST4 | 197093 | 495882 | 8125 | N/A | |
| GAL3ST4 | 197093 | 413800 | 8126 | 400451 | 28836 |
| GALNT14 | 158089 | 324589 | 8127 | 314500 | 28837 |
| GALNT14 | 158089 | 349752 | 8128 | 288988 | 28838 |
| GALNT14 | 158089 | 406653 | 8129 | 385435 | 28839 |
| GALNT14 | 158089 | 475320 | 8130 | N/A | |
| GALNT14 | 158089 | 486564 | 8131 | N/A | |
| GALNT14 | 158089 | 430167 | 8132 | 406399 | 28840 |
| GALNT14 | 158089 | 455477 | 8133 | 399886 | 28841 |
| GALNT14 | 158089 | 464038 | 8134 | N/A | |
| GALNT14 | 158089 | 481023 | 8135 | N/A | |
| GALNT14 | 158089 | 424136 | 8136 | 398723 | 28842 |
| GALNT14 | 158089 | 496397 | 8137 | N/A | |
| GALNT14 | 158089 | 461193 | 8138 | N/A | |
| GALNT14 | 158089 | 490212 | 8139 | N/A | |
| GALNT14 | 158089 | 498206 | 8140 | N/A | |
| GALNT14 | 158089 | 485468 | 8141 | N/A | |
| GALNT15 | 131386 | 339732 | 8142 | 344260 | 28843 |
| GALNT15 | 131386 | 437509 | 8143 | 395873 | 28844 |
| GALNT15 | 131386 | 470031 | 8144 | N/A | |
| GALNT15 | 131386 | 430410 | 8145 | 389079 | 28845 |
| GALNT15 | 131386 | 489467 | 8146 | N/A | |
| GALNT15 | 131386 | 617544 | 8147 | 480229 | 28846 |
| GALNT16 | 100626 | 554858 | 8148 | N/A | |
| GALNT16 | 100626 | 554317 | 8149 | N/A | |
| GALNT16 | 100626 | 555920 | 8150 | N/A | |
| GALNT16 | 100626 | 337827 | 8151 | 336729 | 28847 |
| GALNT16 | 100626 | 553471 | 8152 | 451420 | 28848 |
| GALNT16 | 100626 | 448469 | 8153 | 402970 | 28849 |
| GALNT16 | 100626 | 553669 | 8154 | 451200 | 28850 |
| GALNT16 | 100626 | 553740 | 8155 | N/A | |
| GALNT16 | 100626 | 556677 | 8156 | N/A | |
| GALNT16 | 100626 | 556829 | 8157 | N/A | |
| GALNT18 | 110328 | 227756 | 8158 | 227756 | 28851 |
| GALNT18 | 110328 | 526064 | 8159 | N/A | |
| GALNT3 | 115339 | 392701 | 8160 | 376465 | 28852 |
| GALNT3 | 115339 | 409882 | 8161 | 386955 | 28853 |
| GALNT3 | 115339 | 412248 | 8162 | 412643 | 28854 |
| GALNT3 | 115339 | 437849 | 8163 | 391104 | 28855 |
| GALNT3 | 115339 | 463254 | 8164 | N/A | |
| GALNT3 | 115339 | 431484 | 8165 | 397112 | 28856 |
| GALNT3 | 115339 | 414977 | 8166 | 413477 | 28857 |
| GALNT3 | 115339 | 422973 | 8167 | 413694 | 28858 |
| GALNT3 | 115339 | 447156 | 8168 | 399880 | 28859 |
| GALNT5 | 136542 | 259056 | 8169 | 259056 | 28860 |
| GALNT5 | 136542 | 463418 | 8170 | N/A | |
| GALNT5 | 136542 | 461704 | 8171 | N/A | |
| GALNT6 | 139629 | 543196 | 8172 | 444171 | 28861 |
| GALNT6 | 139629 | 356317 | 8173 | 348668 | 28862 |
| GALNT6 | 139629 | 603680 | 8174 | N/A | |
| GALNT6 | 139629 | 603641 | 8175 | 474670 | 28863 |
| GALNT6 | 139629 | 604381 | 8176 | 474101 | 28864 |
| GALNT6 | 139629 | 604847 | 8177 | 474515 | 28865 |
| GALNT6 | 139629 | 605720 | 8178 | N/A | |
| GALNT6 | 139629 | 605367 | 8179 | N/A | |
| GALNT6 | 139629 | 603482 | 8180 | N/A | |
| GALNT6 | 139629 | 605089 | 8181 | N/A | |
| GALNT6 | 139629 | 605822 | 8182 | N/A | |
| GALNT6 | 139629 | 603203 | 8183 | N/A | |
| GALNT6 | 139629 | 605055 | 8184 | 474483 | 28866 |
| GALNT6 | 139629 | 604506 | 8185 | 474163 | 28867 |
| GALNT6 | 139629 | 605138 | 8186 | 473981 | 28868 |
| GALNT6 | 139629 | 603563 | 8187 | 473948 | 28869 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| GALNT6 | 139629 | 603188 | 8188 | 474052 | 28870 | 5 | CASTOR1 | 239282 | 492159 | 8264 | N/A | |
| GALNT6 | 139629 | 605617 | 8189 | 473836 | 28871 | | CASTOR1 | 239282 | 440704 | 8265 | 407871 | 28914 |
| GALNT6 | 139629 | 604426 | 8190 | 473918 | 28872 | | CASTOR1 | 239282 | 464854 | 8266 | N/A | |
| GALNTL6 | 174473 | 511251 | 8191 | 425590 | 28873 | | CASTOR1 | 239282 | 498572 | 8267 | N/A | |
| GALNTL6 | 174473 | 506823 | 8192 | 423313 | 28874 | | GBAP1 | 160766 | 459805 | 8268 | N/A | |
| GALNTL6 | 174473 | 504379 | 8193 | N/A | | | GBAP1 | 160766 | 486869 | 8269 | N/A | |
| GALNTL6 | 174473 | 513061 | 8194 | N/A | | 10 | GBAP1 | 160766 | 368374 | 8270 | N/A | |
| GALNTL6 | 174473 | 508122 | 8195 | 423827 | 28875 | | GBAP1 | 160766 | 486197 | 8271 | N/A | |
| GALNTL6 | 174473 | 457021 | 8196 | N/A | | | GBAP1 | 160766 | 473223 | 8272 | N/A | |
| GALNTL6 | 174473 | 616459 | 8197 | 483822 | 28876 | | GBAP1 | 160766 | 566701 | 8273 | N/A | |
| GALR1 | 166573 | 299727 | 8198 | 299727 | 28877 | | GBAP1 | 160766 | 463838 | 8274 | N/A | |
| GALR1 | 166573 | 582943 | 8199 | N/A | | | GBAP1 | 160766 | 462587 | 8275 | N/A | |
| GAP43 | 172020 | 305124 | 8200 | 305010 | 28878 | 15 | GCA | 115271 | 473240 | 8276 | N/A | |
| GAP43 | 172020 | 393780 | 8201 | 377372 | 28879 | | GCA | 115271 | 446271 | 8277 | 393218 | 28915 |
| GAPDH | 111640 | 229239 | 8202 | 229239 | 28880 | | GCA | 115271 | 429691 | 8278 | 412899 | 28916 |
| GAPDH | 111640 | 496049 | 8203 | N/A | | | GCA | 115271 | 437150 | 8279 | 394842 | 28917 |
| GAPDH | 111640 | 396856 | 8204 | 380065 | 28881 | | GCA | 115271 | 481161 | 8280 | N/A | |
| GAPDH | 111640 | 492719 | 8205 | N/A | | | GCA | 115271 | 453113 | 8281 | 403805 | 28918 |
| GAPDH | 111640 | 396861 | 8206 | 380070 | 28882 | 20 | GCA | 115271 | 487445 | 8282 | N/A | |
| GAPDH | 111640 | 474249 | 8207 | N/A | | | GCA | 115271 | 479199 | 8283 | N/A | |
| GAPDH | 111640 | 466588 | 8208 | N/A | | | GCA | 115271 | 233612 | 8284 | 233612 | 28919 |
| GAPDH | 111640 | 396859 | 8209 | 380068 | 28883 | | GCA | 115271 | 414723 | 8285 | 408620 | 28920 |
| GAPDH | 111640 | 466525 | 8210 | N/A | | | GCH1 | 131979 | 543643 | 8286 | 444011 | 28921 |
| GAPDH | 111640 | 396858 | 8211 | 380067 | 28884 | | GCH1 | 131979 | 491895 | 8287 | 419045 | 28922 |
| GAPDH | 111640 | 619601 | 8212 | 478864 | 28885 | 25 | GCH1 | 131979 | 254299 | 8288 | N/A | |
| GAREM2 | 157833 | 401533 | 8213 | 384593 | 28886 | | GCH1 | 131979 | 536224 | 8289 | 445246 | 28923 |
| GAREM2 | 157833 | 407684 | 8214 | 384581 | 28887 | | GCH1 | 131979 | 395521 | 8290 | N/A | |
| GAREM2 | 157833 | 496070 | 8215 | N/A | | | GCH1 | 131979 | 622544 | 8291 | 477796 | 28924 |
| GARNL3 | 136895 | 439286 | 8216 | 400579 | 28888 | | GCH1 | 131979 | 395514 | 8292 | 378890 | 28925 |
| GARNL3 | 136895 | 444677 | 8217 | 411160 | 28889 | | GCK | 106633 | 459642 | 8293 | N/A | |
| GARNL3 | 136895 | 429629 | 8218 | 397246 | 28890 | | GCK | 106633 | 336642 | 8294 | 338009 | 28926 |
| GARNL3 | 136895 | 453030 | 8219 | 389679 | 28891 | 30 | GCK | 106633 | 403799 | 8295 | 384247 | 28927 |
| GARNL3 | 136895 | 446764 | 8220 | 416473 | 28892 | | GCK | 106633 | 395796 | 8296 | 379142 | 28928 |
| GARNL3 | 136895 | 441134 | 8221 | 396319 | 28893 | | GCK | 106633 | 345378 | 8297 | 223366 | 28929 |
| GARNL3 | 136895 | 478702 | 8222 | N/A | | | GCK | 106633 | 437084 | 8298 | 402840 | 28930 |
| GARNL3 | 136895 | 425970 | 8223 | 411329 | 28894 | | GCK | 106633 | 473353 | 8299 | N/A | |
| GARNL3 | 136895 | 498801 | 8224 | N/A | | | GCK | 106633 | 476008 | 8300 | N/A | |
| GARNL3 | 136895 | 487565 | 8225 | N/A | | 35 | GCK | 106633 | 616242 | 8301 | 482149 | 28931 |
| GARNL3 | 136895 | 373387 | 8226 | 362485 | 28895 | | GDA | 119125 | 376986 | 8302 | 366185 | 28932 |
| GARNL3 | 136895 | 373386 | 8227 | 362484 | 28896 | | GDA | 119125 | 358399 | 8303 | 351170 | 28933 |
| GARNL3 | 136895 | 464616 | 8228 | N/A | | | GDA | 119125 | 475764 | 8304 | 436619 | 28934 |
| GARNL3 | 136895 | 495172 | 8229 | N/A | | | GDA | 119125 | 477618 | 8305 | N/A | |
| GARNL3 | 136895 | 460176 | 8230 | 474589 | 28897 | | GDA | 119125 | 414671 | 8306 | 403897 | 28935 |
| GARNL3 | 136895 | 481875 | 8231 | N/A | | | GDA | 119125 | 489618 | 8307 | 434682 | 28936 |
| GARNL3 | 136895 | 478696 | 8232 | N/A | | 40 | GDA | 119125 | 436438 | 8308 | 400857 | 28937 |
| GARNL3 | 136895 | 496711 | 8233 | N/A | | | GDA | 119125 | 238018 | 8309 | 238018 | 28938 |
| GARNL3 | 136895 | 481242 | 8234 | N/A | | | GDA | 119125 | 545168 | 8310 | 437972 | 28939 |
| GARNL3 | 136895 | 497703 | 8235 | N/A | | | GDF10 | 266524 | 580279 | 8311 | 464145 | 28940 |
| GARNL3 | 136895 | 463005 | 8236 | N/A | | | GDF11 | 135414 | 257868 | 8312 | 257868 | 28941 |
| GARNL3 | 136895 | 435213 | 8237 | 396205 | 28898 | | GDF11 | 135414 | 546799 | 8313 | 448390 | 28942 |
| GAS1 | 180447 | 298743 | 8238 | 298743 | 28899 | 45 | GDPD4 | 178795 | 376217 | 8314 | 365390 | 28943 |
| GATM | 171766 | 396659 | 8239 | 379895 | 28900 | | GDPD4 | 178795 | 315938 | 8315 | 320815 | 28944 |
| GATM | 171766 | 558362 | 8240 | N/A | | | GDPD4 | 178795 | 532907 | 8316 | N/A | |
| GATM | 171766 | 558336 | 8241 | 454008 | 28901 | | GDPD4 | 178795 | 532155 | 8317 | N/A | |
| GATM | 171766 | 561376 | 8242 | N/A | | | GDPD4 | 178795 | 527489 | 8318 | N/A | |
| GATM | 171766 | 558916 | 8243 | N/A | | | GDPD4 | 178795 | 534245 | 8319 | N/A | |
| GATM | 171766 | 558163 | 8244 | 453781 | 28902 | 50 | GDPD5 | 158555 | 526177 | 8320 | 434050 | 28945 |
| GATM | 171766 | 558537 | 8245 | 453151 | 28903 | | GDPD5 | 158555 | 527820 | 8321 | 437123 | 28946 |
| GATM | 171766 | 561148 | 8246 | 453860 | 28904 | | GDPD5 | 158555 | 533784 | 8322 | 437049 | 28947 |
| GATM | 171766 | 559885 | 8247 | 453087 | 28905 | | GDPD5 | 158555 | 529741 | 8323 | 433214 | 28948 |
| GATM | 171766 | 558118 | 8248 | 452971 | 28906 | | GDPD5 | 158555 | 336898 | 8324 | 337972 | 28949 |
| GATM | 171766 | 560538 | 8249 | N/A | | | GDPD5 | 158555 | 533805 | 8325 | 435196 | 28950 |
| GATM | 171766 | 458245 | 8250 | N/A | | 55 | GDPD5 | 158555 | 531759 | 8326 | N/A | |
| GATM | 171766 | 527933 | 8251 | N/A | | | GDPD5 | 158555 | 534322 | 8327 | 435728 | 28951 |
| CASTOR2 | 274070 | 616305 | 8252 | 484732 | 28907 | | GDPD5 | 158555 | 531561 | 8328 | N/A | |
| CASTOR2 | 274070 | 622472 | 8253 | N/A | | | GDPD5 | 158555 | 527322 | 8329 | N/A | |
| CASTOR1 | 239282 | 459785 | 8254 | N/A | | | GDPD5 | 158555 | 533911 | 8330 | N/A | |
| CASTOR1 | 239282 | 407689 | 8255 | 384183 | 28908 | | GDPD5 | 158555 | 528031 | 8331 | N/A | |
| CASTOR1 | 239282 | 404953 | 8256 | 385868 | 28909 | 60 | GDPD5 | 158555 | 532435 | 8332 | 433727 | 28952 |
| CASTOR1 | 239282 | 440839 | 8257 | 411842 | 28910 | | GDPD5 | 158555 | 529095 | 8333 | N/A | |
| CASTOR1 | 239282 | 421236 | 8258 | 390869 | 28911 | | GDPD5 | 158555 | 524785 | 8334 | N/A | |
| CASTOR1 | 239282 | 497605 | 8259 | N/A | | | GDPD5 | 158555 | 531441 | 8335 | N/A | |
| CASTOR1 | 239282 | 415484 | 8260 | 416041 | 28912 | | GDPD5 | 158555 | 443276 | 8336 | 396535 | 28953 |
| CASTOR1 | 239282 | 425691 | 8261 | 408419 | 28913 | | GEM | 164949 | 396194 | 8337 | 379497 | 28954 |
| CASTOR1 | 239282 | 463795 | 8262 | N/A | | 65 | GEM | 164949 | 297596 | 8338 | 297596 | 28955 |
| CASTOR1 | 239282 | 471480 | 8263 | N/A | | | GEM | 164949 | 523660 | 8339 | N/A | |

-continued

| Symbol | ENSG | ENST | SEQ ID | ENSP | SEQ ID |
|---|---|---|---|---|---|
| GEM | 164949 | 521817 | 8340 | N/A | |
| GEM | 164949 | 523433 | 8341 | 428258 | 28956 |
| GFAP | 131095 | 639277 | 8342 | 492432 | 28957 |
| GFAP | 131095 | 588735 | 8343 | 466598 | 28958 |
| GFAP | 131095 | 638304 | 8344 | 491042 | 28959 |
| GFAP | 131095 | 441312 | 8345 | N/A | |
| GFAP | 131095 | 639243 | 8346 | 491375 | 28960 |
| GFAP | 131095 | 638488 | 8347 | N/A | |
| GFAP | 131095 | 639369 | 8348 | 491243 | 28961 |
| GFAP | 131095 | 592065 | 8349 | N/A | |
| GFAP | 131095 | 640859 | 8350 | 492300 | 28962 |
| GFAP | 131095 | 638400 | 8351 | 491466 | 28963 |
| GFAP | 131095 | 639042 | 8352 | 492860 | 28964 |
| GFAP | 131095 | 640545 | 8353 | 491735 | 28965 |
| GFAP | 131095 | 638921 | 8354 | N/A | |
| GFAP | 131095 | 253408 | 8355 | 253408 | 28966 |
| GFAP | 131095 | 586125 | 8356 | 467397 | 28967 |
| GFAP | 131095 | 638618 | 8357 | 492832 | 28968 |
| GFAP | 131095 | 589701 | 8358 | N/A | |
| GFAP | 131095 | 592706 | 8359 | N/A | |
| GFAP | 131095 | 585543 | 8360 | N/A | |
| GFAP | 131095 | 591880 | 8361 | 467530 | 28969 |
| GFAP | 131095 | 588640 | 8362 | N/A | |
| GFAP | 131095 | 640552 | 8363 | N/A | |
| GFAP | 131095 | 435360 | 8364 | 403962 | 28970 |
| GFAP | 131095 | 591327 | 8365 | N/A | |
| GFAP | 131095 | 638281 | 8366 | 491088 | 28971 |
| GFAP | 131095 | 639921 | 8367 | 492156 | 28972 |
| GFAP | 131095 | 592320 | 8368 | 465320 | 28973 |
| GFAP | 131095 | 586127 | 8369 | N/A | |
| GFAP | 131095 | 586793 | 8370 | 468500 | 28974 |
| GFAP | 131095 | 587997 | 8371 | N/A | |
| GFAP | 131095 | 376990 | 8372 | 366189 | 28975 |
| GFAP | 131095 | 591719 | 8373 | N/A | |
| GFAP | 131095 | 590922 | 8374 | N/A | |
| GFAP | 131095 | 588957 | 8375 | 465565 | 28976 |
| GFAP | 131095 | 588316 | 8376 | 465629 | 28977 |
| GFAP | 131095 | 585728 | 8377 | 465208 | 28978 |
| GFAP | 131095 | 588037 | 8378 | 466163 | 28979 |
| GFAP | 131095 | 593179 | 8379 | 467106 | 28980 |
| GFRA2 | 168546 | 524240 | 8380 | 428518 | 28981 |
| GFRA2 | 168546 | 306793 | 8381 | 306654 | 28982 |
| GFRA2 | 168546 | 517328 | 8382 | 429445 | 28983 |
| GFRA2 | 168546 | 518077 | 8383 | 429206 | 28984 |
| GFRA2 | 168546 | 517892 | 8384 | 429979 | 28985 |
| GFRA2 | 168546 | 522071 | 8385 | 428721 | 28986 |
| GFRA2 | 168546 | 519195 | 8386 | 430622 | 28987 |
| GFRA2 | 168546 | 520676 | 8387 | N/A | |
| GHITM | 165678 | 372134 | 8388 | 361207 | 28988 |
| GHR | 112964 | 230882 | 8389 | 230882 | 28989 |
| GHR | 112964 | 513671 | 8390 | 426739 | 28990 |
| GHR | 112964 | 505006 | 8391 | N/A | |
| GHR | 112964 | 511135 | 8392 | 422333 | 28991 |
| GHR | 112964 | 513625 | 8393 | N/A | |
| GHR | 112964 | 615111 | 8394 | 478291 | 28992 |
| GHR | 112964 | 618088 | 8395 | 482373 | 28993 |
| GHR | 112964 | 357703 | 8396 | 350335 | 28994 |
| GHR | 112964 | 537449 | 8397 | 442206 | 28995 |
| GHR | 112964 | 612382 | 8398 | 478332 | 28996 |
| GHR | 112964 | 622294 | 8399 | 483926 | 28997 |
| GHR | 112964 | 620156 | 8400 | 483403 | 28998 |
| GHR | 112964 | 612626 | 8401 | 479846 | 28999 |
| GIPC2 | 137960 | 476882 | 8402 | N/A | |
| GIPC2 | 137960 | 370759 | 8403 | 359795 | 29000 |
| GIPR | 010310 | 590918 | 8404 | 467494 | 29001 |
| GIPR | 010310 | 263281 | 8405 | 263281 | 29002 |
| GIPR | 010310 | 304207 | 8406 | 305321 | 29003 |
| GIPR | 010310 | 585889 | 8407 | 467342 | 29004 |
| GIPR | 010310 | 591322 | 8408 | 465385 | 29005 |
| GIPR | 010310 | 588816 | 8409 | N/A | |
| GIPR | 010310 | 591224 | 8410 | N/A | |
| GIPR | 010310 | 593127 | 8411 | N/A | |
| GJA1 | 152661 | 282561 | 8412 | 282561 | 29006 |
| GJB1 | 169562 | 374029 | 8413 | 363141 | 29007 |
| GJB1 | 169562 | 374022 | 8414 | 363134 | 29008 |
| GJB1 | 169562 | 447581 | 8415 | 407223 | 29009 |

-continued

| Symbol | ENSG | ENST | SEQ ID | ENSP | SEQ ID |
|---|---|---|---|---|---|
| GJB1 | 169562 | 361726 | 8416 | 354900 | 29010 |
| GJB4 | 189433 | 339480 | 8417 | 345868 | 29011 |
| GJB6 | 121742 | 241124 | 8418 | 241124 | 29012 |
| GJB6 | 121742 | 400066 | 8419 | 382939 | 29013 |
| GJB6 | 121742 | 400065 | 8420 | 382938 | 29014 |
| GJB6 | 121742 | 356192 | 8421 | 348521 | 29015 |
| GJB6 | 121742 | 636852 | 8422 | 489698 | 29016 |
| GJC2 | 198835 | 366714 | 8423 | 355675 | 29017 |
| GJC3 | 176402 | 312891 | 8424 | 325775 | 29018 |
| GJD2 | 159248 | 290374 | 8425 | 290374 | 29019 |
| SLC1A3 | 079215 | 265113 | 8426 | 265113 | 29020 |
| SLC1A3 | 079215 | 513903 | 8427 | 427203 | 29021 |
| SLC1A3 | 079215 | 504121 | 8428 | N/A | |
| SLC1A3 | 079215 | 512374 | 8429 | N/A | |
| SLC1A3 | 079215 | 416645 | 8430 | N/A | |
| SLC1A3 | 079215 | 506725 | 8431 | N/A | |
| SLC1A3 | 079215 | 505202 | 8432 | 424986 | 29022 |
| SLC1A3 | 079215 | 513646 | 8433 | 420992 | 29023 |
| SLC1A3 | 079215 | 502864 | 8434 | N/A | |
| SLC1A3 | 079215 | 514563 | 8435 | N/A | |
| SLC1A3 | 079215 | 509272 | 8436 | N/A | |
| SLC1A3 | 079215 | 505376 | 8437 | N/A | |
| SLC1A3 | 079215 | 506178 | 8438 | N/A | |
| SLC1A3 | 079215 | 612708 | 8439 | 483657 | 29024 |
| SLC1A3 | 079215 | 381918 | 8440 | 371343 | 29025 |
| SLC1A3 | 079215 | 613445 | 8441 | 477672 | 29026 |
| SLC1A3 | 079215 | 265113 | 8442 | 265113 | 29027 |
| SLC1A3 | 079215 | 513903 | 8443 | 427203 | 29028 |
| SLC1A3 | 079215 | 504121 | 8444 | N/A | |
| SLC1A3 | 079215 | 512374 | 8445 | N/A | |
| SLC1A3 | 079215 | 416645 | 8446 | N/A | |
| SLC1A3 | 079215 | 506725 | 8447 | N/A | |
| SLC1A3 | 079215 | 505202 | 8448 | 424986 | 29029 |
| SLC1A3 | 079215 | 513616 | 8449 | 420992 | 29030 |
| SLC1A3 | 079215 | 502864 | 8450 | N/A | |
| SLC1A3 | 079215 | 514563 | 8451 | N/A | |
| SLC1A3 | 079215 | 509272 | 8452 | N/A | |
| SLC1A3 | 079215 | 505376 | 8453 | N/A | |
| SLC1A3 | 079215 | 506178 | 8454 | N/A | |
| SLC1A3 | 079215 | 612708 | 8455 | 483657 | 29031 |
| SLC1A3 | 079215 | 381918 | 8456 | 371343 | 29032 |
| SLC1A3 | 079215 | 613445 | 8457 | 477672 | 29033 |
| GLB1L3 | 166105 | 389887 | 8458 | 374537 | 29034 |
| GLB1L3 | 166105 | 431683 | 8459 | 396615 | 29035 |
| GLB1L3 | 166105 | 532985 | 8460 | N/A | |
| GLB1L3 | 166105 | 486034 | 8461 | N/A | |
| GLB1L3 | 166105 | 498012 | 8462 | N/A | |
| GLB1L3 | 166105 | 455971 | 8463 | 397929 | 29036 |
| GLB1L3 | 166105 | 410100 | 8464 | N/A | |
| GLB1L3 | 166105 | 467068 | 8465 | N/A | |
| GLDC | 178445 | 321612 | 8466 | 370737 | 29037 |
| GLDC | 178445 | 638274 | 8467 | 491487 | 29038 |
| GLDC | 178445 | 639639 | 8468 | 491312 | 29039 |
| GLDC | 178445 | 640505 | 8469 | N/A | |
| GLDC | 178445 | 638233 | 8470 | N/A | |
| GLDC | 178445 | 639364 | 8471 | N/A | |
| GLDC | 178445 | 638661 | 8472 | 491369 | 29040 |
| GLDC | 178445 | 639461 | 8473 | N/A | |
| GLDC | 178445 | 639954 | 8474 | N/A | |
| GLDC | 178445 | 639318 | 8475 | 491932 | 29041 |
| GLDC | 178445 | 638694 | 8476 | N/A | |
| GLDC | 178445 | 477960 | 8477 | N/A | |
| GLDC | 178445 | 639443 | 8478 | N/A | |
| GLDC | 178445 | 640592 | 8479 | N/A | |
| GLDC | 178445 | 460457 | 8480 | N/A | |
| GLDC | 178445 | 640208 | 8481 | 491895 | 29042 |
| GLDC | 178445 | 463305 | 8482 | 491209 | 29043 |
| GLDC | 178445 | 640703 | 8483 | N/A | |
| GLDC | 178445 | 639493 | 8484 | N/A | |
| GLDC | 178445 | 638654 | 8485 | 491101 | 29044 |
| GLDC | 178445 | 639840 | 8486 | 491161 | 29045 |
| GLDC | 178445 | 639020 | 8487 | 491392 | 29046 |
| GLDN | 186417 | 335449 | 8488 | 335196 | 29047 |
| GLDN | 186417 | 560215 | 8489 | 484633 | 29048 |
| GLDN | 186417 | 558286 | 8490 | N/A | |
| GLDN | 186417 | 560690 | 8491 | N/A | |

-continued

-continued

| Symbol | ENSG | ENST | SEQ ID | ENSP | SEQ ID |
|---|---|---|---|---|---|
| GLDN | 186417 | 559317 | 8492 | N/A | |
| GLDN | 186417 | 464150 | 8493 | N/A | |
| GLDN | 186417 | 396399 | 8494 | 379681 | 29049 |
| GLDN | 186417 | 561194 | 8495 | N/A | |
| GLDN | 186417 | 558426 | 8496 | 453433 | 29050 |
| GLDN | 186417 | 612989 | 8497 | 479249 | 29051 |
| GLI1 | 111087 | 532291 | 8498 | 436671 | 29052 |
| GLI1 | 111087 | 228682 | 8499 | 228682 | 29053 |
| GLI1 | 111087 | 528432 | 8500 | 434421 | 29054 |
| GLI1 | 111087 | 530789 | 8501 | N/A | |
| GLI1 | 111087 | 528467 | 8502 | 434408 | 29055 |
| GLI1 | 111087 | 527742 | 8503 | N/A | |
| GLI1 | 111087 | 543426 | 8504 | 437607 | 29056 |
| GLI1 | 111087 | 546141 | 8505 | 441006 | 29057 |
| GLI2 | 074047 | 482119 | 8506 | N/A | |
| GLI2 | 074047 | 472722 | 8507 | N/A | |
| GLI2 | 074047 | 418323 | 8508 | 398992 | 29058 |
| GLI2 | 074047 | 438299 | 8509 | 400593 | 29059 |
| GLI2 | 074047 | 452692 | 8510 | 403715 | 29060 |
| GLI2 | 074047 | 445186 | 8511 | 397488 | 29061 |
| GLI2 | 074047 | 341310 | 8512 | 344473 | 29062 |
| GLI2 | 074047 | 452319 | 8513 | 390436 | 29063 |
| GLI2 | 074047 | 437950 | 8514 | 415773 | 29064 |
| GLI2 | 074047 | 435313 | 8515 | N/A | |
| GLI2 | 074047 | 360874 | 8516 | 441454 | 29065 |
| GLI2 | 074047 | 433812 | 8517 | 402383 | 29066 |
| GLI2 | 074047 | 361492 | 8518 | 354586 | 29067 |
| GLI3 | 106571 | 395925 | 8519 | 379258 | 29068 |
| GLI3 | 106571 | 479210 | 8520 | N/A | |
| GLI3 | 106571 | 464291 | 8521 | N/A | |
| GLI3 | 106571 | 448703 | 8522 | 406135 | 29069 |
| GLI3 | 106571 | 437480 | 8523 | 407963 | 29070 |
| GLI3 | 106571 | 428534 | 8524 | N/A | |
| GLIPR1 | 139278 | 266659 | 8525 | 266659 | 29071 |
| GLIPR1 | 139278 | 536703 | 8526 | 440594 | 29072 |
| GLIPR1 | 139278 | 456650 | 8527 | 391144 | 29073 |
| GLIPR1 | 139278 | 550491 | 8528 | 448008 | 29074 |
| GLIPR2 | 122694 | 377959 | 8529 | 367195 | 29075 |
| GLIPR2 | 122694 | 377960 | 8530 | 367196 | 29076 |
| GLIPR2 | 122694 | 474050 | 8531 | N/A | |
| GLIPR2 | 122694 | 619700 | 8532 | 478768 | 29077 |
| GLIPR2 | 122694 | 396613 | 8533 | 379857 | 29078 |
| GLIS1 | 174332 | 312233 | 8534 | 309653 | 29079 |
| GLIS1 | 174332 | 628545 | 8535 | 486112 | 29080 |
| GLIS3 | 107249 | 324333 | 8536 | 325494 | 29081 |
| GLIS3 | 107249 | 461870 | 8537 | N/A | |
| GLIS3 | 107249 | 381971 | 8538 | 371398 | 29082 |
| GLIS3 | 107249 | 467497 | 8539 | N/A | |
| GLIS3 | 107249 | 463680 | 8540 | N/A | |
| GLIS3 | 107249 | 464391 | 8541 | N/A | |
| GLIS3 | 107249 | 469833 | 8542 | N/A | |
| GLIS3 | 107249 | 490709 | 8543 | N/A | |
| GLIS3 | 107249 | 473846 | 8544 | N/A | |
| GLIS3 | 107249 | 462164 | 8545 | 418671 | 29083 |
| GLIS3 | 107249 | 478315 | 8546 | 418995 | 29084 |
| GLIS3 | 107249 | 478844 | 8547 | 418005 | 29085 |
| GLIS3 | 107249 | 481827 | 8548 | 417883 | 29086 |
| GLIS3 | 107249 | 491889 | 8549 | 419914 | 29087 |
| GLIS3 | 107249 | 477901 | 8550 | 417794 | 29088 |
| GLIS3 | 107249 | 465708 | 8551 | N/A | |
| GLIS3 | 107249 | 471664 | 8552 | N/A | |
| GLP2R | 065325 | 574745 | 8553 | 458242 | 29089 |
| GLP2R | 065325 | 262441 | 8554 | 262441 | 29090 |
| GLP2R | 065325 | 458005 | 8555 | 404471 | 29091 |
| GLP2R | 065325 | 304773 | 8556 | 303605 | 29092 |
| GLRA1 | 145888 | 274576 | 8557 | 274576 | 29093 |
| GLRA1 | 145888 | 462581 | 8558 | 430595 | 29094 |
| GLRA1 | 145888 | 455880 | 8559 | 411593 | 29095 |
| GLRA1 | 145888 | 471351 | 8560 | N/A | |
| GLUD1 | 148672 | 277865 | 8561 | 277865 | 29096 |
| GLUD1 | 148672 | 487058 | 8562 | N/A | |
| GLUD1 | 148672 | 465164 | 8563 | N/A | |
| GLUD1 | 148672 | 474574 | 8564 | N/A | |
| GLUL | 135821 | 331872 | 8565 | 356537 | 29097 |
| GLUL | 135821 | 491322 | 8566 | N/A | |
| GLUL | 135821 | 339526 | 8567 | 344958 | 29098 |

| Symbol | ENSG | ENST | SEQ ID | ENSP | SEQ ID |
|---|---|---|---|---|---|
| GLUL | 135821 | 463851 | 8568 | N/A | |
| GLUL | 135821 | 461447 | 8569 | N/A | |
| GLUL | 135821 | 484996 | 8570 | N/A | |
| GLUL | 135821 | 489818 | 8571 | N/A | |
| GLUL | 135821 | 475808 | 8572 | N/A | |
| GLUL | 135821 | 480604 | 8573 | N/A | |
| GLUL | 135821 | 462444 | 8574 | N/A | |
| GLUL | 135821 | 311223 | 8575 | 307900 | 29099 |
| GLUL | 135821 | 417584 | 8576 | 398320 | 29100 |
| C6orf163 | 203872 | 388923 | 8577 | 373575 | 29101 |
| C6orf163 | 203872 | 608326 | 8578 | 477323 | 29102 |
| C6orf163 | 203872 | 369574 | 8579 | N/A | |
| C6orf163 | 203872 | 608891 | 8580 | N/A | |
| TF | 091513 | 402696 | 8581 | 385834 | 29103 |
| TF | 091513 | 466911 | 8582 | 417468 | 29104 |
| TF | 091513 | 474287 | 8583 | N/A | |
| TF | 091513 | 460531 | 8584 | N/A | |
| TF | 091513 | 414694 | 8585 | 401505 | 29105 |
| TF | 091513 | 494430 | 8586 | 418396 | 29106 |
| TF | 091513 | 493011 | 8587 | N/A | |
| TF | 091513 | 482271 | 8588 | 419338 | 29107 |
| TF | 091513 | 485977 | 8589 | 418716 | 29108 |
| TF | 091513 | 475382 | 8590 | N/A | |
| TF | 091513 | 498622 | 8591 | N/A | |
| TF | 091513 | 461695 | 8592 | 419714 | 29109 |
| TF | 091513 | 462495 | 8593 | N/A | |
| TF | 091513 | 467842 | 8594 | N/A | |
| TF | 091513 | 402696 | 8595 | 385834 | 29110 |
| TF | 091513 | 466911 | 8596 | 417468 | 29111 |
| TF | 091513 | 474287 | 8597 | N/A | |
| TF | 091513 | 460531 | 8598 | N/A | |
| TF | 091513 | 414694 | 8599 | 401505 | 29112 |
| TF | 091513 | 494430 | 8600 | 418396 | 29113 |
| TF | 091513 | 493011 | 8601 | N/A | |
| TF | 091513 | 482271 | 8602 | 419338 | 29114 |
| TF | 091513 | 485977 | 8603 | 418716 | 29115 |
| TF | 091513 | 475382 | 8604 | N/A | |
| TF | 091513 | 498622 | 8605 | N/A | |
| TF | 091513 | 461695 | 8606 | 419714 | 29116 |
| TF | 091513 | 462495 | 8607 | N/A | |
| TF | 091513 | 467842 | 8608 | N/A | |
| GNA12 | 146535 | 275364 | 8609 | 275364 | 29117 |
| GNA12 | 146535 | 491117 | 8610 | N/A | |
| GNA12 | 146535 | 407904 | 8611 | 385935 | 29118 |
| GNA12 | 146535 | 407653 | 8612 | 386054 | 29119 |
| GNA12 | 146535 | 496740 | 8613 | N/A | |
| GNA12 | 146535 | 471281 | 8614 | N/A | |
| GNA12 | 146535 | 485329 | 8615 | N/A | |
| GNA12 | 146535 | 447791 | 8616 | 391462 | 29120 |
| GNAL | 141404 | 334049 | 8617 | 334051 | 29121 |
| GNAL | 141404 | 585590 | 8618 | N/A | |
| GNAL | 141404 | 535121 | 8619 | 439023 | 29122 |
| GNAL | 141404 | 269162 | 8620 | 269162 | 29123 |
| GNAL | 141404 | 423027 | 8621 | 408489 | 29124 |
| GNAL | 141404 | 585642 | 8622 | 467345 | 29125 |
| GNAL | 141404 | 590972 | 8623 | N/A | |
| GNAL | 141404 | 590228 | 8624 | 467709 | 29126 |
| GNAL | 141404 | 602628 | 8625 | 473600 | 29127 |
| GNAL | 141404 | 586926 | 8626 | 466709 | 29128 |
| GNAO1 | 087258 | 262493 | 8627 | 262493 | 29129 |
| GNAO1 | 087258 | 569295 | 8628 | 492271 | 29130 |
| GNAO1 | 087258 | 638705 | 8629 | 491223 | 29131 |
| GNAO1 | 087258 | 262494 | 8630 | 262494 | 29132 |
| GNAO1 | 087258 | 570235 | 8631 | 477740 | 29133 |
| GNAO1 | 087258 | 563661 | 8632 | 492694 | 29134 |
| GNAO1 | 087258 | 639966 | 8633 | N/A | |
| GNAO1 | 087258 | 610893 | 8634 | 492677 | 29135 |
| GNAO1 | 087258 | 639770 | 8635 | 491999 | 29136 |
| GNAO1 | 087258 | 565363 | 8636 | N/A | |
| GNAO1 | 087258 | 638836 | 8637 | N/A | |
| GNAO1 | 087258 | 639251 | 8638 | N/A | |
| GNAO1 | 087258 | 640390 | 8639 | N/A | |
| GNAO1 | 087258 | 638210 | 8640 | N/A | |
| GNAO1 | 087258 | 563440 | 8641 | N/A | |
| GNAO1 | 087258 | 638185 | 8642 | N/A | |
| GNAO1 | 087258 | 639055 | 8643 | N/A | |

-continued

| Symbol | ENSG | ENST | SEQ ID | ENSP | SEQ ID |
|---|---|---|---|---|---|
| GNAO1 | 087258 | 639268 | 8644 | 491391 | 29137 |
| GNAO1 | 087258 | 562316 | 8645 | 457238 | 29138 |
| GNAO1 | 087258 | 639341 | 8646 | 491137 | 29139 |
| GNAO1 | 087258 | 640560 | 8647 | N/A | |
| GNAO1 | 087258 | 568375 | 8648 | 491143 | 29140 |
| GNAO1 | 087258 | 640469 | 8649 | 491875 | 29141 |
| GNAO1 | 087258 | 564727 | 8650 | 454971 | 29142 |
| GNAO1 | 087258 | 639787 | 8651 | N/A | |
| GNAO1 | 087258 | 564798 | 8652 | N/A | |
| GNB3 | 111664 | 540458 | 8653 | N/A | |
| GNB3 | 111664 | 229264 | 8654 | 229264 | 29143 |
| GNB3 | 111664 | 541257 | 8655 | 442002 | 29144 |
| GNB3 | 111664 | 541978 | 8656 | 439753 | 29145 |
| GNB3 | 111664 | 435982 | 8657 | 414734 | 29146 |
| GNB3 | 111664 | 539127 | 8658 | 444325 | 29147 |
| GNB3 | 111664 | 542868 | 8659 | N/A | |
| GNB3 | 111664 | 537035 | 8660 | 445967 | 29148 |
| GNB3 | 111664 | 542751 | 8661 | N/A | |
| GNG11 | 127920 | 248564 | 8662 | 248564 | 29149 |
| GNG12 | 172380 | 370982 | 8663 | 360021 | 29150 |
| GNG12 | 172380 | 494936 | 8664 | N/A | |
| GNG13 | 127588 | 248150 | 8665 | 248150 | 29151 |
| GNG2 | 186469 | 553432 | 8666 | 451279 | 29152 |
| GNG2 | 186469 | 556522 | 8667 | 450904 | 29153 |
| GNG2 | 186469 | 557376 | 8668 | 450758 | 29154 |
| GNG2 | 186469 | 553560 | 8669 | 450586 | 29155 |
| GNG2 | 186469 | 554832 | 8670 | N/A | |
| GNG2 | 186469 | 553299 | 8671 | N/A | |
| GNG2 | 186469 | 335281 | 8672 | 334448 | 29156 |
| GNG2 | 186469 | 557208 | 8673 | N/A | |
| GNG2 | 186469 | 555472 | 8674 | 451102 | 29157 |
| GNG2 | 186469 | 556766 | 8675 | 451231 | 29158 |
| GNG2 | 186469 | 554840 | 8676 | N/A | |
| GNG2 | 186469 | 554736 | 8677 | 452014 | 29159 |
| GNG2 | 186469 | 556752 | 8678 | 451576 | 29160 |
| GNG2 | 186469 | 556471 | 8679 | N/A | |
| GNG2 | 186469 | 554875 | 8680 | 451536 | 29161 |
| GNG2 | 186469 | 615906 | 8681 | 484021 | 29162 |
| GNL3 | 163938 | 479230 | 8682 | 419734 | 29163 |
| GNL3 | 163938 | 418458 | 8683 | 395772 | 29164 |
| GNL3 | 163938 | 468146 | 8684 | N/A | |
| GNL3 | 163938 | 394799 | 8685 | 378278 | 29165 |
| GNL3 | 163938 | 468885 | 8686 | N/A | |
| GNL3 | 163938 | 462550 | 8687 | N/A | |
| GNL3 | 163938 | 492349 | 8688 | 420345 | 29166 |
| GNL3 | 163938 | 496254 | 8689 | N/A | |
| GNL3 | 163938 | 474423 | 8690 | 419895 | 29167 |
| GNL3 | 163938 | 460073 | 8691 | N/A | |
| GNL3 | 163938 | 484022 | 8692 | N/A | |
| GNL3 | 163938 | 497356 | 8693 | N/A | |
| GOLGA7B | 155265 | 370602 | 8694 | 359634 | 29168 |
| GOLGA7B | 155265 | 423054 | 8695 | N/A | |
| GOLGA7B | 155265 | 596005 | 8696 | 471396 | 29169 |
| GOT1 | 120053 | 370508 | 8697 | 359539 | 29170 |
| GOT1 | 120053 | 489349 | 8698 | N/A | |
| GOT1 | 120053 | 471741 | 8699 | N/A | |
| GPATCH4 | 160818 | 368232 | 8700 | 357215 | 29171 |
| GPATCH4 | 160818 | 438976 | 8701 | 396441 | 29172 |
| GPATCH4 | 160818 | 415314 | 8702 | 412620 | 29173 |
| GPATCH4 | 160818 | 494414 | 8703 | N/A | |
| GPATCH4 | 160818 | 497287 | 8704 | N/A | |
| GPATCH4 | 160818 | 463513 | 8705 | 436243 | 29174 |
| GPATCH4 | 160818 | 498641 | 8706 | N/A | |
| GPATCH4 | 160818 | 529520 | 8707 | N/A | |
| GPATCH4 | 160818 | 473910 | 8708 | N/A | |
| GPATCH4 | 160818 | 531129 | 8709 | N/A | |
| GPATCH4 | 160818 | 474904 | 8710 | 436907 | 29175 |
| GPATCH4 | 160818 | 498756 | 8711 | N/A | |
| GPATCH4 | 160818 | 506832 | 8712 | N/A | |
| GPATCH4 | 160818 | 527691 | 8713 | N/A | |
| GPATCH4 | 160818 | 531900 | 8714 | N/A | |
| GPATCH4 | 160818 | 525375 | 8715 | N/A | |
| GPC2 | 213420 | 471717 | 8716 | N/A | |
| GPC2 | 213420 | 480087 | 8717 | 488396 | 29176 |
| GPC2 | 213420 | 490629 | 8718 | N/A | |
| GPC2 | 213420 | 486702 | 8719 | N/A | |

-continued

| Symbol | ENSG | ENST | SEQ ID | ENSP | SEQ ID |
|---|---|---|---|---|---|
| GPC2 | 213420 | 292377 | 8720 | 292377 | 29177 |
| GPC6 | 183098 | 377047 | 8721 | 366246 | 29178 |
| GPC6 | 183098 | 617456 | 8722 | 477667 | 29179 |
| GPCPD1 | 125772 | 379019 | 8723 | 368305 | 29180 |
| GPCPD1 | 125772 | 418646 | 8724 | 396720 | 29181 |
| GPCPD1 | 125772 | 481038 | 8725 | N/A | |
| GPCPD1 | 125772 | 462080 | 8726 | N/A | |
| GPCPD1 | 125772 | 633552 | 8727 | 487616 | 29182 |
| GPCPD1 | 125772 | 473797 | 8728 | N/A | |
| GPCPD1 | 125772 | 481690 | 8729 | 488635 | 29183 |
| GPHN | 171723 | 315266 | 8730 | 312771 | 29184 |
| GPHN | 171723 | 478722 | 8731 | 417901 | 29185 |
| GPHN | 171723 | 459628 | 8732 | 452220 | 29186 |
| GPHN | 171723 | 543237 | 8733 | 438404 | 29187 |
| GPHN | 171723 | 555668 | 8734 | 451935 | 29188 |
| GPHN | 171723 | 556633 | 8735 | 451056 | 29189 |
| GPHN | 171723 | 557654 | 8736 | 451790 | 29190 |
| GPHN | 171723 | 553936 | 8737 | 451725 | 29191 |
| GPHN | 171723 | 556020 | 8738 | N/A | |
| GPHN | 171723 | 544752 | 8739 | N/A | |
| GPHN | 171723 | 555456 | 8740 | 450706 | 29192 |
| GPHN | 171723 | 556501 | 8741 | N/A | |
| GPHN | 171723 | 555527 | 8742 | N/A | |
| GPHN | 171723 | 555503 | 8743 | 452009 | 29193 |
| GPHN | 171723 | 557678 | 8744 | N/A | |
| GPHN | 171723 | 556240 | 8745 | 450442 | 29194 |
| GPNMB | 136235 | 465673 | 8746 | N/A | |
| GPNMB | 136235 | 492858 | 8747 | N/A | |
| GPNMB | 136235 | 258733 | 8748 | 258733 | 29195 |
| GPNMB | 136235 | 381990 | 8749 | 371420 | 29196 |
| GPNMB | 136235 | 409458 | 8750 | 386476 | 29197 |
| GPNMB | 136235 | 459927 | 8751 | N/A | |
| GPNMB | 136235 | 487890 | 8752 | N/A | |
| GPNMB | 136235 | 474157 | 8753 | N/A | |
| GPNMB | 136235 | 492512 | 8754 | N/A | |
| GPNMB | 136235 | 479625 | 8755 | N/A | |
| GPNMB | 136235 | 470994 | 8756 | N/A | |
| GPNMB | 136235 | 463011 | 8757 | N/A | |
| GPNMB | 136235 | 478451 | 8758 | N/A | |
| GPNMB | 136235 | 468723 | 8759 | N/A | |
| GPR107 | 148358 | 372406 | 8760 | 361483 | 29198 |
| GPR107 | 148358 | 347136 | 8761 | 336988 | 29199 |
| GPR107 | 148358 | 493417 | 8762 | 475772 | 29200 |
| GPR107 | 148358 | 462907 | 8763 | N/A | |
| GPR107 | 148358 | 483935 | 8764 | N/A | |
| GPR107 | 148358 | 415344 | 8765 | N/A | |
| GPR107 | 148358 | 372410 | 8766 | 361487 | 29201 |
| GPR107 | 148358 | 610997 | 8767 | 483750 | 29202 |
| GPR135 | 181619 | 481661 | 8768 | 432696 | 29203 |
| GPR135 | 181619 | 395116 | 8769 | 378548 | 29204 |
| GPR153 | 158292 | 377893 | 8770 | 367125 | 29205 |
| GPR161 | 143147 | 367838 | 8771 | 356812 | 29206 |
| GPR161 | 143147 | 478868 | 8772 | N/A | |
| GPR161 | 143147 | 367836 | 8773 | 356810 | 29207 |
| GPR161 | 143147 | 367835 | 8774 | 356809 | 29208 |
| GPR161 | 143147 | 493800 | 8775 | N/A | |
| GPR161 | 143147 | 485232 | 8776 | N/A | |
| GPR161 | 143147 | 546300 | 8777 | 444348 | 29209 |
| GPR161 | 143147 | 271357 | 8778 | 271357 | 29210 |
| GPR161 | 143147 | 539777 | 8779 | 437576 | 29211 |
| GPR161 | 143147 | 537209 | 8780 | 441039 | 29212 |
| GPR22 | 172209 | 473300 | 8781 | N/A | |
| GPR22 | 172209 | 304402 | 8782 | 302676 | 29213 |
| GPR22 | 172209 | 496754 | 8783 | N/A | |
| GPR22 | 283812 | 638179 | 8784 | N/A | |
| GPR22 | 283812 | 639742 | 8785 | 492841 | 29214 |
| GPR22 | 283812 | 640321 | 8786 | N/A | |
| GPR34 | 171659 | 378142 | 8787 | 367384 | 29215 |
| GPR34 | 171659 | 378138 | 8788 | 367378 | 29216 |
| GPR34 | 171659 | 620846 | 8789 | 480296 | 29217 |
| GPR37 | 170775 | 303921 | 8790 | 306449 | 29218 |
| GPR37L1 | 170075 | 367282 | 8791 | 356251 | 29219 |
| GPR63 | 112218 | 229955 | 8792 | 229955 | 29220 |
| GPR84 | 139572 | 267015 | 8793 | 267015 | 29221 |
| GPR84 | 139572 | 551809 | 8794 | 450310 | 29222 |
| GPRASP2 | 158301 | 332262 | 8795 | 339057 | 29223 |

-continued

| Symbol | ENSG | ENST | SEQ ID | ENSP | SEQ ID |
|---|---|---|---|---|---|
| GPRASP2 | 158301 | 483720 | 8796 | N/A | |
| GPRASP2 | 158301 | 486814 | 8797 | N/A | |
| GPRASP2 | 158301 | 543253 | 8798 | 437872 | 29224 |
| GPRASP2 | 158301 | 535209 | 8799 | 437394 | 29225 |
| GPRC5C | 170412 | 482723 | 8800 | N/A | |
| GPRC5C | 170412 | 582873 | 8801 | N/A | |
| GPRC5C | 170412 | 342648 | 8802 | 340595 | 29226 |
| GPRC5C | 170412 | 481232 | 8803 | 462147 | 29227 |
| GPRC5C | 170412 | 582444 | 8804 | 463813 | 29228 |
| GPRC5C | 170412 | 582473 | 8805 | 462440 | 29229 |
| GPRC5C | 170412 | 577663 | 8806 | N/A | |
| GPRC5C | 170412 | 581590 | 8807 | 463090 | 29230 |
| GPRC5C | 170412 | 392629 | 8808 | 376405 | 29231 |
| GPRC5C | 170412 | 392628 | 8809 | 376404 | 29232 |
| GPRC5C | 170412 | 392627 | 8810 | 376403 | 29233 |
| GPSM2 | 121957 | 406462 | 8811 | 385510 | 29234 |
| GPSM2 | 121957 | 435987 | 8812 | 408664 | 29235 |
| GPSM2 | 121957 | 435475 | 8813 | 401948 | 29236 |
| GPSM2 | 121957 | 446797 | 8814 | 392138 | 29237 |
| GPSM2 | 121957 | 441735 | 8815 | 390629 | 29238 |
| GPSM2 | 121957 | 264126 | 8816 | 264126 | 29239 |
| GPX2 | 176153 | 553522 | 8817 | 450991 | 29240 |
| GPX2 | 176153 | 389614 | 8818 | 374265 | 29241 |
| GPX2 | 176153 | 557049 | 8819 | 451721 | 29242 |
| GPX2 | 176153 | 557323 | 8820 | 451844 | 29243 |
| GPX2 | 176153 | 612794 | 8821 | 478082 | 29244 |
| GRAMD2B | 155324 | 513040 | 8822 | 426120 | 29245 |
| GRAMD2B | 155324 | 506445 | 8823 | 424985 | 29246 |
| GRAMD2B | 155324 | 285689 | 8824 | 285689 | 29247 |
| GRAMD2B | 155324 | 515200 | 8825 | 426143 | 29248 |
| GRAMD2B | 155324 | 514932 | 8826 | N/A | |
| GRAMD2B | 155324 | 513913 | 8827 | N/A | |
| GRAMD2B | 155324 | 505720 | 8828 | N/A | |
| GRAMD2B | 155324 | 514099 | 8829 | 423236 | 29249 |
| GRAMD2B | 155324 | 513978 | 8830 | 421494 | 29250 |
| GRAMD2B | 155324 | 502348 | 8831 | 427596 | 29251 |
| GRAMD2B | 155324 | 509882 | 8832 | N/A | |
| GRAMD2B | 155324 | 505441 | 8833 | N/A | |
| GRAMD2B | 155324 | 511134 | 8834 | 426088 | 29252 |
| GRAMD2B | 155324 | 504859 | 8835 | N/A | |
| GRAMD2B | 155324 | 508523 | 8836 | N/A | |
| GRAMD2B | 155324 | 512579 | 8837 | N/A | |
| GRAMD2B | 155324 | 503702 | 8838 | N/A | |
| GRAMD2B | 155324 | 542322 | 8839 | 441876 | 29253 |
| GRAMD2B | 155324 | 544396 | 8840 | 444049 | 29254 |
| GRAMD4 | 075240 | 447351 | 8841 | 409784 | 29255 |
| GRAMD4 | 075240 | 431155 | 8842 | 408042 | 29256 |
| GRAMD4 | 075240 | 406902 | 8843 | 385689 | 29257 |
| GRAMD4 | 075240 | 490378 | 8844 | N/A | |
| GRAMD4 | 075240 | 456069 | 8845 | 397501 | 29258 |
| GRAMD4 | 075240 | 408031 | 8846 | 385851 | 29259 |
| GRAMD4 | 075240 | 361034 | 8847 | 354313 | 29260 |
| GRB10 | 106070 | 402578 | 8848 | 385189 | 29261 |
| GRB10 | 106070 | 403097 | 8849 | 385544 | 29262 |
| GRB10 | 106070 | 406641 | 8850 | 385366 | 29263 |
| GRB10 | 106070 | 357271 | 8851 | 349818 | 29264 |
| GRB10 | 106070 | 407526 | 8852 | 385046 | 29265 |
| GRB10 | 106070 | 401949 | 8853 | 385770 | 29266 |
| GRB10 | 106070 | 402497 | 8854 | 385748 | 29267 |
| GRB10 | 106070 | 461886 | 8855 | N/A | |
| GRB10 | 106070 | 473696 | 8856 | N/A | |
| GRB10 | 106070 | 482397 | 8857 | N/A | |
| GRB10 | 106070 | 428711 | 8858 | 410920 | 29268 |
| GRB10 | 106070 | 439044 | 8859 | 413023 | 29269 |
| GRB10 | 106070 | 465602 | 8860 | N/A | |
| GRB10 | 106070 | 483819 | 8861 | N/A | |
| GRB10 | 106070 | 470992 | 8862 | N/A | |
| GRB10 | 106070 | 483157 | 8863 | N/A | |
| GRB10 | 106070 | 492265 | 8864 | N/A | |
| GRB10 | 106070 | 467386 | 8865 | N/A | |
| GRB10 | 106070 | 478162 | 8866 | N/A | |
| GRB10 | 106070 | 490051 | 8867 | N/A | |
| GRB10 | 106070 | 398812 | 8868 | 381793 | 29270 |
| GRB10 | 106070 | 335866 | 8869 | 338543 | 29271 |
| GRB10 | 106070 | 398810 | 8870 | 381790 | 29272 |
| GRB14 | 115290 | 488342 | 8871 | N/A | |

-continued

| Symbol | ENSG | ENST | SEQ ID | ENSP | SEQ ID |
|---|---|---|---|---|---|
| GRB14 | 115290 | 263915 | 8872 | 263915 | 29273 |
| GRB14 | 115290 | 497306 | 8873 | N/A | |
| GRB14 | 115290 | 446413 | 8874 | 416786 | 29274 |
| GRB14 | 115290 | 469573 | 8875 | N/A | |
| GRB14 | 115290 | 424693 | 8876 | 401702 | 29275 |
| GRB7 | 141738 | 577695 | 8877 | 463416 | 29276 |
| GRB7 | 141738 | 309156 | 8878 | 310771 | 29277 |
| GRB7 | 141738 | 485182 | 8879 | N/A | |
| GRB7 | 141738 | 583813 | 8880 | 463126 | 29278 |
| GRB7 | 141738 | 584853 | 8881 | N/A | |
| GRB7 | 141738 | 584819 | 8882 | N/A | |
| GRB7 | 141738 | 394211 | 8883 | 377761 | 29279 |
| GRB7 | 141738 | 578702 | 8884 | N/A | |
| GRB7 | 141738 | 445327 | 8885 | 403459 | 29280 |
| GRB7 | 141738 | 394209 | 8886 | 377759 | 29281 |
| GRB7 | 141738 | 584053 | 8887 | N/A | |
| GRB7 | 141738 | 394204 | 8888 | 377754 | 29282 |
| GRB7 | 141738 | 461756 | 8889 | N/A | |
| GRB7 | 141738 | 473071 | 8890 | N/A | |
| GREB1 | 196208 | 628795 | 8891 | 487278 | 29283 |
| GREB1 | 196208 | 381486 | 8892 | 370896 | 29284 |
| GREB1 | 196208 | 263834 | 8893 | 263834 | 29285 |
| GREB1 | 196208 | 389825 | 8894 | 374475 | 29286 |
| GREB1 | 196208 | 381483 | 8895 | 370892 | 29287 |
| GREB1 | 196208 | 470980 | 8896 | N/A | |
| GREB1 | 196208 | 432985 | 8897 | 403886 | 29288 |
| GREB1 | 196208 | 396123 | 8898 | 379429 | 29289 |
| GREB1 | 196208 | 472040 | 8899 | N/A | |
| GREB1 | 196208 | 234142 | 8900 | 234142 | 29290 |
| GREB1L | 141449 | 584446 | 8901 | N/A | |
| GREB1L | 141449 | 269218 | 8902 | 269218 | 29291 |
| GREB1L | 141449 | 580732 | 8903 | 464162 | 29292 |
| GREB1L | 141449 | 578368 | 8904 | N/A | |
| GREB1L | 141449 | 579454 | 8905 | 463926 | 29293 |
| GREB1L | 141449 | 581327 | 8906 | 463976 | 29294 |
| GREB1L | 141449 | 580683 | 8907 | N/A | |
| GREB1L | 141449 | 578955 | 8908 | N/A | |
| GREB1L | 141449 | 578383 | 8909 | N/A | |
| GREB1L | 141449 | 580384 | 8910 | 462152 | 29295 |
| GREB1L | 141449 | 424526 | 8911 | 412060 | 29296 |
| GRHL1 | 134317 | 439493 | 8912 | 387521 | 29297 |
| GRHL1 | 134317 | 497403 | 8913 | N/A | |
| GRHL1 | 134317 | 464418 | 8914 | 420654 | 29298 |
| GRHL1 | 134317 | 324907 | 8915 | 324693 | 29299 |
| GRHL1 | 134317 | 472167 | 8916 | 418275 | 29300 |
| GRHL1 | 134317 | 494520 | 8917 | N/A | |
| GRHL1 | 134317 | 480736 | 8918 | 419831 | 29301 |
| GRHL1 | 134317 | 405379 | 8919 | 384209 | 29302 |
| GRIA1 | 155511 | 481559 | 8920 | N/A | |
| GRIA1 | 155511 | 520353 | 8921 | N/A | |
| GRIA1 | 155511 | 518862 | 8922 | N/A | |
| GRIA1 | 155511 | 285900 | 8923 | 285900 | 29303 |
| GRIA1 | 155511 | 474198 | 8924 | N/A | |
| GRIA1 | 155511 | 518142 | 8925 | 427920 | 29304 |
| GRIA1 | 155511 | 340592 | 8926 | 339343 | 29305 |
| GRIA1 | 155511 | 517469 | 8927 | N/A | |
| GRIA1 | 155511 | 521843 | 8928 | 427864 | 29306 |
| GRIA1 | 155511 | 448073 | 8929 | 415569 | 29307 |
| GRIA1 | 155511 | 518783 | 8930 | 428994 | 29308 |
| GRIA1 | 155511 | 492291 | 8931 | N/A | |
| GRIA1 | 155511 | 520966 | 8932 | N/A | |
| GRIA3 | 125675 | 616590 | 8933 | 479607 | 29309 |
| GRIA3 | 125675 | 611689 | 8934 | 478758 | 29310 |
| GRIA3 | 125675 | 541091 | 8935 | 446440 | 29311 |
| GRIA3 | 125675 | 620443 | 8936 | 478489 | 29312 |
| GRIA3 | 125675 | 479118 | 8937 | N/A | |
| GRIA3 | 125675 | 477389 | 8938 | N/A | |
| GRIA3 | 125675 | 460123 | 8939 | N/A | |
| GRIA3 | 125675 | 622768 | 8940 | 481554 | 29313 |
| GRIA3 | 125675 | 620581 | 8941 | 481875 | 29314 |
| GRID1 | 182771 | 327946 | 8942 | 330148 | 29315 |
| GRID1 | 182771 | 552278 | 8943 | N/A | |
| GRID1 | 182771 | 464741 | 8944 | 433064 | 29316 |
| GRID2 | 152208 | 282020 | 8945 | 282020 | 29317 |
| GRID2 | 152208 | 505687 | 8946 | N/A | |
| GRID2 | 152208 | 510992 | 8947 | 421257 | 29318 |

-continued

-continued

| Symbol | ENSG | ENST | SEQ ID | ENSP | SEQ ID |
|---|---|---|---|---|---|
| GRID2 | 152208 | 515744 | 8948 | N/A | |
| GRID2 | 152208 | 502699 | 8949 | 422845 | 29319 |
| GRID2 | 152208 | 512631 | 8950 | 423331 | 29320 |
| GRID2 | 152208 | 513976 | 8951 | 425794 | 29321 |
| GRID2 | 152208 | 637838 | 8952 | 490775 | 29322 |
| GRID2 | 152208 | 611049 | 8953 | 483084 | 29323 |
| GRID2IP | 215045 | 452113 | 8954 | 397887 | 29324 |
| GRID2IP | 215045 | 435185 | 8955 | 408364 | 29325 |
| GRID2IP | 215045 | 457091 | 8956 | 397351 | 29326 |
| GRIK1 | 171189 | 327783 | 8957 | 327687 | 29327 |
| GRIK1 | 171189 | 389125 | 8958 | 373777 | 29328 |
| GRIK1 | 171189 | 399913 | 8959 | 382797 | 29329 |
| GRIK1 | 171189 | 399914 | 8960 | 382798 | 29330 |
| GRIK1 | 171189 | 389124 | 8961 | 373776 | 29331 |
| GRIK1 | 171189 | 399907 | 8962 | 382791 | 29332 |
| GRIK1 | 171189 | 399909 | 8963 | 382793 | 29333 |
| GRIK1 | 171189 | 472429 | 8964 | N/A | |
| GRIK2 | 164418 | 421544 | 8965 | 397026 | 29334 |
| GRIK2 | 164418 | 413795 | 8966 | 405596 | 29335 |
| GRIK2 | 164418 | 369138 | 8967 | 358134 | 29336 |
| GRIK2 | 164418 | 358361 | 8968 | 351128 | 29337 |
| GRIK2 | 164418 | 455610 | 8969 | 391988 | 29338 |
| GRIK2 | 164418 | 436862 | 8970 | 407140 | 29339 |
| GRIK2 | 164418 | 487395 | 8971 | N/A | |
| GRIK2 | 164418 | 487161 | 8972 | N/A | |
| GRIK2 | 164418 | 369134 | 8973 | 358130 | 29340 |
| GRIK2 | 164418 | 318991 | 8974 | 313276 | 29341 |
| GRIK2 | 164418 | 369137 | 8975 | 358133 | 29342 |
| GRIK3 | 163873 | 373091 | 8976 | 362183 | 29343 |
| GRIK3 | 163873 | 373093 | 8977 | 362185 | 29344 |
| GRIK3 | 163873 | 462621 | 8978 | N/A | |
| GRIK3 | 163873 | 479620 | 8979 | N/A | |
| GRIN2A | 183454 | 396573 | 8980 | 379818 | 29345 |
| GRIN2A | 183454 | 461292 | 8981 | N/A | |
| GRIN2A | 183454 | 636273 | 8982 | N/A | |
| GRIN2A | 183454 | 562109 | 8983 | 454998 | 29346 |
| GRIN2A | 183454 | 330684 | 8984 | 332549 | 29347 |
| GRIN2A | 183454 | 463531 | 8985 | N/A | |
| GRIN2A | 183454 | 566683 | 8986 | N/A | |
| GRIN2A | 183454 | 568247 | 8987 | N/A | |
| GRIN2A | 183454 | 637393 | 8988 | 490232 | 29348 |
| GRIN2A | 183454 | 566670 | 8989 | N/A | |
| GRIN2A | 183454 | 637334 | 8990 | N/A | |
| GRIN2A | 183454 | 566665 | 8991 | N/A | |
| GRIN2A | 183454 | 636406 | 8992 | 490676 | 29349 |
| GRIN2A | 183454 | 637188 | 8993 | 489946 | 29350 |
| GRIN2A | 183454 | 535259 | 8994 | 441572 | 29351 |
| GRIN2B | 273079 | 637214 | 8995 | 489997 | 29352 |
| GRIN2B | 273079 | 609686 | 8996 | 477455 | 29353 |
| GRIN2B | 273079 | 636207 | 8997 | N/A | |
| GRIN2B | 273079 | 628166 | 8998 | N/A | |
| GRIN2B | 273079 | 636855 | 8999 | N/A | |
| GRIN2B | 273079 | 636856 | 9000 | N/A | |
| GRIN2B | 273079 | 630791 | 9001 | 486677 | 29354 |
| GRIN2B | 273079 | 627535 | 9002 | 486411 | 29355 |
| GRIN2B | 273079 | 637875 | 9003 | N/A | |
| GRIN2C | 161509 | 293190 | 9004 | 293190 | 29356 |
| GRIN2C | 161509 | 584176 | 9005 | N/A | |
| GRIN2C | 161509 | 347612 | 9006 | 338645 | 29357 |
| GRIN2C | 161509 | 578159 | 9007 | N/A | |
| GRIN2C | 161509 | 584496 | 9008 | N/A | |
| GRIN2D | 105464 | 263269 | 9009 | 263269 | 29358 |
| GRIP1 | 155974 | 398016 | 9010 | 381098 | 29359 |
| GRIP1 | 155974 | 538164 | 9011 | 439053 | 29360 |
| GRIP1 | 155974 | 540854 | 9012 | 443006 | 29361 |
| GRIP1 | 155974 | 538211 | 9013 | 446047 | 29362 |
| GRIP1 | 155974 | 535323 | 9014 | N/A | |
| GRIP1 | 155974 | 540433 | 9015 | 446024 | 29363 |
| GRIP1 | 155974 | 536215 | 9016 | 446011 | 29364 |
| GRIP1 | 155974 | 541299 | 9017 | N/A | |
| GRIP1 | 155974 | 542021 | 9018 | N/A | |
| GRIP1 | 155974 | 543172 | 9019 | 443860 | 29365 |
| GRIP1 | 155974 | 535002 | 9020 | 440918 | 29366 |
| GRIP1 | 155974 | 545666 | 9021 | 439124 | 29367 |
| GRIP1 | 155974 | 542309 | 9022 | 438500 | 29368 |
| GRIP1 | 155974 | 539540 | 9023 | 443392 | 29369 |

| Symbol | ENSG | ENST | SEQ ID | ENSP | SEQ ID |
|---|---|---|---|---|---|
| GRIP1 | 155974 | 541947 | 9024 | 438921 | 29370 |
| GRIP1 | 155974 | 538373 | 9025 | 446067 | 29371 |
| GRIP1 | 155974 | 359742 | 9026 | 352780 | 29372 |
| GRK3 | 100077 | 324198 | 9027 | 317578 | 29373 |
| GRK3 | 100077 | 455558 | 9028 | 393688 | 29374 |
| GRK3 | 100077 | 619906 | 9029 | 478925 | 29375 |
| GRK4 | 125388 | 398051 | 9030 | 381128 | 29376 |
| GRK4 | 125388 | 503518 | 9031 | 421650 | 29377 |
| GRK4 | 125388 | 398052 | 9032 | 381129 | 29378 |
| GRK4 | 125388 | 345167 | 9033 | 264764 | 29379 |
| GRK4 | 125388 | 504933 | 9034 | 427445 | 29380 |
| GRK4 | 125388 | 507230 | 9035 | N/A | |
| GRK4 | 125388 | 505271 | 9036 | N/A | |
| GRK4 | 125388 | 509545 | 9037 | N/A | |
| GRK4 | 125388 | 511827 | 9038 | N/A | |
| GRK4 | 125388 | 504308 | 9039 | N/A | |
| GRK5 | 198873 | 392870 | 9040 | 376609 | 29381 |
| GRK5 | 198873 | 369108 | 9041 | N/A | |
| GRM1 | 152822 | 507005 | 9042 | N/A | |
| GRM1 | 152822 | 502405 | 9043 | N/A | |
| GRM1 | 152822 | 492807 | 9044 | 424095 | 29382 |
| GRM1 | 152822 | 355289 | 9045 | 347437 | 29383 |
| GRM1 | 152822 | 282753 | 9046 | 282753 | 29384 |
| GRM1 | 152822 | 507907 | 9047 | 425599 | 29385 |
| GRM1 | 152822 | 361719 | 9048 | 354896 | 29386 |
| GRM4 | 124493 | 538487 | 9049 | 440556 | 29387 |
| GRM4 | 124493 | 374177 | 9050 | 363292 | 29388 |
| GRM4 | 124493 | 545715 | 9051 | N/A | |
| GRM4 | 124493 | 609222 | 9052 | 477466 | 29389 |
| GRM4 | 124493 | 609860 | 9053 | N/A | |
| GRM4 | 124493 | 544773 | 9054 | 437730 | 29390 |
| GRM4 | 124493 | 455714 | 9055 | 398456 | 29391 |
| GRM4 | 124493 | 609278 | 9056 | 477016 | 29392 |
| GRM4 | 124493 | 609443 | 9057 | 476561 | 29393 |
| GRM4 | 124493 | 609915 | 9058 | N/A | |
| GRM4 | 124493 | 609973 | 9059 | N/A | |
| GRM4 | 124493 | 607916 | 9060 | N/A | |
| GRM4 | 124493 | 535756 | 9061 | 437925 | 29394 |
| GRM4 | 124493 | 374181 | 9062 | 363296 | 29395 |
| GRM5 | 168959 | 305432 | 9063 | 305905 | 29396 |
| GRM5 | 168959 | 305447 | 9064 | 306138 | 29397 |
| GRM5 | 168959 | 449371 | 9065 | 403724 | 29398 |
| GRM5 | 168959 | 393294 | 9066 | 376972 | 29399 |
| GRM5 | 168959 | 455756 | 9067 | 405690 | 29400 |
| GRM7 | 196277 | 443259 | 9068 | 404161 | 29401 |
| GRM7 | 196277 | 448328 | 9069 | 393799 | 29402 |
| GRM7 | 196277 | 467425 | 9070 | 419835 | 29403 |
| GRM7 | 196277 | 357716 | 9071 | 350348 | 29404 |
| GRM7 | 196277 | 486284 | 9072 | 417536 | 29405 |
| GRM7 | 196277 | 440923 | 9073 | 412329 | 29406 |
| GRM7 | 196277 | 389336 | 9074 | 373987 | 29407 |
| GRM7 | 196277 | 389335 | 9075 | 373986 | 29408 |
| GRM7 | 196277 | 435689 | 9076 | 405194 | 29409 |
| GRM7 | 196277 | 461677 | 9077 | N/A | |
| GRM7 | 196277 | 463676 | 9078 | N/A | |
| GRM7 | 196277 | 445087 | 9079 | 395035 | 29410 |
| GRM7 | 196277 | 458641 | 9080 | N/A | |
| GRM7 | 196277 | 471242 | 9081 | N/A | |
| GRM7 | 196277 | 402647 | 9082 | 384585 | 29411 |
| GRM8 | 179603 | 339582 | 9083 | 344173 | 29412 |
| GRM8 | 179603 | 358373 | 9084 | 351142 | 29413 |
| GRM8 | 179603 | 489939 | 9085 | N/A | |
| GRM8 | 179603 | 341617 | 9086 | 345747 | 29414 |
| GRM8 | 179603 | 495315 | 9087 | N/A | |
| GRM8 | 179603 | 472701 | 9088 | 419832 | 29415 |
| GRM8 | 179603 | 480995 | 9089 | N/A | |
| GRM8 | 179603 | 448250 | 9090 | N/A | |
| GRM8 | 179603 | 457830 | 9091 | 415522 | 29416 |
| GRM8 | 179603 | 465844 | 9092 | 418255 | 29417 |
| GRM8 | 179603 | 423518 | 9093 | N/A | |
| GRM8 | 179603 | 465800 | 9094 | N/A | |
| GRM8 | 179603 | 473254 | 9095 | N/A | |
| GRM8 | 179603 | 412160 | 9096 | 398012 | 29418 |
| GRM8 | 179603 | 444921 | 9097 | 409790 | 29419 |
| GSAP | 186088 | 491796 | 9098 | N/A | |
| GSAP | 186088 | 449779 | 9099 | N/A | |

-continued

-continued

| Symbol | ENSG | ENST | SEQ ID | ENSP | SEQ ID |
|---|---|---|---|---|---|
| GSAP | 186088 | 257626 | 9100 | 257626 | 29420 |
| GSAP | 186088 | 482866 | 9101 | N/A | |
| GSAP | 186088 | 474686 | 9102 | N/A | |
| GSAP | 186088 | 440473 | 9103 | N/A | |
| GSAP | 186088 | 415112 | 9104 | 396230 | 29421 |
| GSAP | 186088 | 426477 | 9105 | N/A | |
| GSAP | 186088 | 489920 | 9106 | N/A | |
| GSAP | 186088 | 334003 | 9107 | N/A | |
| GSAP | 186088 | 434084 | 9108 | N/A | |
| GSAP | 186088 | 430584 | 9109 | 402748 | 29422 |
| GSAP | 186088 | 441833 | 9110 | 415402 | 29423 |
| GSN | 148180 | 373823 | 9111 | 362929 | 29424 |
| GSN | 148180 | 432226 | 9112 | 404226 | 29425 |
| GSN | 148180 | 373808 | 9113 | 362914 | 29426 |
| GSN | 148180 | 477863 | 9114 | N/A | |
| GSN | 148180 | 449733 | 9115 | 409358 | 29427 |
| GSN | 148180 | 483960 | 9116 | N/A | |
| GSN | 148180 | 477104 | 9117 | 489067 | 29428 |
| GSN | 148180 | 394353 | 9118 | 377882 | 29429 |
| GSN | 148180 | 545652 | 9119 | 445823 | 29430 |
| GSN | 148180 | 373818 | 9120 | 362924 | 29431 |
| GSN | 148180 | 485767 | 9121 | N/A | |
| GSN | 148180 | 373807 | 9122 | N/A | |
| GSN | 148180 | 373806 | 9123 | 362912 | 29432 |
| GSN | 148180 | 477553 | 9124 | N/A | |
| GSN | 148180 | 434663 | 9125 | N/A | |
| GSTM1 | 134184 | 490021 | 9126 | N/A | |
| GSTM1 | 134184 | 309851 | 9127 | 311469 | 29433 |
| GSTM1 | 134184 | 369823 | 9128 | 358838 | 29434 |
| GSTM1 | 134184 | 349334 | 9129 | 234981 | 29435 |
| GSTM1 | 134184 | 476065 | 9130 | 456315 | 29436 |
| GSTM1 | 134184 | 483399 | 9131 | 455929 | 29437 |
| GSTM1 | 134184 | 490171 | 9132 | N/A | |
| GSTM1 | 134184 | 369819 | 9133 | 358834 | 29438 |
| GSTO2 | 065621 | 338595 | 9134 | 345023 | 29439 |
| GSTO2 | 065621 | 473401 | 9135 | N/A | |
| GSTO2 | 065621 | 477078 | 9136 | N/A | |
| GSTO2 | 065621 | 369707 | 9137 | 358721 | 29440 |
| GSTO2 | 065621 | 467629 | 9138 | N/A | |
| GSTO2 | 065621 | 498052 | 9139 | N/A | |
| GSTO2 | 065621 | 450629 | 9140 | 390986 | 29441 |
| GSX1 | 169840 | 302945 | 9141 | 304331 | 29442 |
| GTF2A1L | 242441 | 448460 | 9142 | 412645 | 29443 |
| GTF2A1L | 242441 | 437125 | 9143 | 396702 | 29444 |
| GTF2A1L | 242441 | 403751 | 9144 | 384597 | 29445 |
| GTF2A1L | 242441 | 423675 | 9145 | 394793 | 29446 |
| GTF2A1L | 242441 | 468326 | 9146 | N/A | |
| GTF2A1L | 242441 | 508440 | 9147 | 421474 | 29447 |
| GTF2A1L | 242441 | 430487 | 9148 | 387896 | 29448 |
| GTF2B | 137947 | 370500 | 9149 | 359531 | 29449 |
| GTF2B | 137947 | 448623 | 9150 | 415741 | 29450 |
| GTF2B | 137947 | 494819 | 9151 | N/A | |
| GTF2B | 137947 | 418217 | 9152 | 402345 | 29451 |
| GTF2B | 137947 | 486078 | 9153 | N/A | |
| GTF2B | 137947 | 471296 | 9154 | N/A | |
| GTF2B | 137947 | 471471 | 9155 | N/A | |
| GTPBP2 | 172432 | 496137 | 9156 | 436973 | 29452 |
| GTPBP2 | 172432 | 419497 | 9157 | 392944 | 29453 |
| GTPBP2 | 172432 | 432918 | 9158 | 398905 | 29454 |
| GTPBP2 | 172432 | 476510 | 9159 | N/A | |
| GTPBP2 | 172432 | 307126 | 9160 | 303997 | 29455 |
| GTPBP2 | 172432 | 459959 | 9161 | N/A | |
| GTPBP2 | 172432 | 442748 | 9162 | 411358 | 29456 |
| GTPBP2 | 172432 | 480263 | 9163 | N/A | |
| GTPBP2 | 172432 | 452781 | 9164 | 410676 | 29457 |
| GTPBP2 | 172432 | 307114 | 9165 | 304893 | 29458 |
| GTSCR1 | 263417 | 582578 | 9166 | N/A | |
| GUCY1A3 | 164116 | 506455 | 9167 | 424361 | 29459 |
| GUCY1A3 | 164116 | 511108 | 9168 | 421493 | 29460 |
| GUCY1A3 | 164116 | 512983 | 9169 | N/A | |
| GUCY1A3 | 164116 | 511507 | 9170 | 426968 | 29461 |
| GUCY1A3 | 164116 | 515602 | 9171 | N/A | |
| GUCY1A3 | 164116 | 455639 | 9172 | 412201 | 29462 |
| GUCY1A3 | 164116 | 509901 | 9173 | 424863 | 29463 |
| GUCY1A3 | 164116 | 443668 | 9174 | 409903 | 29464 |
| GUCY1A3 | 164116 | 393832 | 9175 | 377418 | 29465 |
| GUCY1A3 | 164116 | 296518 | 9176 | 296518 | 29466 |
| GUCY1A3 | 164116 | 515201 | 9177 | 422141 | 29467 |
| GUCY1A3 | 164116 | 513574 | 9178 | 426040 | 29468 |
| GUCY1A3 | 164116 | 621234 | 9179 | 479710 | 29469 |
| GYG2 | 056998 | 398806 | 9180 | 381786 | 29470 |
| GYG2 | 056998 | 381163 | 9181 | 370555 | 29471 |
| GYG2 | 056998 | 381161 | 9182 | N/A | |
| GYG2 | 056998 | 520904 | 9183 | 430764 | 29472 |
| GYG2 | 056998 | 469234 | 9184 | N/A | |
| GYG2 | 056998 | 353656 | 9185 | 487294 | 29473 |
| GYG2 | 056998 | 453106 | 9186 | N/A | |
| GYG2 | 056998 | 381157 | 9187 | 370549 | 29474 |
| GYG2 | 056998 | 639373 | 9188 | 491962 | 29475 |
| GYG2P1 | 206159 | 382966 | 9189 | N/A | |
| GYG2P1 | 206159 | 493160 | 9190 | N/A | |
| GYG2P1 | 206159 | 357871 | 9191 | N/A | |
| GYG2P1 | 206159 | 382963 | 9192 | N/A | |
| GYG2P1 | 206159 | 382965 | 9193 | N/A | |
| GYS1 | 104812 | 323798 | 9194 | 317904 | 29476 |
| GYS1 | 104812 | 263276 | 9195 | 263276 | 29477 |
| GYS1 | 104812 | 594220 | 9196 | 470072 | 29478 |
| GYS1 | 104812 | 472004 | 9197 | N/A | |
| GYS1 | 104812 | 496048 | 9198 | N/A | |
| GYS1 | 104812 | 484289 | 9199 | N/A | |
| GYS1 | 104812 | 457974 | 9200 | N/A | |
| GZF1 | 125812 | 338121 | 9201 | 338290 | 29479 |
| GZF1 | 125812 | 424216 | 9202 | 410009 | 29480 |
| GZF1 | 125812 | 461789 | 9203 | N/A | |
| GZF1 | 125812 | 477239 | 9204 | N/A | |
| GZF1 | 125812 | 377051 | 9205 | 366250 | 29481 |
| HAMP | 105697 | 598398 | 9206 | 471894 | 29482 |
| HAMP | 105697 | 222304 | 9207 | 222304 | 29483 |
| HAMP | 105697 | 593580 | 9208 | N/A | |
| HAPLN2 | 132702 | 255039 | 9209 | 255039 | 29484 |
| HAPLN2 | 132702 | 487988 | 9210 | N/A | |
| HAPLN2 | 132702 | 456112 | 9211 | 388835 | 29485 |
| HAPLN2 | 132702 | 482204 | 9212 | N/A | |
| HAPLN2 | 132702 | 494218 | 9213 | N/A | |
| HAS2 | 170961 | 303924 | 9214 | 306991 | 29486 |
| HCN1 | 164588 | 303230 | 9215 | 307342 | 29487 |
| HCN1 | 164588 | 637305 | 9216 | N/A | |
| HCN1 | 164588 | 637256 | 9217 | N/A | |
| HCN1 | 164588 | 634658 | 9218 | 489134 | 29488 |
| HCN1 | 164588 | 638054 | 9219 | N/A | |
| HCN2 | 099822 | 251287 | 9220 | 251287 | 29489 |
| HCN4 | 138622 | 261917 | 9221 | 261917 | 29490 |
| HDAC8 | 147099 | 373583 | 9222 | 362685 | 29491 |
| HDAC8 | 147099 | 373573 | 9223 | 362674 | 29492 |
| HDAC8 | 147099 | 470998 | 9224 | N/A | |
| HDAC8 | 147099 | 373568 | 9225 | 362669 | 29493 |
| HDAC8 | 147099 | 436675 | 9226 | 416489 | 29494 |
| HDAC8 | 147099 | 415409 | 9227 | 396424 | 29495 |
| HDAC8 | 147099 | 412342 | 9228 | 400180 | 29496 |
| HDAC8 | 147099 | 373571 | 9229 | 362672 | 29497 |
| HDAC8 | 147099 | 439122 | 9230 | 414486 | 29498 |
| HDAC8 | 147099 | 373560 | 9231 | 362661 | 29499 |
| HDAC8 | 147099 | 373559 | 9232 | 362660 | 29500 |
| HDAC8 | 147099 | 478743 | 9233 | N/A | |
| HDAC8 | 147099 | 421523 | 9234 | 398997 | 29501 |
| HDAC8 | 147099 | 373556 | 9235 | 362657 | 29502 |
| HDAC8 | 147099 | 373554 | 9236 | 362655 | 29503 |
| HDAC8 | 147099 | 444609 | 9237 | 409778 | 29504 |
| HDAC8 | 147099 | 486704 | 9238 | N/A | |
| HDAC8 | 147099 | 373589 | 9239 | 362691 | 29505 |
| HDHD2 | 167220 | 300605 | 9240 | 300605 | 29506 |
| HDHD2 | 167220 | 588183 | 9241 | 466602 | 29507 |
| HDHD2 | 167220 | 588861 | 9242 | N/A | |
| HDHD2 | 167220 | 587841 | 9243 | N/A | |
| HDHD2 | 167220 | 590815 | 9244 | 468067 | 29508 |
| HDHD2 | 167220 | 591480 | 9245 | 466710 | 29509 |
| HDHD2 | 167220 | 586546 | 9246 | 467309 | 29510 |
| HDHD2 | 167220 | 590481 | 9247 | 467998 | 29511 |
| HDHD2 | 167220 | 588940 | 9248 | 467775 | 29512 |
| HDHD2 | 167220 | 591268 | 9249 | 465829 | 29513 |
| HDHD2 | 167220 | 587388 | 9250 | 466923 | 29514 |
| HDHD2 | 167220 | 592591 | 9251 | 465282 | 29515 |

-continued

-continued

| Symbol | ENSG | ENST | SEQ ID | ENSP | SEQ ID |
|---|---|---|---|---|---|
| HDHD2 | 167220 | 591671 | 9252 | N/A | |
| HEBP1 | 013583 | 014930 | 9253 | 014930 | 29516 |
| HEBP1 | 013583 | 540916 | 9254 | N/A | |
| HEBP1 | 013583 | 535636 | 9255 | 442020 | 29517 |
| HEBP1 | 013583 | 536942 | 9256 | 441678 | 29518 |
| HECA | 112406 | 367658 | 9257 | 356630 | 29519 |
| HECW1 | 002746 | 395891 | 9258 | 379228 | 29520 |
| HECW1 | 002746 | 490954 | 9259 | N/A | |
| HECW1 | 002746 | 453890 | 9260 | 407774 | 29521 |
| HECW1 | 002746 | 492310 | 9261 | N/A | |
| HECW1 | 002746 | 471527 | 9262 | N/A | |
| HECW1 | 002746 | 493057 | 9263 | N/A | |
| HECW1 | 002746 | 464944 | 9264 | N/A | |
| HECW1 | 002746 | 481031 | 9265 | N/A | |
| HECW1 | 002746 | 471043 | 9266 | N/A | |
| HECW1 | 002746 | 461842 | 9267 | N/A | |
| HECW1 | 002746 | 429529 | 9268 | 413336 | 29522 |
| HEG1 | 173706 | 311127 | 9269 | 311502 | 29523 |
| HEG1 | 173706 | 487661 | 9270 | 417648 | 29524 |
| HEG1 | 173706 | 480667 | 9271 | N/A | |
| HEG1 | 173706 | 482699 | 9272 | 417494 | 29525 |
| HEG1 | 173706 | 488654 | 9273 | N/A | |
| HEG1 | 173706 | 477536 | 9274 | N/A | |
| HEPACAM | 165478 | 528971 | 9275 | N/A | |
| HEPACAM | 165478 | 526273 | 9276 | N/A | |
| HEPACAM | 165478 | 298251 | 9277 | 298251 | 29526 |
| HERPUD1 | 051108 | 439977 | 9278 | 409555 | 29527 |
| HERPUD1 | 051108 | 562914 | 9279 | N/A | |
| HERPUD1 | 051108 | 568676 | 9280 | N/A | |
| HERPUD1 | 051108 | 569569 | 9281 | N/A | |
| HERPUD1 | 051108 | 565966 | 9282 | 456384 | 29528 |
| HERPUD1 | 051108 | 344114 | 9283 | 340931 | 29529 |
| HERPUD1 | 051108 | 300302 | 9284 | 300302 | 29530 |
| HERPUD1 | 051108 | 570273 | 9285 | N/A | |
| HERPUD1 | 051108 | 379792 | 9286 | 369118 | 29531 |
| HERPUD1 | 051108 | 569429 | 9287 | 457321 | 29532 |
| HERPUD1 | 051108 | 563343 | 9288 | 455094 | 29533 |
| HERPUD1 | 051108 | 566550 | 9289 | N/A | |
| HERPUD1 | 051108 | 563781 | 9290 | N/A | |
| HERPUD1 | 051108 | 568358 | 9291 | 457095 | 29534 |
| HERPUD1 | 051108 | 564678 | 9292 | N/A | |
| HERPUD1 | 051108 | 563911 | 9293 | 455841 | 29535 |
| HERPUD1 | 051108 | 567944 | 9294 | N/A | |
| HERPUD1 | 051108 | 568651 | 9295 | 457955 | 29536 |
| HERPUD1 | 051108 | 568814 | 9296 | N/A | |
| HES1 | 114315 | 232424 | 9297 | 232424 | 29537 |
| HES1 | 114315 | 476918 | 9298 | N/A | |
| HES3 | 173673 | 377898 | 9299 | 367130 | 29538 |
| HEY2 | 135547 | 368365 | 9300 | 357349 | 29539 |
| HEY2 | 135547 | 368364 | 9301 | 357348 | 29540 |
| HGF | 019991 | 222390 | 9302 | 222390 | 29541 |
| HGF | 019991 | 457544 | 9303 | 391238 | 29542 |
| HGF | 019991 | 444829 | 9304 | 389854 | 29543 |
| HGF | 019991 | 453411 | 9305 | 408270 | 29544 |
| HGF | 019991 | 423064 | 9306 | 413829 | 29545 |
| HGF | 019991 | 465234 | 9307 | N/A | |
| HGF | 019991 | 453018 | 9308 | 395468 | 29546 |
| HGF | 019991 | 412881 | 9309 | 396307 | 29547 |
| HGF | 019991 | 421558 | 9310 | 388592 | 29548 |
| HGF | 019991 | 354224 | 9311 | 346164 | 29549 |
| HHATL | 010282 | 490003 | 9312 | N/A | |
| HHATL | 010282 | 466007 | 9313 | N/A | |
| HHATL | 010282 | 426666 | 9314 | 401568 | 29550 |
| HHATL | 010282 | 310417 | 9315 | 310621 | 29551 |
| HHATL | 010282 | 441594 | 9316 | 405423 | 29552 |
| HHATL | 010282 | 480939 | 9317 | N/A | |
| HHATL | 010282 | 457462 | 9318 | 403787 | 29553 |
| HHATL | 010282 | 416756 | 9319 | 395779 | 29554 |
| HHATL | 010282 | 455195 | 9320 | 415351 | 29555 |
| HHATL | 010282 | 417472 | 9321 | 413810 | 29556 |
| HHATL | 010282 | 442469 | 9322 | 408999 | 29557 |
| HHATL | 010282 | 497000 | 9323 | N/A | |
| HHIP | 164161 | 296575 | 9324 | 296575 | 29558 |
| HHIP | 164161 | 434550 | 9325 | 408587 | 29559 |
| HHIP | 164161 | 505891 | 9326 | N/A | |
| HHIP | 164161 | 511314 | 9327 | N/A | |

| Symbol | ENSG | ENST | SEQ ID | ENSP | SEQ ID |
|---|---|---|---|---|---|
| HHIP | 164161 | 515080 | 9328 | N/A | |
| HHIP | 164161 | 509630 | 9329 | N/A | |
| HHIP | 164161 | 512791 | 9330 | N/A | |
| HHIP | 164161 | 503090 | 9331 | N/A | |
| HIF3A | 124440 | 244302 | 9332 | N/A | |
| HIF3A | 124440 | 377670 | 9333 | 366898 | 29560 |
| HIF3A | 124440 | 524533 | 9334 | N/A | |
| HIF3A | 124440 | 244303 | 9335 | 244303 | 29561 |
| HIF3A | 124440 | 528563 | 9336 | 435532 | 29562 |
| HIF3A | 124440 | 533145 | 9337 | 435200 | 29563 |
| HIF3A | 124440 | 472815 | 9338 | 434653 | 29564 |
| HIF3A | 124440 | 526506 | 9339 | 432613 | 29565 |
| HIF3A | 124440 | 291300 | 9340 | N/A | |
| HIF3A | 124440 | 300862 | 9341 | 300862 | 29566 |
| HIF3A | 124440 | 600879 | 9342 | 469031 | 29567 |
| HIF3A | 124440 | 600383 | 9343 | 471560 | 29568 |
| HIF3A | 124440 | 525854 | 9344 | N/A | |
| HIF3A | 124440 | 529205 | 9345 | N/A | |
| HIF3A | 124440 | 531043 | 9346 | 434700 | 29569 |
| HIF3A | 124440 | 600236 | 9347 | N/A | |
| HIF3A | 124440 | 529542 | 9348 | N/A | |
| HIF3A | 124440 | 475432 | 9349 | N/A | |
| HIF3A | 124440 | 533789 | 9350 | 432809 | 29570 |
| HIGD1A | 181061 | 321331 | 9351 | 319393 | 29571 |
| HIGD1A | 181061 | 418900 | 9352 | 402160 | 29572 |
| HIGD1A | 181061 | 470543 | 9353 | N/A | |
| HIGD1A | 181061 | 430190 | 9354 | 408289 | 29573 |
| HIGD1A | 181061 | 452906 | 9355 | 398064 | 29574 |
| HIP1 | 127946 | 336926 | 9356 | 336747 | 29575 |
| HIP1 | 127946 | 434438 | 9357 | 410300 | 29576 |
| HIP1 | 127946 | 404944 | 9358 | N/A | |
| HIP1 | 127946 | 420909 | 9359 | 414280 | 29577 |
| HIP1 | 127946 | 485723 | 9360 | N/A | |
| HIP1 | 127946 | 479835 | 9361 | N/A | |
| HIP1 | 127946 | 616821 | 9362 | 484528 | 29578 |
| HIP1R | 130787 | 535831 | 9363 | N/A | |
| HIP1R | 130787 | 253083 | 9364 | 253083 | 29579 |
| HIP1R | 130787 | 452196 | 9365 | N/A | |
| HIP1R | 130787 | 536772 | 9366 | N/A | |
| HIP1R | 130787 | 536847 | 9367 | N/A | |
| HIP1R | 130787 | 541712 | 9368 | N/A | |
| HIP1R | 130787 | 536617 | 9369 | N/A | |
| HIP1R | 130787 | 538236 | 9370 | N/A | |
| HIP1R | 130787 | 535012 | 9371 | 446236 | 29580 |
| HIP1R | 130787 | 537322 | 9372 | N/A | |
| HIPK4 | 160396 | 291823 | 9373 | 291823 | 29581 |
| HIST1H2BD | 158373 | 377777 | 9374 | 367008 | 29582 |
| HIST1H2BD | 158373 | 289316 | 9375 | 289316 | 29583 |
| HIST2H2BA | 223345 | 430394 | 9376 | N/A | |
| HIST2H2BA | 223345 | 412169 | 9377 | N/A | |
| HIST2H2BE | 184678 | 369155 | 9378 | 358151 | 29584 |
| HIST2H2BF | 203814 | 420462 | 9379 | N/A | |
| HIST2H2BF | 203814 | 469483 | 9380 | N/A | |
| HIST2H2BF | 203814 | 620458 | 9381 | N/A | |
| HIST2H2BF | 203814 | 369167 | 9382 | 358164 | 29585 |
| HIST2H2BF | 203814 | 545683 | 9383 | 445831 | 29586 |
| HK2 | 159399 | 290573 | 9384 | 290573 | 29587 |
| HK2 | 159399 | 409174 | 9385 | 387140 | 29588 |
| HK2 | 159399 | 472302 | 9386 | N/A | |
| HMCES | 183624 | 509042 | 9387 | 423132 | 29589 |
| HMCES | 183624 | 383463 | 9388 | 372955 | 29590 |
| HMCES | 183624 | 417226 | 9389 | 392966 | 29591 |
| HMCES | 183624 | 510314 | 9390 | 426276 | 29592 |
| HMCES | 183624 | 502878 | 9391 | 426215 | 29593 |
| HMCES | 183624 | 389735 | 9392 | 374385 | 29594 |
| HMCES | 183624 | 509551 | 9393 | 424594 | 29595 |
| HMCES | 183624 | 511665 | 9394 | 421895 | 29596 |
| HMGCLL1 | 146151 | 274901 | 9395 | 274901 | 29597 |
| HMGCLL1 | 146151 | 398661 | 9396 | 381654 | 29598 |
| HMGCLL1 | 146151 | 370852 | 9397 | 359889 | 29599 |
| HMGCLL1 | 146151 | 370850 | 9398 | 359887 | 29600 |
| HMGCLL1 | 146151 | 508459 | 9399 | 424309 | 29601 |
| HMGCLL1 | 146151 | 308161 | 9400 | 309737 | 29602 |
| HMGCLL1 | 146151 | 507223 | 9401 | N/A | |
| HMGCLL1 | 146151 | 428842 | 9402 | 412924 | 29603 |
| HMGCLL1 | 146151 | 515546 | 9403 | 426054 | 29604 |

-continued

| Symbol | ENSG | ENST | SEQ ID | ENSP | SEQ ID |
|---|---|---|---|---|---|
| HMGCR | 113161 | 511206 | 9404 | 426745 | 29605 |
| HMGCR | 113161 | 287936 | 9405 | 287936 | 29606 |
| HMGCR | 113161 | 343975 | 9406 | 340816 | 29607 |
| HMGCR | 113161 | 509431 | 9407 | N/A | |
| HMGCR | 113161 | 507942 | 9408 | 427340 | 29608 |
| HMGCR | 113161 | 442032 | 9409 | 409100 | 29609 |
| HMGCR | 113161 | 504166 | 9410 | N/A | |
| HMGCR | 113161 | 515776 | 9411 | N/A | |
| HMGCR | 113161 | 508070 | 9412 | N/A | |
| HMGCR | 113161 | 509085 | 9413 | 421378 | 29610 |
| HMGCR | 113161 | 511986 | 9414 | 420871 | 29611 |
| HMGCR | 113161 | 514315 | 9415 | N/A | |
| HMGCR | 113161 | 512053 | 9416 | N/A | |
| HMGCS1 | 112972 | 325110 | 9417 | 322706 | 29612 |
| HMGCS1 | 112972 | 433297 | 9418 | 399402 | 29613 |
| HMGCS1 | 112972 | 508319 | 9419 | N/A | |
| HMGCS1 | 112972 | 514610 | 9420 | N/A | |
| HMGCS1 | 112972 | 507004 | 9421 | N/A | |
| HMGCS1 | 112972 | 507293 | 9422 | N/A | |
| HMGCS1 | 112972 | 511774 | 9423 | 427339 | 29614 |
| HMGN1 | 205581 | 288344 | 9424 | 288344 | 29615 |
| HMGN1 | 205581 | 486741 | 9425 | N/A | |
| HMGN1 | 205581 | 431390 | 9426 | 395291 | 29616 |
| HMGN1 | 205581 | 380749 | 9427 | 370125 | 29617 |
| HMGN1 | 205581 | 492280 | 9428 | N/A | |
| HMGN1 | 205581 | 436324 | 9429 | 414421 | 29618 |
| HMGN1 | 205581 | 380748 | 9430 | 370124 | 29619 |
| HMGN1 | 205581 | 419378 | 9431 | 396693 | 29620 |
| HMGN1 | 205581 | 489072 | 9432 | N/A | |
| HMGN1 | 205581 | 482192 | 9433 | N/A | |
| HMGN1 | 205581 | 380747 | 9434 | 370123 | 29621 |
| HMGN1 | 205581 | 485550 | 9435 | N/A | |
| HMGN1 | 205581 | 490032 | 9436 | N/A | |
| HMGN1 | 205581 | 443046 | 9437 | 395787 | 29622 |
| HMGN1 | 205581 | 464078 | 9438 | N/A | |
| HMGN1 | 205581 | 491183 | 9439 | N/A | |
| HMGN1 | 205581 | 479586 | 9440 | N/A | |
| HMGN1 | 205581 | 471260 | 9441 | N/A | |
| HMGN1 | 205581 | 482733 | 9442 | N/A | |
| HMGN1 | 205581 | 463631 | 9443 | N/A | |
| HOMER1 | 152413 | 334082 | 9444 | 334382 | 29623 |
| HOMER1 | 152413 | 460741 | 9445 | N/A | |
| HOMER1 | 152413 | 282260 | 9446 | 282260 | 29624 |
| HOMER1 | 152413 | 508576 | 9447 | 426651 | 29625 |
| HOMER1 | 152413 | 535690 | 9448 | 441587 | 29626 |
| HOMER3 | 051128 | 221222 | 9449 | 221222 | 29627 |
| HOMER3 | 051128 | 539827 | 9450 | 439937 | 29628 |
| HOMER3 | 051128 | 392351 | 9451 | 376162 | 29629 |
| HOMER3 | 051128 | 594794 | 9452 | 469800 | 29630 |
| HOMER3 | 051128 | 594439 | 9453 | 471835 | 29631 |
| HOMER3 | 051128 | 542541 | 9454 | 446026 | 29632 |
| HOMER3 | 051128 | 595756 | 9455 | N/A | |
| HOMER3 | 051128 | 596482 | 9456 | 472815 | 29633 |
| HOMER3 | 051128 | 600077 | 9457 | 470659 | 29634 |
| HOMER3 | 051128 | 599808 | 9458 | N/A | |
| HOMER3 | 051128 | 599097 | 9459 | 472800 | 29635 |
| HOMER3 | 051128 | 433218 | 9460 | 396154 | 29636 |
| HOXD1 | 128645 | 331462 | 9461 | 328598 | 29637 |
| HPCAL1 | 115756 | 423674 | 9462 | 413689 | 29638 |
| HPCAL1 | 115756 | 307845 | 9463 | 310749 | 29639 |
| HPCAL1 | 115756 | 381765 | 9464 | 371184 | 29640 |
| HPCAL1 | 115756 | 419810 | 9465 | 416359 | 29641 |
| HPCAL1 | 115756 | 422133 | 9466 | 388856 | 29642 |
| HPCAL1 | 115756 | 622018 | 9467 | 482993 | 29643 |
| HPCAL1 | 115756 | 620771 | 9468 | 483786 | 29644 |
| HPCAL1 | 115756 | 613496 | 9469 | 478231 | 29645 |
| HPCAL4 | 116983 | 372844 | 9470 | 361935 | 29646 |
| HPCAL4 | 116983 | 612703 | 9471 | 484070 | 29647 |
| HPCAL4 | 116983 | 617690 | 9472 | 481834 | 29648 |
| HPN | 105707 | 262626 | 9473 | 262626 | 29649 |
| HPN | 105707 | 392226 | 9474 | 376060 | 29650 |
| HPN | 105707 | 600390 | 9475 | 472310 | 29651 |
| HPN | 105707 | 597419 | 9476 | 470327 | 29652 |
| HPN | 105707 | 599363 | 9477 | N/A | |
| HPN | 105707 | 596662 | 9478 | N/A | |
| HPN | 105707 | 541345 | 9479 | N/A | |

-continued

| Symbol | ENSG | ENST | SEQ ID | ENSP | SEQ ID |
|---|---|---|---|---|---|
| HPN | 105707 | 593305 | 9480 | N/A | |
| HPN | 105707 | 600675 | 9481 | N/A | |
| HPSE2 | 172987 | 370552 | 9482 | 359583 | 29653 |
| HPSE2 | 172987 | 370549 | 9483 | 359580 | 29654 |
| HPSE2 | 172987 | 628193 | 9484 | 485916 | 29655 |
| HPSE2 | 172987 | 370546 | 9485 | 359577 | 29656 |
| HPSE2 | 172987 | 404542 | 9486 | 384384 | 29657 |
| HPSE2 | 172987 | 614306 | 9487 | 484672 | 29658 |
| HRASLS | 127252 | 264735 | 9488 | 264735 | 29659 |
| HRASLS | 127252 | 416012 | 9489 | 414431 | 29660 |
| HRH2 | 113749 | 377291 | 9490 | 366506 | 29661 |
| HRH2 | 113749 | 624694 | 9491 | 490705 | 29662 |
| HRH2 | 113749 | 636584 | 9492 | 489742 | 29663 |
| HRH2 | 113749 | 231683 | 9493 | 231683 | 29664 |
| HRH3 | 101180 | 340177 | 9494 | 342560 | 29665 |
| HRH3 | 101180 | 317393 | 9495 | 321482 | 29666 |
| HRH3 | 101180 | 611492 | 9496 | 482567 | 29667 |
| HS3ST1 | 002587 | 002596 | 9497 | 002596 | 29668 |
| HS3ST1 | 002587 | 514690 | 9498 | 425673 | 29669 |
| HS3ST1 | 002587 | 510712 | 9499 | 422629 | 29670 |
| HS3ST2 | 122254 | 261374 | 9500 | 261374 | 29671 |
| HS3ST2 | 122254 | 473392 | 9501 | 454505 | 29672 |
| HS3ST4 | 182601 | 331351 | 9502 | 330606 | 29673 |
| HS3ST4 | 182601 | 475436 | 9503 | N/A | |
| HS6ST2 | 171004 | 370836 | 9504 | 359873 | 29674 |
| HS6ST2 | 171004 | 521489 | 9505 | 429473 | 29675 |
| HS6ST2 | 171004 | 602570 | 9506 | N/A | |
| HS6ST2 | 171004 | 370833 | 9507 | 359870 | 29676 |
| HS6ST2 | 171004 | 406696 | 9508 | 384013 | 29677 |
| HS6ST2 | 171004 | 640529 | 9509 | 491722 | 29678 |
| HSD17B11 | 198189 | 358290 | 9510 | 351035 | 29679 |
| HSD17B11 | 198189 | 507518 | 9511 | N/A | |
| HSD17B11 | 198189 | 512344 | 9512 | N/A | |
| HSD17B11 | 198189 | 502576 | 9513 | N/A | |
| HSD17B11 | 198189 | 507286 | 9514 | 423775 | 29680 |
| HSD17B11 | 198189 | 513854 | 9515 | N/A | |
| HSD17B11 | 198189 | 508413 | 9516 | N/A | |
| HSD17B12 | 149084 | 278353 | 9517 | 278353 | 29681 |
| HSD17B12 | 149084 | 527433 | 9518 | 490749 | 29682 |
| HSD17B12 | 149084 | 531185 | 9519 | 436582 | 29683 |
| HSD17B12 | 149084 | 636007 | 9520 | 490822 | 29684 |
| HSD17B12 | 149084 | 395700 | 9521 | 379052 | 29685 |
| HSD17B12 | 149084 | 636722 | 9522 | 490003 | 29686 |
| HSD17B12 | 149084 | 637401 | 9523 | 490421 | 29687 |
| HSD17B12 | 149084 | 638034 | 9524 | 490701 | 29688 |
| HSD17B12 | 149084 | 527213 | 9525 | N/A | |
| HSD17B12 | 149084 | 532178 | 9526 | N/A | |
| HSD17B12 | 149084 | 533090 | 9527 | N/A | |
| HSD17B12 | 149084 | 533802 | 9528 | N/A | |
| HSD17B12 | 149084 | 534053 | 9529 | N/A | |
| HSD17B12 | 149084 | 525736 | 9530 | N/A | |
| HSP90AA1 | 080824 | 216281 | 9531 | 216281 | 29689 |
| HSP90AA1 | 080824 | 334701 | 9532 | 335153 | 29690 |
| HSP90AA1 | 080824 | 554401 | 9533 | 451400 | 29691 |
| HSP90AA1 | 080824 | 557089 | 9534 | N/A | |
| HSP90AA1 | 080824 | 560130 | 9535 | N/A | |
| HSP90AA1 | 080824 | 553585 | 9536 | 450712 | 29692 |
| HSP90AA1 | 080824 | 555662 | 9537 | N/A | |
| HSP90AA1 | 080824 | 556554 | 9538 | N/A | |
| HSP90AA1 | 080824 | 557234 | 9539 | 452241 | 29693 |
| HSP90AA1 | 080824 | 558600 | 9540 | 489370 | 29694 |
| HSP90AB1 | 096384 | 371646 | 9541 | 360709 | 29695 |
| HSP90AB1 | 096384 | 353801 | 9542 | 325875 | 29696 |
| HSP90AB1 | 096384 | 371554 | 9543 | 360609 | 29697 |
| HSP90AB1 | 096384 | 620073 | 9544 | 481908 | 29698 |
| HSPA1A | 234475 | 433487 | 9545 | 408907 | 29699 |
| HSPA1A | 234475 | 452298 | 9546 | 393259 | 29700 |
| HSPA1A | 215328 | 400040 | 9547 | 382915 | 29701 |
| HSPA1A | 215328 | 383389 | 9548 | 372880 | 29702 |
| HSPA1A | 235941 | 430065 | 9549 | 404524 | 29703 |
| HSPA1A | 235941 | 422919 | 9550 | 415927 | 29704 |
| HSPA1A | 204389 | 375651 | 9551 | 364802 | 29705 |
| HSPA1A | 204389 | 608703 | 9552 | 477378 | 29706 |
| HSPA1A | 237724 | 441618 | 9553 | 406359 | 29707 |
| HSPA1A | 237724 | 449876 | 9554 | 410693 | 29708 |
| HSPA1B | 231555 | 445736 | 9555 | 403530 | 29709 |

423

-continued

| Symbol | ENSG | ENST | SEQ ID | ENSP | SEQ ID |
|---|---|---|---|---|---|
| HSPA1B | 204388 | 375650 | 9556 | 364801 | 29710 |
| HSPA1B | 212866 | 391555 | 9557 | 375399 | 29711 |
| HSPA1B | 212866 | 458062 | 9558 | 402651 | 29712 |
| HSPA1B | 232804 | 450744 | 9559 | 393087 | 29713 |
| HSPA1B | 232804 | 417199 | 9560 | 387691 | 29714 |
| HSPA1B | 224501 | 391548 | 9561 | 375391 | 29715 |
| HSPA1B | 224501 | 545241 | 9562 | 442789 | 29716 |
| HSPA4 | 170606 | 304858 | 9563 | 302961 | 29717 |
| HSPA4 | 170606 | 504328 | 9564 | N/A | |
| HSPA4 | 170606 | 514825 | 9565 | N/A | |
| HSPA4 | 170606 | 615899 | 9566 | 478102 | 29718 |
| HSPA4 | 170606 | 617074 | 9567 | 481686 | 29719 |
| HSPA4L | 164070 | 508776 | 9568 | 422482 | 29720 |
| HSPA4L | 164070 | 296464 | 9569 | 296464 | 29721 |
| HSPA4L | 164070 | 508549 | 9570 | 427305 | 29722 |
| HSPA4L | 164070 | 505726 | 9571 | 425645 | 29723 |
| HSPA4L | 164070 | 515262 | 9572 | N/A | |
| HSPA8 | 109971 | 532636 | 9573 | 437125 | 29724 |
| HSPA8 | 109971 | 533540 | 9574 | 437189 | 29725 |
| HSPA8 | 109971 | 534624 | 9575 | 432083 | 29726 |
| HSPA8 | 109971 | 453788 | 9576 | 404372 | 29727 |
| HSPA8 | 109971 | 532091 | 9577 | N/A | |
| HSPA8 | 109971 | 227378 | 9578 | 227378 | 29728 |
| HSPA8 | 109971 | 534319 | 9579 | 433316 | 29729 |
| HSPA8 | 109971 | 526110 | 9580 | 433584 | 29730 |
| HSPA8 | 109971 | 524552 | 9581 | 435908 | 29731 |
| HSPA8 | 109971 | 526686 | 9582 | 435019 | 29732 |
| HSPA8 | 109971 | 533238 | 9583 | N/A | |
| HSPA8 | 109971 | 526862 | 9584 | N/A | |
| HSPA8 | 109971 | 527983 | 9585 | N/A | |
| HSPA8 | 109971 | 528292 | 9586 | 432884 | 29733 |
| HSPA8 | 109971 | 532780 | 9587 | N/A | |
| HSPA8 | 109971 | 525463 | 9588 | 436762 | 29734 |
| HSPA8 | 109971 | 532167 | 9589 | N/A | |
| HSPA8 | 109971 | 525624 | 9590 | 435154 | 29735 |
| HSPA8 | 109971 | 534567 | 9591 | 431641 | 29736 |
| HSPA8 | 109971 | 527387 | 9592 | 436183 | 29737 |
| HSPA8 | 109971 | 532182 | 9593 | 434415 | 29738 |
| HSPA8 | 109971 | 524590 | 9594 | 434565 | 29739 |
| HSPA8 | 109971 | 530391 | 9595 | 434851 | 29740 |
| HSPA8 | 109971 | 531063 | 9596 | N/A | |
| HSPA9 | 113013 | 297185 | 9597 | 297185 | 29741 |
| HSPA9 | 113013 | 501917 | 9598 | N/A | |
| HSPA9 | 113013 | 524109 | 9599 | N/A | |
| HSPA9 | 113013 | 512328 | 9600 | 421892 | 29742 |
| HSPA9 | 113013 | 507097 | 9601 | N/A | |
| HSPA9 | 113013 | 523929 | 9602 | 429475 | 29743 |
| HSPA9 | 113013 | 508003 | 9603 | N/A | |
| HSPA9 | 113013 | 504902 | 9604 | 421311 | 29744 |
| HSPA9 | 113013 | 507115 | 9605 | 423759 | 29745 |
| HSPA9 | 113013 | 505110 | 9606 | 420944 | 29746 |
| HSPA9 | 113013 | 504810 | 9607 | 425598 | 29747 |
| HSPA9 | 113013 | 506477 | 9608 | N/A | |
| HSPA9 | 113013 | 507886 | 9609 | 423098 | 29748 |
| HSPB1 | 106211 | 248553 | 9610 | 248553 | 29749 |
| HSPB1 | 106211 | 447574 | 9611 | 414357 | 29750 |
| HSPB1 | 106211 | 429938 | 9612 | 405285 | 29751 |
| HSPD1 | 144381 | 388968 | 9613 | 373620 | 29752 |
| HSPD1 | 144381 | 491249 | 9614 | N/A | |
| HSPD1 | 144381 | 482167 | 9615 | N/A | |
| HSPD1 | 144381 | 430176 | 9616 | 393670 | 29753 |
| HSPD1 | 144381 | 486181 | 9617 | N/A | |
| HSPD1 | 144381 | 452200 | 9618 | 412717 | 29754 |
| HSPD1 | 144381 | 440114 | 9619 | 390404 | 29755 |
| HSPD1 | 144381 | 476746 | 9620 | N/A | |
| HSPD1 | 144381 | 461097 | 9621 | N/A | |
| HSPD1 | 144381 | 426480 | 9622 | 414446 | 29756 |
| HSPD1 | 144381 | 428204 | 9623 | 396460 | 29757 |
| HSPD1 | 144381 | 439605 | 9624 | 402478 | 29758 |
| HSPD1 | 144381 | 418022 | 9625 | 412227 | 29759 |
| HSPD1 | 144381 | 345042 | 9626 | 340019 | 29760 |
| HSPE1-MOB4 | 270757 | 604458 | 9627 | 474534 | 29761 |
| HSPH1 | 120694 | 320027 | 9628 | 318687 | 29762 |
| HSPH1 | 120694 | 435381 | 9629 | 408991 | 29763 |
| HSPH1 | 120694 | 630972 | 9630 | 487365 | 29764 |
| HSPH1 | 120694 | 380405 | 9631 | 369768 | 29765 |

424

-continued

| Symbol | ENSG | ENST | SEQ ID | ENSP | SEQ ID |
|---|---|---|---|---|---|
| HSPH1 | 120694 | 602786 | 9632 | 473512 | 29766 |
| HSPH1 | 120694 | 626866 | 9633 | N/A | |
| HSPH1 | 120694 | 469538 | 9634 | N/A | |
| HSPH1 | 120694 | 629751 | 9635 | N/A | |
| HSPH1 | 120694 | 445273 | 9636 | 396090 | 29767 |
| HTR1B | 135312 | 369947 | 9637 | 358963 | 29768 |
| HTR2A | 102468 | 378688 | 9638 | 367959 | 29769 |
| HTR2A | 102468 | 612998 | 9639 | 482708 | 29770 |
| HTR2A | 102468 | 543956 | 9640 | 441861 | 29771 |
| HTR2A | 102468 | 542664 | 9641 | 437737 | 29772 |
| HTR2C | 147246 | 371951 | 9642 | 361019 | 29773 |
| HTR2C | 147246 | 276198 | 9643 | 276198 | 29774 |
| HTR2C | 147246 | 371950 | 9644 | 361018 | 29775 |
| HTR5A | 157219 | 287907 | 9645 | 287907 | 29776 |
| HTR5A | 157219 | 486819 | 9646 | N/A | |
| HTR5A-AS1 | 220575 | 395731 | 9647 | N/A | |
| HTR5A-AS1 | 220575 | 493904 | 9648 | N/A | |
| HTRA1 | 166033 | 368984 | 9649 | 357980 | 29777 |
| HTRA1 | 166033 | 420892 | 9650 | 412676 | 29778 |
| HUNK | 142149 | 270112 | 9651 | 270112 | 29779 |
| HUNK | 142149 | 430354 | 9652 | 411860 | 29780 |
| HUNK | 142149 | 465574 | 9653 | N/A | |
| HUNK | 142149 | 439107 | 9654 | 408219 | 29781 |
| ICAM5 | 105376 | 221980 | 9655 | 221980 | 29782 |
| ICAM5 | 105376 | 588912 | 9656 | N/A | |
| ICAM5 | 105376 | 586004 | 9657 | N/A | |
| ICAM5 | 105376 | 587398 | 9658 | 464796 | 29783 |
| ICAM5 | 105376 | 586480 | 9659 | N/A | |
| ICMT | 116237 | 343813 | 9660 | 343552 | 29784 |
| ICMT | 116237 | 495791 | 9661 | N/A | |
| ICMT | 116237 | 489498 | 9662 | 466222 | 29785 |
| ICMT | 116237 | 474756 | 9663 | 467999 | 29786 |
| ICOSLG | 160223 | 344330 | 9664 | 339477 | 29787 |
| ICOSLG | 160223 | 407780 | 9665 | 384432 | 29788 |
| ICOSLG | 160223 | 400379 | 9666 | 383230 | 29789 |
| ICOSLG | 160223 | 400377 | 9667 | 383228 | 29790 |
| ID2 | 115738 | 234091 | 9668 | 234091 | 29791 |
| ID2 | 115738 | 331129 | 9669 | 385465 | 29792 |
| ID2 | 115738 | 472142 | 9670 | N/A | |
| ID2 | 115738 | 396290 | 9671 | 379585 | 29793 |
| ID4 | 172201 | 378700 | 9672 | 367972 | 29794 |
| IDI1 | 067064 | 381344 | 9673 | 370748 | 29795 |
| IDI1 | 067064 | 491735 | 9674 | N/A | |
| IDI1 | 067064 | 427898 | 9675 | 404771 | 29796 |
| IDI1 | 067064 | 429642 | 9676 | 401879 | 29797 |
| IDI1 | 067064 | 482091 | 9677 | N/A | |
| IFFO1 | 010295 | 472558 | 9678 | N/A | |
| IFFO1 | 010295 | 471408 | 9679 | N/A | |
| IFFO1 | 010295 | 465801 | 9680 | 436261 | 29798 |
| IFFO1 | 010295 | 336604 | 9681 | 337593 | 29799 |
| IFFO1 | 010295 | 487279 | 9682 | 432493 | 29800 |
| IFFO1 | 010295 | 396840 | 9683 | 380052 | 29801 |
| IFFO1 | 010295 | 356896 | 9684 | 349364 | 29802 |
| IFFO1 | 010295 | 488007 | 9685 | N/A | |
| IFFO1 | 010295 | 396830 | 9686 | N/A | |
| IFFO1 | 010295 | 619571 | 9687 | 482285 | 29803 |
| IFFO1 | 010295 | 436152 | 9688 | 390721 | 29804 |
| IFFO1 | 010295 | 615885 | 9689 | 482340 | 29805 |
| IFNLR1 | 185436 | 327535 | 9690 | 327824 | 29806 |
| IFNLR1 | 185436 | 327575 | 9691 | 328994 | 29807 |
| IFNLR1 | 185436 | 374421 | 9692 | 363542 | 29808 |
| IFNLR1 | 185436 | 374419 | 9693 | 363540 | 29809 |
| IFNLR1 | 185436 | 374418 | 9694 | 363539 | 29810 |
| IFRD1 | 006652 | 432734 | 9695 | 391379 | 29811 |
| IFRD1 | 006652 | 005558 | 9696 | 005558 | 29812 |
| IFRD1 | 006652 | 443101 | 9697 | 397592 | 29813 |
| IFRD1 | 006652 | 445335 | 9698 | 402453 | 29814 |
| IFRD1 | 006652 | 417662 | 9699 | 413893 | 29815 |
| IFRD1 | 006652 | 403825 | 9700 | 384477 | 29816 |
| IFRD1 | 006652 | 429071 | 9701 | 397314 | 29817 |
| IFRD1 | 006652 | 476927 | 9702 | 437250 | 29818 |
| IFRD1 | 006652 | 440625 | 9703 | 402177 | 29819 |
| IFRD1 | 006652 | 466459 | 9704 | N/A | |
| IFRD1 | 006652 | 486688 | 9705 | N/A | |
| IFRD1 | 006652 | 421296 | 9706 | 403203 | 29820 |
| IFRD1 | 006652 | 489994 | 9707 | N/A | |

-continued

| Symbol | ENSG | ENST | SEQ ID | ENSP | SEQ ID |
|---|---|---|---|---|---|
| IFRD1 | 006652 | 470441 | 9708 | N/A | |
| IFRD1 | 006652 | 462155 | 9709 | 435635 | 29821 |
| IFRD1 | 006652 | 621379 | 9710 | 483255 | 29822 |
| IFRD1 | 006652 | 535603 | 9711 | 439188 | 29823 |
| IFRD1 | 006652 | 432734 | 9712 | 391379 | 29824 |
| IFRD1 | 005558 | 005558 | 9713 | 005558 | 29825 |
| IFRD1 | 006652 | 443101 | 9714 | 397592 | 29826 |
| IFRD1 | 006652 | 445335 | 9715 | 402453 | 29827 |
| IFRD1 | 006652 | 417662 | 9716 | 413893 | 29828 |
| IFRD1 | 006652 | 403825 | 9717 | 384477 | 29829 |
| IFRD1 | 006652 | 429071 | 9718 | 397314 | 29830 |
| IFRD1 | 006652 | 476927 | 9719 | 437250 | 29831 |
| IFRD1 | 006652 | 440625 | 9720 | 402177 | 29832 |
| IFRD1 | 006652 | 466459 | 9721 | N/A | |
| IFRD1 | 006652 | 486688 | 9722 | N/A | |
| IFRD1 | 006652 | 421296 | 9723 | 403203 | 29833 |
| IFRD1 | 006652 | 489994 | 9724 | N/A | |
| IFRD1 | 006652 | 470441 | 9725 | N/A | |
| IFRD1 | 006652 | 462155 | 9726 | 435635 | 29834 |
| IFRD1 | 006652 | 621379 | 9727 | 483255 | 29835 |
| IFRD1 | 006652 | 535603 | 9728 | 439188 | 29836 |
| IFT43 | 119650 | 554026 | 9729 | N/A | |
| IFT43 | 119650 | 555305 | 9730 | N/A | |
| IFT43 | 119650 | 555370 | 9731 | 452051 | 29837 |
| IFT43 | 119650 | 238628 | 9732 | 238628 | 29838 |
| IFT43 | 119650 | 556742 | 9733 | 451096 | 29839 |
| IFT43 | 119650 | 553338 | 9734 | N/A | |
| IFT43 | 119650 | 553438 | 9735 | N/A | |
| IFT43 | 119650 | 554423 | 9736 | N/A | |
| IFT43 | 119650 | 554233 | 9737 | N/A | |
| IFT43 | 119650 | 314067 | 9738 | 324177 | 29840 |
| IFT43 | 119650 | 555677 | 9739 | N/A | |
| IFT43 | 119650 | 542766 | 9740 | 440064 | 29841 |
| IGDCC3 | 174498 | 327987 | 9741 | 332773 | 29842 |
| IGDCC3 | 174498 | 558354 | 9742 | 454105 | 29843 |
| IGDCC3 | 174498 | 559231 | 9743 | N/A | |
| IGDCC3 | 174498 | 559058 | 9744 | 452838 | 29844 |
| IGDCC3 | 174498 | 559947 | 9745 | N/A | |
| IGDCC4 | 103742 | 352385 | 9746 | 319623 | 29845 |
| IGDCC4 | 103742 | 558048 | 9747 | N/A | |
| IGDCC4 | 103742 | 559327 | 9748 | N/A | |
| IGDCC4 | 103742 | 561309 | 9749 | N/A | |
| IGDCC4 | 103742 | 560319 | 9750 | N/A | |
| IGDCC4 | 103742 | 558819 | 9751 | N/A | |
| IGF2 | 167244 | 416167 | 9752 | 414497 | 29846 |
| IGF2 | 167244 | 434045 | 9753 | 391826 | 29847 |
| IGF2 | 167244 | 381392 | 9754 | 370799 | 29848 |
| IGF2 | 167244 | 381389 | 9755 | 370796 | 29849 |
| IGF2 | 167244 | 418738 | 9756 | 402047 | 29850 |
| IGF2 | 167244 | 381395 | 9757 | 370802 | 29851 |
| IGF2 | 167244 | 381406 | 9758 | 370813 | 29852 |
| IGFBP3 | 146674 | 381086 | 9759 | 370674 | 29853 |
| IGFBP3 | 146674 | 275521 | 9760 | 275521 | 29854 |
| IGFBP3 | 146674 | 460209 | 9761 | N/A | |
| IGFBP3 | 146674 | 381083 | 9762 | 370473 | 29855 |
| IGFBP3 | 146674 | 428530 | 9763 | 390298 | 29856 |
| IGFBP3 | 146674 | 417621 | 9764 | 399116 | 29857 |
| IGFBP3 | 146674 | 448817 | 9765 | 389668 | 29858 |
| IGFBP3 | 146674 | 465642 | 9766 | N/A | |
| IGFBP3 | 146674 | 460477 | 9767 | N/A | |
| IGFBP3 | 146674 | 613132 | 9768 | 477772 | 29859 |
| IGFBP3 | 146674 | 615754 | 9769 | 480717 | 29860 |
| IGFBP5 | 115461 | 233813 | 9770 | 233813 | 29861 |
| IGFBP5 | 115461 | 486341 | 9771 | N/A | |
| IGFBP5 | 115461 | 449583 | 9772 | 413474 | 29862 |
| IGSF11 | 144847 | 425327 | 9773 | 406092 | 29863 |
| IGSF11 | 144847 | 393775 | 9774 | 377370 | 29864 |
| IGSF11 | 144847 | 489689 | 9775 | 420486 | 29865 |
| IGSF11 | 144847 | 441144 | 9776 | 401240 | 29866 |
| IGSF11 | 144847 | 491903 | 9777 | 417413 | 29867 |
| IGSF11 | 144847 | 459718 | 9778 | N/A | |
| IGSF11 | 144847 | 483401 | 9779 | 418976 | 29868 |
| IGSF11 | 144847 | 480431 | 9780 | 418047 | 29869 |
| IGSF11 | 144847 | 494802 | 9781 | N/A | |
| IGSF11 | 144847 | 354673 | 9782 | 346700 | 29870 |
| IGSF3 | 143061 | 369486 | 9783 | 358498 | 29871 |

-continued

| Symbol | ENSG | ENST | SEQ ID | ENSP | SEQ ID |
|---|---|---|---|---|---|
| IGSF3 | 143061 | 318837 | 9784 | 321184 | 29872 |
| IGSF3 | 143061 | 481589 | 9785 | 474657 | 29873 |
| IGSF3 | 143061 | 369483 | 9786 | 358495 | 29874 |
| ELP1 | 070061 | 495759 | 9787 | 433514 | 29875 |
| ELP1 | 070061 | 374647 | 9788 | 363779 | 29876 |
| ELP1 | 070061 | 467959 | 9789 | N/A | |
| ELP1 | 070061 | 537196 | 9790 | 439367 | 29877 |
| IL15 | 164136 | 320650 | 9791 | 323505 | 29878 |
| IL15 | 164136 | 296545 | 9792 | 296545 | 29879 |
| IL15 | 164136 | 514653 | 9793 | 422271 | 29880 |
| IL15 | 164136 | 529613 | 9794 | 435462 | 29881 |
| IL15 | 164136 | 477265 | 9795 | 436914 | 29882 |
| IL15 | 164136 | 505351 | 9796 | N/A | |
| IL15 | 164136 | 509249 | 9797 | N/A | |
| IL15 | 164136 | 394159 | 9798 | 377714 | 29883 |
| IL16 | 172349 | 560989 | 9799 | N/A | |
| IL16 | 172349 | 560241 | 9800 | 452738 | 29884 |
| IL16 | 172349 | 360547 | 9801 | 456972 | 29885 |
| IL16 | 172349 | 559383 | 9802 | 453250 | 29886 |
| IL16 | 172349 | 394660 | 9803 | 378155 | 29887 |
| IL16 | 172349 | 302987 | 9804 | 302935 | 29888 |
| IL16 | 172349 | 560115 | 9805 | 454636 | 29889 |
| IL16 | 172349 | 394652 | 9806 | 378147 | 29890 |
| IL16 | 172349 | 560230 | 9807 | N/A | |
| IL16 | 172349 | 558857 | 9808 | 453131 | 29891 |
| IL16 | 172349 | 558332 | 9809 | 453214 | 29892 |
| IL16 | 172349 | 559342 | 9810 | N/A | |
| IL16 | 172349 | 559953 | 9811 | N/A | |
| IL18 | 150782 | 280357 | 9812 | 280357 | 29893 |
| IL18 | 150782 | 524595 | 9813 | 434561 | 29894 |
| IL18 | 150782 | 525547 | 9814 | N/A | |
| IL18 | 150782 | 528832 | 9815 | 434161 | 29895 |
| IL18 | 150782 | 533858 | 9816 | N/A | |
| IL18 | 150782 | 534225 | 9817 | N/A | |
| IL20RB | 174564 | 484501 | 9818 | N/A | |
| IL20RB | 174564 | 329582 | 9819 | 328133 | 29896 |
| IL20RB | 174564 | 469964 | 9820 | 418637 | 29897 |
| IL20RB | 174564 | 491483 | 9821 | 417437 | 29898 |
| IL20RB | 174564 | 475972 | 9822 | 420725 | 29899 |
| IL22 | 127318 | 538666 | 9823 | 442424 | 29900 |
| IL22 | 127318 | 328087 | 9824 | 329384 | 29901 |
| IL22 | 127318 | 538666 | 9825 | 442424 | 29902 |
| IL22 | 127318 | 328087 | 9826 | 329384 | 29903 |
| IL33 | 137033 | 381434 | 9827 | 370842 | 29904 |
| IL33 | 137033 | 463336 | 9828 | N/A | |
| IL33 | 137033 | 417746 | 9829 | 394039 | 29905 |
| IL33 | 137033 | 611532 | 9830 | 478858 | 29906 |
| IL33 | 137033 | 456383 | 9831 | 414238 | 29907 |
| ILDR2 | 143195 | 414590 | 9832 | N/A | |
| ILDR2 | 143195 | 614979 | 9833 | N/A | |
| ILDR2 | 143195 | 271417 | 9834 | 271417 | 29908 |
| ILDR2 | 143195 | 528703 | 9835 | 432750 | 29909 |
| ILDR2 | 143195 | 525740 | 9836 | 436120 | 29910 |
| ILDR2 | 143195 | 529387 | 9837 | 431316 | 29911 |
| ILDR2 | 143195 | 469934 | 9838 | 437008 | 29912 |
| ILDR2 | 143195 | 529071 | 9839 | 436882 | 29913 |
| ILDR2 | 143195 | 526687 | 9840 | 434273 | 29914 |
| IMPA2 | 141401 | 588752 | 9841 | N/A | |
| IMPA2 | 141401 | 589238 | 9842 | 465416 | 29915 |
| IMPA2 | 141401 | 269159 | 9843 | 269159 | 29916 |
| IMPA2 | 141401 | 590107 | 9844 | 466059 | 29917 |
| IMPA2 | 141401 | 383376 | 9845 | 372867 | 29918 |
| IMPA2 | 141401 | 590138 | 9846 | 465938 | 29919 |
| IMPA2 | 141401 | 588927 | 9847 | 464767 | 29920 |
| IMPA2 | 141401 | 588863 | 9848 | N/A | |
| IMPA2 | 141401 | 588167 | 9849 | N/A | |
| IMPA2 | 141401 | 586230 | 9850 | 464754 | 29921 |
| IMPA2 | 141401 | 589374 | 9851 | N/A | |
| IMPA2 | 141401 | 625802 | 9852 | 486461 | 29922 |
| IMPG1 | 112706 | 369950 | 9853 | 358966 | 29923 |
| IMPG1 | 112706 | 369952 | 9854 | 358968 | 29924 |
| IMPG1 | 112706 | 611179 | 9855 | 481913 | 29925 |
| IMPG1 | 112706 | 369963 | 9856 | 358980 | 29926 |
| INAVA | 163362 | 532631 | 9857 | 431682 | 29927 |
| INAVA | 163362 | 451872 | 9858 | 397255 | 29928 |
| INAVA | 163362 | 367342 | 9859 | 356311 | 29929 |

-continued

-continued

| Symbol | ENSG | ENST | SEQ ID | ENSP | SEQ ID |
| --- | --- | --- | --- | --- | --- |
| INAVA | 163362 | 413687 | 9860 | 392105 | 29930 |
| INAVA | 163362 | 531649 | 9861 | N/A | |
| INAVA | 163362 | 526172 | 9862 | N/A | |
| INAVA | 163362 | 465162 | 9863 | N/A | |
| INAVA | 163362 | 532631 | 9864 | 431682 | 29931 |
| INAVA | 163362 | 451872 | 9865 | 397255 | 29932 |
| INAVA | 163362 | 367342 | 9866 | 356311 | 29933 |
| INAVA | 163362 | 413687 | 9867 | 392105 | 29934 |
| INAVA | 163362 | 531649 | 9868 | N/A | |
| INAVA | 163362 | 526172 | 9869 | N/A | |
| INAVA | 163362 | 465162 | 9870 | N/A | |
| INF2 | 203485 | 330634 | 9871 | 376406 | 29935 |
| INF2 | 203485 | 398337 | 9872 | 381380 | 29936 |
| INF2 | 203485 | 392634 | 9873 | 376410 | 29937 |
| INF2 | 203485 | 252527 | 9874 | 252527 | 29938 |
| INF2 | 203485 | 474229 | 9875 | N/A | |
| INF2 | 203485 | 480763 | 9876 | N/A | |
| INF2 | 203485 | 477497 | 9877 | N/A | |
| INF2 | 203485 | 481338 | 9878 | N/A | |
| INF2 | 203485 | 617571 | 9879 | 483829 | 29939 |
| INHBA | 122641 | 416150 | 9880 | N/A | |
| INHBA | 122641 | 242208 | 9881 | 242208 | 29940 |
| INHBA | 122641 | 464515 | 9882 | N/A | |
| INHBA | 122641 | 442711 | 9883 | 397197 | 29941 |
| INHBA | 122641 | 638023 | 9884 | 490646 | 29942 |
| INPP1 | 151689 | 322522 | 9885 | 325423 | 29943 |
| INPP1 | 151689 | 430311 | 9886 | 415014 | 29944 |
| INPP1 | 151689 | 413239 | 9887 | 391415 | 29945 |
| INPP1 | 151689 | 431594 | 9888 | 409786 | 29946 |
| INPP1 | 151689 | 444194 | 9889 | 404732 | 29947 |
| INPP1 | 151689 | 422454 | 9890 | N/A | |
| INPP1 | 151689 | 417336 | 9891 | N/A | |
| INPP1 | 151689 | 458647 | 9892 | 392814 | 29948 |
| INPP1 | 151689 | 423767 | 9893 | 395424 | 29949 |
| INPP1 | 151689 | 451089 | 9894 | 410662 | 29950 |
| INPP1 | 151689 | 409027 | 9895 | 387079 | 29951 |
| INPP1 | 151689 | 458193 | 9896 | 412119 | 29952 |
| INPP1 | 151689 | 487628 | 9897 | N/A | |
| INPP1 | 151689 | 470892 | 9898 | N/A | |
| INPP1 | 151689 | 392329 | 9899 | 376142 | 29953 |
| INPP4B | 109452 | 513000 | 9900 | 425487 | 29954 |
| INPP4B | 109452 | 508116 | 9901 | 423954 | 29955 |
| INPP4B | 109452 | 509777 | 9902 | 422793 | 29956 |
| INPP4B | 109452 | 511838 | 9903 | 426207 | 29957 |
| INPP4B | 109452 | 512630 | 9904 | 423771 | 29958 |
| INPP4B | 109452 | 510812 | 9905 | 427250 | 29959 |
| INPP4B | 109452 | 514525 | 9906 | 421065 | 29960 |
| INPP4B | 109452 | 506297 | 9907 | 424731 | 29961 |
| INPP4B | 109452 | 507462 | 9908 | 425764 | 29962 |
| INPP4B | 109452 | 506217 | 9909 | 424057 | 29963 |
| INPP4B | 109452 | 506788 | 9910 | 426957 | 29964 |
| INPP4B | 109452 | 506517 | 9911 | N/A | |
| INPP4B | 109452 | 506000 | 9912 | 420888 | 29965 |
| INPP4B | 109452 | 504632 | 9913 | N/A | |
| INPP4B | 109452 | 506243 | 9914 | N/A | |
| INPP4B | 109452 | 507861 | 9915 | 426897 | 29966 |
| INPP4B | 109452 | 503927 | 9916 | 422052 | 29967 |
| INPP4B | 109452 | 514964 | 9917 | N/A | |
| INPP4B | 109452 | 505483 | 9918 | N/A | |
| INPP4B | 109452 | 512489 | 9919 | N/A | |
| INPP4B | 109452 | 508084 | 9920 | N/A | |
| INPP4B | 109452 | 262992 | 9921 | 262992 | 29968 |
| INPP4B | 109452 | 630044 | 9922 | 486368 | 29969 |
| INPP5A | 068383 | 368594 | 9923 | 357583 | 29970 |
| INPP5A | 068383 | 368593 | 9924 | 357582 | 29971 |
| INPP5A | 068383 | 423490 | 9925 | 390936 | 29972 |
| INPP5A | 068383 | 342652 | 9926 | 340707 | 29973 |
| INPP5A | 068383 | 487614 | 9927 | N/A | |
| INPP5A | 068383 | 498337 | 9928 | N/A | |
| INPP5A | 068383 | 445580 | 9929 | 390749 | 29974 |
| INPP5D | 281614 | 629761 | 9930 | 486669 | 29975 |
| INPP5D | 281614 | 630338 | 9931 | N/A | |
| INPP5D | 281614 | 630854 | 9932 | 487191 | 29976 |
| INPP5D | 281614 | 627806 | 9933 | N/A | |
| INPP5D | 281614 | 630466 | 9934 | N/A | |
| INPP5D | 281614 | 631055 | 9935 | N/A | |

| Symbol | ENSG | ENST | SEQ ID | ENSP | SEQ ID |
| --- | --- | --- | --- | --- | --- |
| INPP5D | 281614 | 627169 | 9936 | 487535 | 29977 |
| INPP5D | 281614 | 628466 | 9937 | N/A | |
| INPP5D | 281614 | 627243 | 9938 | N/A | |
| INPP5D | 281614 | 628814 | 9939 | N/A | |
| INPP5D | 281614 | 629540 | 9940 | N/A | |
| INPP5D | 281614 | 627349 | 9941 | N/A | |
| INPP5D | 281614 | 628842 | 9942 | 487335 | 29978 |
| INPP5D | 281614 | 629792 | 9943 | 486018 | 29979 |
| INPP5D | 168918 | 359570 | 9944 | 352575 | 29980 |
| INPP5D | 168918 | 451407 | 9945 | N/A | |
| INPP5D | 168918 | 445964 | 9946 | 405338 | 29981 |
| INPP5D | 168918 | 467393 | 9947 | N/A | |
| INPP5D | 168918 | 474278 | 9948 | N/A | |
| INPP5D | 168918 | 496402 | 9949 | N/A | |
| INPP5D | 168918 | 415617 | 9950 | 397421 | 29982 |
| INPP5D | 168918 | 493078 | 9951 | N/A | |
| INPP5D | 168918 | 472517 | 9952 | N/A | |
| INPP5D | 168918 | 493632 | 9953 | N/A | |
| INPP5D | 168918 | 480983 | 9954 | N/A | |
| INPP5D | 168918 | 465281 | 9955 | N/A | |
| INPP5D | 168918 | 417661 | 9956 | 414835 | 29983 |
| INPP5D | 168918 | 491070 | 9957 | 473280 | 29984 |
| INSC | 188487 | 379554 | 9958 | 368872 | 29985 |
| INSC | 188487 | 379556 | 9959 | 368874 | 29986 |
| INSC | 188487 | 528567 | 9960 | 435022 | 29987 |
| INSC | 188487 | 530161 | 9961 | 436194 | 29988 |
| INSC | 188487 | 525218 | 9962 | 436113 | 29989 |
| INSC | 188487 | 447214 | 9963 | N/A | |
| INSC | 188487 | 526102 | 9964 | N/A | |
| INSC | 188487 | 424273 | 9965 | 389161 | 29990 |
| INSIG1 | 186480 | 340368 | 9966 | 344741 | 29991 |
| INSIG1 | 186480 | 425172 | 9967 | 414691 | 29992 |
| INSIG1 | 186480 | 342407 | 9968 | 344035 | 29993 |
| INSIG1 | 186480 | 476756 | 9969 | 420198 | 29994 |
| INSIG1 | 186480 | 468307 | 9970 | N/A | |
| INSIG1 | 186480 | 344756 | 9971 | 340010 | 29995 |
| IPCEF1 | 074706 | 470622 | 9972 | N/A | |
| IPCEF1 | 074706 | 265198 | 9973 | 265198 | 29996 |
| IPCEF1 | 074706 | 422970 | 9974 | 394751 | 29997 |
| IPCEF1 | 074706 | 522590 | 9975 | N/A | |
| IPCEF1 | 074706 | 367220 | 9976 | 356189 | 29998 |
| IPCEF1 | 074706 | 519344 | 9977 | 430287 | 29999 |
| IPCEF1 | 074706 | 519091 | 9978 | N/A | |
| IPCEF1 | 074706 | 484827 | 9979 | N/A | |
| IPCEF1 | 074706 | 517438 | 9980 | 431092 | 30000 |
| IPCEF1 | 074706 | 519405 | 9981 | 428767 | 30001 |
| IPCEF1 | 074706 | 519190 | 9982 | 429972 | 30002 |
| IPCEF1 | 074706 | 518162 | 9983 | N/A | |
| IPCEF1 | 074706 | 520261 | 9984 | 431004 | 30003 |
| ITPR1 | 150995 | 357086 | 9985 | 349597 | 30004 |
| ITPR1 | 150995 | 456211 | 9986 | 397885 | 30005 |
| ITPR1 | 150995 | 443694 | 9987 | 401671 | 30006 |
| ITPR1 | 150995 | 491868 | 9988 | N/A | |
| ITPR1 | 150995 | 477577 | 9989 | N/A | |
| ITPR1 | 150995 | 494681 | 9990 | N/A | |
| ITPR1 | 150995 | 487016 | 9991 | N/A | |
| ITPR1 | 150995 | 479831 | 9992 | N/A | |
| ITPR1 | 150995 | 481415 | 9993 | N/A | |
| ITPR1 | 150995 | 467545 | 9994 | N/A | |
| ITPR1 | 150995 | 493491 | 9995 | N/A | |
| ITPR1 | 150995 | 463980 | 9996 | N/A | |
| ITPR1 | 150995 | 490572 | 9997 | N/A | |
| ITPR1 | 150995 | 472205 | 9998 | N/A | |
| ITPR1 | 150995 | 478515 | 9999 | N/A | |
| ITPR1 | 150995 | 302643 | 10000 | 306253 | 30007 |
| ITPR1 | 150995 | 354582 | 10001 | 346595 | 30008 |
| ITPR1 | 150995 | 544951 | 10002 | 440564 | 30009 |
| ITPR1 | 150995 | 467056 | 10003 | N/A | |
| ITPR1 | 150995 | 357086 | 10004 | 349597 | 30010 |
| ITPR1 | 150995 | 456211 | 10005 | 397885 | 30011 |
| ITPR1 | 150995 | 443694 | 10006 | 401671 | 30012 |
| ITPR1 | 150995 | 491868 | 10007 | N/A | |
| ITPR1 | 150995 | 477577 | 10008 | N/A | |
| ITPR1 | 150995 | 494681 | 10009 | N/A | |
| ITPR1 | 150995 | 487016 | 10010 | N/A | |
| ITPR1 | 150995 | 479831 | 10011 | N/A | |

-continued

-continued

| Symbol | ENSG | ENST | SEQ ID | ENSP | SEQ ID |
|---|---|---|---|---|---|
| ITPR1 | 150995 | 481415 | 10012 | N/A | |
| ITPR1 | 150995 | 467545 | 10013 | N/A | |
| ITPR1 | 150995 | 493491 | 10014 | N/A | |
| ITPR1 | 150995 | 463980 | 10015 | N/A | |
| ITPR1 | 150995 | 490572 | 10016 | N/A | |
| ITPR1 | 150995 | 472205 | 10017 | N/A | |
| ITPR1 | 150995 | 478515 | 10018 | N/A | |
| ITPR1 | 150995 | 302640 | 10019 | 306253 | 30013 |
| ITPR1 | 150995 | 354582 | 10020 | 346595 | 30014 |
| ITPR1 | 150995 | 544951 | 10021 | 440564 | 30015 |
| ITPR1 | 150995 | 467056 | 10022 | N/A | |
| IQCH | 103599 | 512104 | 10023 | 427323 | 30016 |
| IQCH | 103599 | 514049 | 10024 | 421223 | 30017 |
| IQCH | 103599 | 335894 | 10025 | 336861 | 30018 |
| IQCH | 103599 | 535744 | 10026 | 441306 | 30019 |
| IQCH | 103599 | 559568 | 10027 | 453749 | 30020 |
| IQCH | 103599 | 560497 | 10028 | N/A | |
| IQCH | 103599 | 561339 | 10029 | 454387 | 30021 |
| IQCH | 103599 | 560790 | 10030 | N/A | |
| IQCH | 103599 | 559172 | 10031 | N/A | |
| IQCH | 103599 | 561357 | 10032 | 457425 | 30022 |
| IQCH | 103599 | 558759 | 10033 | 456293 | 30023 |
| IQCH | 103599 | 546225 | 10034 | 444118 | 30024 |
| IQCH | 103599 | 358767 | 10035 | 351617 | 30025 |
| IQCH | 103599 | 629425 | 10036 | 486970 | 30026 |
| IQGAP1 | 140575 | 268182 | 10037 | 268182 | 30027 |
| IQGAP1 | 140575 | 633485 | 10038 | 488618 | 30028 |
| IQGAP1 | 140575 | 560738 | 10039 | 453181 | 30029 |
| IQGAP1 | 140575 | 560418 | 10040 | 452723 | 30030 |
| IQGAP1 | 140575 | 559809 | 10041 | 484647 | 30031 |
| IQGAP1 | 140575 | 559682 | 10042 | N/A | |
| IQGAP1 | 140575 | 560373 | 10043 | 480393 | 30032 |
| IQGAP1 | 140575 | 558003 | 10044 | N/A | |
| IQGAP1 | 140575 | 560733 | 10045 | N/A | |
| IQGAP1 | 140575 | 560020 | 10046 | N/A | |
| IQGAP1 | 140575 | 560218 | 10047 | N/A | |
| IQGAP1 | 140575 | 558491 | 10048 | N/A | |
| IQGAP1 | 140575 | 561132 | 10049 | N/A | |
| IQGAP1 | 140575 | 561461 | 10050 | N/A | |
| IQGAP1 | 140575 | 559031 | 10051 | N/A | |
| IQGAP1 | 140575 | 559674 | 10052 | N/A | |
| IQGAP1 | 140575 | 558957 | 10053 | N/A | |
| IQGAP1 | 140575 | 561086 | 10054 | N/A | |
| IQSEC1 | 144711 | 273221 | 10055 | 273221 | 30033 |
| IQSEC1 | 144711 | 618604 | 10056 | 478001 | 30034 |
| IQSEC1 | 144711 | 613206 | 10057 | 480301 | 30035 |
| IQSEC1 | 144711 | 473088 | 10058 | N/A | |
| IQSEC1 | 144711 | 474467 | 10059 | N/A | |
| IQSEC3 | 120645 | 538872 | 10060 | 437554 | 30036 |
| IQSEC3 | 120645 | 382841 | 10061 | 372292 | 30037 |
| IQSEC3 | 120645 | 540907 | 10062 | N/A | |
| IQSEC3 | 120645 | 537151 | 10063 | N/A | |
| IQSEC3 | 120645 | 544511 | 10064 | N/A | |
| IQSEC3 | 262607 | 575724 | 10065 | 461496 | 30038 |
| IQSEC3 | 262607 | 571363 | 10066 | 461043 | 30039 |
| IQSEC3 | 262607 | 574111 | 10067 | N/A | |
| IQSEC3 | 262607 | 573139 | 10068 | N/A | |
| IRAK2 | 134070 | 256458 | 10069 | 256458 | 30040 |
| IRX1 | 170549 | 302006 | 10070 | 305244 | 30041 |
| IRX2 | 170561 | 382611 | 10071 | 372056 | 30042 |
| IRX2 | 170561 | 302057 | 10072 | 307006 | 30043 |
| IRX5 | 176842 | 394636 | 10073 | 378132 | 30044 |
| IRX5 | 176842 | 560154 | 10074 | 453660 | 30045 |
| IRX5 | 176842 | 320990 | 10075 | 316250 | 30046 |
| IRX5 | 176842 | 558597 | 10076 | N/A | |
| IRX5 | 176842 | 620085 | 10077 | 483446 | 30047 |
| ISYNA1 | 105655 | 582811 | 10078 | 463628 | 30048 |
| ISYNA1 | 105655 | 338128 | 10079 | 337746 | 30049 |
| ISYNA1 | 105655 | 457269 | 10080 | 415458 | 30050 |
| ISYNA1 | 105655 | 582287 | 10081 | N/A | |
| ISYNA1 | 105655 | 581672 | 10082 | 464528 | 30051 |
| ISYNA1 | 105655 | 578963 | 10083 | 475677 | 30052 |
| ISYNA1 | 105655 | 582770 | 10084 | 464209 | 30053 |
| ISYNA1 | 105655 | 577916 | 10085 | N/A | |
| ISYNA1 | 105655 | 577820 | 10086 | 463271 | 30054 |
| ISYNA1 | 105655 | 583816 | 10087 | N/A | |

| Symbol | ENSG | ENST | SEQ ID | ENSP | SEQ ID |
|---|---|---|---|---|---|
| ISYNA1 | 105655 | 583309 | 10088 | N/A | |
| ISYNA1 | 105655 | 578352 | 10089 | 462001 | 30055 |
| ISYNA1 | 105655 | 581800 | 10090 | 463500 | 30056 |
| ISYNA1 | 105655 | 583534 | 10091 | 464430 | 30057 |
| ITGA11 | 137809 | 423218 | 10092 | 403392 | 30058 |
| ITGA11 | 137809 | 315757 | 10093 | 327290 | 30059 |
| ITGA11 | 137809 | 569346 | 10094 | N/A | |
| ITGA11 | 137809 | 566429 | 10095 | N/A | |
| ITGA11 | 137809 | 562826 | 10096 | N/A | |
| ITGA11 | 137809 | 565868 | 10097 | N/A | |
| ITGA11 | 137809 | 568677 | 10098 | N/A | |
| ITGA2 | 164171 | 296585 | 10099 | 296585 | 30060 |
| ITGA2 | 164171 | 503810 | 10100 | 426489 | 30061 |
| ITGA2 | 164171 | 513685 | 10101 | 422095 | 30062 |
| ITGA2 | 164171 | 509814 | 10102 | 424397 | 30063 |
| ITGA2 | 164171 | 509960 | 10103 | 424642 | 30064 |
| ITGA2 | 164171 | 510722 | 10104 | 422145 | 30065 |
| ITGA4 | 115232 | 476089 | 10105 | N/A | |
| ITGA4 | 115232 | 339307 | 10106 | 340149 | 30066 |
| ITGA4 | 115232 | 397033 | 10107 | 380227 | 30067 |
| ITGA4 | 115232 | 465522 | 10108 | N/A | |
| ITGA4 | 115232 | 233573 | 10109 | 233573 | 30068 |
| ITGA4 | 115232 | 484404 | 10110 | N/A | |
| ITGA4 | 115232 | 478440 | 10111 | N/A | |
| ITGA4 | 115232 | 473002 | 10112 | N/A | |
| ITGA4 | 115232 | 490435 | 10113 | N/A | |
| ITGA4 | 115232 | 476824 | 10114 | N/A | |
| ITGA4 | 115232 | 468948 | 10115 | N/A | |
| ITGA5 | 161638 | 552564 | 10116 | N/A | |
| ITGA5 | 161638 | 293379 | 10117 | 293379 | 30069 |
| ITGA5 | 161638 | 547197 | 10118 | 450267 | 30070 |
| ITGA5 | 161638 | 549601 | 10119 | N/A | |
| ITGA5 | 161638 | 552431 | 10120 | N/A | |
| ITGA5 | 161638 | 552387 | 10121 | N/A | |
| ITGA5 | 161638 | 552583 | 10122 | N/A | |
| ITGA5 | 161638 | 551564 | 10123 | N/A | |
| ITGA5 | 161638 | 550141 | 10124 | N/A | |
| ITGA5 | 161638 | 551861 | 10125 | N/A | |
| ITGA5 | 161638 | 435631 | 10126 | 405865 | 30071 |
| ITGA5 | 161638 | 553071 | 10127 | 447347 | 30072 |
| ITGA5 | 161638 | 547744 | 10128 | N/A | |
| ITGA7 | 135424 | 553804 | 10129 | 452120 | 30073 |
| ITGA7 | 135424 | 257879 | 10130 | 257879 | 30074 |
| ITGA7 | 135424 | 554327 | 10131 | 450693 | 30075 |
| ITGA7 | 135424 | 347027 | 10132 | 343009 | 30076 |
| ITGA7 | 135424 | 452168 | 10133 | 393844 | 30077 |
| ITGA7 | 135424 | 555728 | 10134 | 452387 | 30078 |
| ITGA7 | 135424 | 557555 | 10135 | 451039 | 30079 |
| ITGA7 | 135424 | 557058 | 10136 | N/A | |
| ITGA7 | 135424 | 557488 | 10137 | N/A | |
| ITGA7 | 135424 | 556273 | 10138 | 450679 | 30080 |
| ITGA7 | 135424 | 554543 | 10139 | N/A | |
| ITGA7 | 135424 | 557257 | 10140 | 450578 | 30081 |
| ITGA7 | 135424 | 553276 | 10141 | N/A | |
| ITGA7 | 135424 | 555687 | 10142 | 451311 | 30082 |
| ITGA7 | 135424 | 554724 | 10143 | 452043 | 30083 |
| ITGA7 | 135424 | 553737 | 10144 | N/A | |
| ITGA7 | 135424 | 556371 | 10145 | N/A | |
| ITGA7 | 135424 | 553893 | 10146 | 452467 | 30084 |
| ITGA7 | 135424 | 555809 | 10147 | 450798 | 30085 |
| ITGA7 | 135424 | 554359 | 10148 | N/A | |
| ITGA8 | 077943 | 378076 | 10149 | 367316 | 30086 |
| ITGA8 | 077943 | 477064 | 10150 | N/A | |
| ITGA8 | 077943 | 468882 | 10151 | N/A | |
| ITGA9 | 144668 | 422441 | 10152 | 397258 | 30087 |
| ITGA9 | 144668 | 264741 | 10153 | 264741 | 30088 |
| ITGA9 | 144668 | 461533 | 10154 | N/A | |
| ITGA9 | 144668 | 411817 | 10155 | 406533 | 30089 |
| ITGAV | 138448 | 261023 | 10156 | 261023 | 30090 |
| ITGAV | 138448 | 374907 | 10157 | 364042 | 30091 |
| ITGAV | 138448 | 433736 | 10158 | 404291 | 30092 |
| ITGAV | 138448 | 460641 | 10159 | N/A | |
| ITGAV | 138448 | 496477 | 10160 | N/A | |
| ITGAV | 138448 | 496854 | 10161 | N/A | |
| ITGAV | 138448 | 474571 | 10162 | N/A | |
| ITGAV | 138448 | 430709 | 10163 | 389442 | 30093 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| ITGB4 | 132470 | 579662 | 10164 | 463651 | 30094 | 5 | JAG1 | 101384 | 622545 | 10240 | 484139 | 30134 |
| ITGB4 | 132470 | 200181 | 10165 | 200181 | 30095 | | JAG1 | 101384 | 620743 | 10241 | N/A | |
| ITGB4 | 132470 | 450894 | 10166 | 405536 | 30096 | | JAG1 | 101384 | 617965 | 10242 | N/A | |
| ITGB4 | 132470 | 580542 | 10167 | N/A | | | JAM2 | 154721 | 400532 | 10243 | 383376 | 30135 |
| ITGB4 | 132470 | 449880 | 10168 | 400217 | 30097 | | JAM2 | 154721 | 480456 | 10244 | 420419 | 30136 |
| ITGB4 | 132470 | 584558 | 10169 | N/A | | | JAM2 | 154721 | 460679 | 10245 | 436801 | 30137 |
| ITGB4 | 132470 | 582629 | 10170 | 463788 | 30098 | 10 | JAM2 | 154721 | 492962 | 10246 | N/A | |
| ITGB4 | 132470 | 584374 | 10171 | N/A | | | JAM2 | 154721 | 477351 | 10247 | N/A | |
| ITGB4 | 132470 | 584025 | 10172 | N/A | | | JAM2 | 154721 | 471689 | 10248 | N/A | |
| ITGB4 | 132470 | 583327 | 10173 | N/A | | | JAM2 | 154721 | 312957 | 10249 | 318416 | 30138 |
| ITGB4 | 132470 | 579211 | 10174 | N/A | | | JAM3 | 166086 | 299106 | 10250 | 299106 | 30139 |
| ITGB4 | 132470 | 584939 | 10175 | 464259 | 30099 | | JAM3 | 166086 | 532252 | 10251 | 432455 | 30140 |
| ITGB4 | 132470 | 578318 | 10176 | 462494 | 30100 | 15 | JAM3 | 166086 | 534549 | 10252 | 433206 | 30141 |
| ITGB5 | 082781 | 296181 | 10177 | 296181 | 30101 | | JAM3 | 166086 | 441717 | 10253 | 395742 | 30142 |
| ITGB5 | 082781 | 460797 | 10178 | N/A | | | JAM3 | 166086 | 531302 | 10254 | N/A | |
| ITGB5 | 082781 | 461306 | 10179 | N/A | | | JAM3 | 166086 | 524969 | 10255 | N/A | |
| ITGB5 | 082781 | 481591 | 10180 | 420814 | 30102 | | JAM3 | 166086 | 532165 | 10256 | N/A | |
| ITGB5 | 082781 | 488466 | 10181 | 477446 | 30103 | | JAM3 | 166086 | 533711 | 10257 | N/A | |
| ITGB5 | 082781 | 474838 | 10182 | N/A | | | JAML | 160593 | 529164 | 10258 | N/A | |
| ITGB5 | 082781 | 496703 | 10183 | 418367 | 30104 | 20 | JAML | 160593 | 531536 | 10259 | N/A | |
| ITGB5 | 082781 | 476988 | 10184 | N/A | | | JAML | 160593 | 524477 | 10260 | 432769 | 30143 |
| ITGB5 | 082781 | 465464 | 10185 | 418079 | 30105 | | JAML | 160593 | 527877 | 10261 | 435145 | 30144 |
| ITGB5 | 082781 | 608657 | 10186 | 477230 | 30106 | | JAML | 160593 | 525565 | 10262 | 431791 | 30145 |
| ITGB5 | 082781 | 483168 | 10187 | 419198 | 30107 | | JAML | 160593 | 640745 | 10263 | 492467 | 30146 |
| ITGB5 | 082781 | 608107 | 10188 | 476655 | 30108 | | JAML | 160593 | 531530 | 10264 | N/A | |
| ITGB5 | 082781 | 608945 | 10189 | N/A | | 25 | JAML | 160593 | 526620 | 10265 | 431218 | 30147 |
| ITGB8 | 105855 | 537992 | 10190 | 441561 | 30109 | | JAML | 160593 | 526595 | 10266 | 431614 | 30148 |
| ITGB8 | 105855 | 478974 | 10191 | N/A | | | JAML | 160593 | 356289 | 10267 | 348635 | 30149 |
| ITGB8 | 105855 | 222573 | 10192 | 222573 | 30110 | | JAML | 160593 | 292067 | 10268 | 292067 | 30150 |
| ITGB8 | 105855 | 460204 | 10193 | N/A | | | JAML | 160593 | 534294 | 10269 | N/A | |
| ITGB8 | 105855 | 477859 | 10194 | N/A | | | JAML | 160593 | 533261 | 10270 | 436117 | 30151 |
| ITIH3 | 162267 | 467268 | 10195 | N/A | | 30 | JAZF1 | 153814 | 427814 | 10271 | 388302 | 30152 |
| ITIH3 | 162267 | 416872 | 10196 | 413922 | 30111 | | JAZF1 | 153814 | 283928 | 10272 | 283928 | 30153 |
| ITIH3 | 162267 | 449956 | 10197 | 415769 | 30112 | | JAZF1 | 153814 | 466516 | 10273 | N/A | |
| ITIH3 | 162267 | 465243 | 10198 | N/A | | | JAZF1 | 153814 | 430432 | 10274 | 387976 | 30154 |
| ITIH3 | 162267 | 463893 | 10199 | N/A | | | JAZF1 | 153814 | 447620 | 10275 | 415096 | 30155 |
| ITIH3 | 162267 | 464804 | 10200 | N/A | | | JAZF1 | 153814 | 452993 | 10276 | 415984 | 30156 |
| ITIH3 | 162267 | 465314 | 10201 | N/A | | 35 | JAZF1 | 153814 | 420835 | 10277 | N/A | |
| ITIH3 | 162267 | 475931 | 10202 | N/A | | | JAZF1 | 153814 | 454041 | 10278 | 399083 | 30157 |
| ITIH3 | 162267 | 495622 | 10203 | N/A | | | JDP2 | 140044 | 419727 | 10279 | 415558 | 30158 |
| ITIH3 | 162267 | 493136 | 10204 | N/A | | | JDP2 | 140044 | 559773 | 10280 | N/A | |
| ITIH3 | 162267 | 621946 | 10205 | 479928 | 30113 | | JDP2 | 140044 | 559060 | 10281 | 452769 | 30159 |
| ITM2A | 078596 | 373298 | 10206 | 362395 | 30114 | | JDP2 | 140044 | 558068 | 10282 | N/A | |
| ITM2A | 078596 | 469541 | 10207 | N/A | | 40 | JDP2 | 140044 | 435893 | 10283 | 399587 | 30160 |
| ITM2A | 078596 | 482194 | 10208 | N/A | | | JDP2 | 140044 | 267569 | 10284 | 267569 | 30161 |
| ITM2A | 078596 | 462038 | 10209 | N/A | | | JDP2 | 140044 | 437176 | 10285 | 409787 | 30162 |
| ITM2A | 078596 | 461357 | 10210 | N/A | | | JKAMP | 050130 | 261247 | 10286 | 261247 | 30163 |
| ITM2A | 078596 | 434584 | 10211 | 415533 | 30115 | | JKAMP | 050130 | 554754 | 10287 | N/A | |
| ITPKA | 137825 | 425927 | 10212 | 396560 | 30116 | | JKAMP | 050130 | 557560 | 10288 | N/A | |
| ITPKA | 137825 | 260386 | 10213 | 260386 | 30117 | | JKAMP | 050130 | 425728 | 10289 | 389699 | 30164 |
| ITPKA | 137825 | 462816 | 10214 | N/A | | 45 | JKAMP | 050130 | 553156 | 10290 | N/A | |
| ITPKA | 137825 | 491007 | 10215 | N/A | | | JKAMP | 050130 | 555491 | 10291 | 451723 | 30165 |
| ITPKB | 143772 | 272117 | 10216 | 272117 | 30118 | | JKAMP | 050130 | 556985 | 10292 | 451076 | 30166 |
| ITPKB | 143772 | 366784 | 10217 | 355748 | 30119 | | JKAMP | 050130 | 554271 | 10293 | 450749 | 30167 |
| ITPKB | 143772 | 429204 | 10218 | 411152 | 30120 | | JKAMP | 050130 | 554795 | 10294 | 450813 | 30168 |
| ITPRIPL2 | 205730 | 566735 | 10219 | 455257 | 30121 | | JKAMP | 050130 | 553941 | 10295 | N/A | |
| ITPRIPL2 | 205730 | 381440 | 10220 | 370849 | 30122 | 50 | JKAMP | 050130 | 602482 | 10296 | N/A | |
| ITSN2 | 198399 | 478720 | 10221 | N/A | | | JKAMP | 050130 | 554721 | 10297 | N/A | |
| ITSN2 | 198399 | 361999 | 10222 | 354561 | 30123 | | JKAMP | 050130 | 553647 | 10298 | N/A | |
| ITSN2 | 198399 | 355123 | 10223 | 347244 | 30124 | | JKAMP | 050130 | 356057 | 10299 | 348351 | 30169 |
| ITSN2 | 198399 | 427234 | 10224 | 395682 | 30125 | | JKAMP | 050130 | 616435 | 10300 | 479775 | 30170 |
| ITSN2 | 198399 | 449392 | 10225 | 411319 | 30126 | | JMY | 152409 | 396137 | 10301 | 379441 | 30171 |
| ITSN2 | 198399 | 479575 | 10226 | N/A | | 55 | JMY | 152409 | 412001 | 10302 | N/A | |
| ITSN2 | 198399 | 406921 | 10227 | 384499 | 30127 | | JOSD1 | 100221 | 216039 | 10303 | 216039 | 30172 |
| ITSN2 | 198399 | 416160 | 10228 | 389013 | 30128 | | JOSD1 | 100221 | 545590 | 10304 | 444798 | 30173 |
| ITSN2 | 198399 | 412011 | 10229 | 391224 | 30129 | | JOSD1 | 100221 | 482442 | 10305 | N/A | |
| ITSN2 | 198399 | 469848 | 10230 | N/A | | | JOSD1 | 100221 | 427389 | 10306 | 410010 | 30174 |
| ITSN2 | 198399 | 443927 | 10231 | 391715 | 30130 | | JOSD1 | 100221 | 412832 | 10307 | 415189 | 30175 |
| ITSN2 | 198399 | 407704 | 10232 | N/A | | 60 | JOSD1 | 100221 | 417712 | 10308 | 393131 | 30176 |
| ITSN2 | 198399 | 622089 | 10233 | 479408 | 30131 | | JOSD1 | 100221 | 456626 | 10309 | 405182 | 30177 |
| JAG1 | 101384 | 254958 | 10234 | 254958 | 30132 | | JOSD1 | 100221 | 462610 | 10310 | N/A | |
| JAG1 | 101384 | 423891 | 10235 | N/A | | | JOSD1 | 100221 | 490169 | 10311 | N/A | |
| JAG1 | 101384 | 617357 | 10236 | N/A | | | JOSD1 | 100221 | 493939 | 10312 | N/A | |
| JAG1 | 101384 | 488480 | 10237 | N/A | | | JPH1 | 104369 | 342232 | 10313 | 344488 | 30178 |
| JAG1 | 101384 | 612857 | 10238 | N/A | | 65 | JPH1 | 104369 | 518195 | 10314 | N/A | |
| JAG1 | 101384 | 613518 | 10239 | 481034 | 30133 | | JPH1 | 104369 | 519947 | 10315 | 429652 | 30179 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| JPH3 | 154118 | 537256 | 10316 | N/A | | 5 | KCNAB2 | 069424 | 478098 | 10392 | N/A | |
| JPH3 | 154118 | 301008 | 10317 | N/A | | | KCNAB2 | 069424 | 445501 | 10393 | 398395 | 30231 |
| JPH3 | 154118 | 284262 | 10318 | 284262 | 30180 | | KCNAB2 | 069424 | 389632 | 10394 | 374283 | 30232 |
| JPH3 | 154118 | 563609 | 10319 | N/A | | | KCNAB2 | 069424 | 428161 | 10395 | 400285 | 30233 |
| JUN | 177606 | 371222 | 10320 | 360266 | 30181 | | KCNAB2 | 069424 | 602612 | 10396 | 473602 | 30234 |
| JUNB | 171223 | 302754 | 10321 | 303315 | 30182 | | KCNAB2 | 069424 | 435937 | 10397 | N/A | |
| JUND | 130522 | 252818 | 10322 | 252818 | 30183 | 10 | KCNAB2 | 069424 | 164247 | 10398 | 164247 | 30235 |
| JUND | 130522 | 600972 | 10323 | 475153 | 30184 | | KCNAB2 | 069424 | 459822 | 10399 | N/A | |
| KANK1 | 107104 | 382303 | 10324 | 371740 | 30185 | | KCNAB2 | 069424 | 472700 | 10400 | 464860 | 30236 |
| KANK1 | 107104 | 467541 | 10325 | N/A | | | KCNAB2 | 069424 | 378083 | 10401 | 367323 | 30237 |
| KANK1 | 107104 | 475690 | 10326 | N/A | | | KCNAB2 | 069424 | 458166 | 10402 | 396167 | 30238 |
| KANK1 | 107104 | 489369 | 10327 | N/A | | | KCNAB2 | 069424 | 462676 | 10403 | 465785 | 30239 |
| KANK1 | 107104 | 354485 | 10328 | N/A | | 15 | KCNAB2 | 069424 | 481789 | 10404 | N/A | |
| KANK1 | 107104 | 382297 | 10329 | 371734 | 30186 | | KCNAB2 | 069424 | 352527 | 10405 | 318772 | 30240 |
| KANK1 | 107104 | 382293 | 10330 | 371730 | 30187 | | KCNAB2 | 069424 | 341524 | 10406 | 340824 | 30241 |
| KANK1 | 107104 | 382289 | 10331 | 371726 | 30188 | | KCNAB3 | 170049 | 303790 | 10407 | 302719 | 30242 |
| KANK1 | 107104 | 382286 | 10332 | 371723 | 30189 | | KCNAB3 | 170049 | 572275 | 10408 | N/A | |
| KANK1 | 107104 | 619269 | 10333 | 477725 | 30190 | | KCNAB3 | 170049 | 570587 | 10409 | 458237 | 30243 |
| KANK2 | 197256 | 586659 | 10334 | 465650 | 30191 | 20 | KCNAB3 | 170049 | 576981 | 10410 | N/A | |
| KANK2 | 197256 | 588787 | 10335 | 464896 | 30192 | | KCNAB3 | 170049 | 574006 | 10411 | N/A | |
| KANK2 | 197256 | 587317 | 10336 | N/A | | | KCNAB3 | 170049 | 570852 | 10412 | 461290 | 30244 |
| KANK2 | 197256 | 589359 | 10337 | 468002 | 30193 | | KCNC1 | 129159 | 379472 | 10413 | 368785 | 30245 |
| KANK2 | 197256 | 589894 | 10338 | 467029 | 30194 | | KCNC1 | 129159 | 265959 | 10414 | 265969 | 30246 |
| KANK2 | 197256 | 590400 | 10339 | N/A | | | KCNC1 | 129159 | 640318 | 10415 | 491189 | 30247 |
| KANK2 | 197256 | 592675 | 10340 | 468409 | 30195 | 25 | KCNC1 | 129159 | 640153 | 10416 | N/A | |
| KANK2 | 197256 | 590685 | 10341 | 468490 | 30196 | | KCNC1 | 129159 | 640909 | 10417 | 491644 | 30248 |
| KANK2 | 197256 | 588724 | 10342 | 465914 | 30197 | | KCNC1 | 129159 | 639495 | 10418 | 491700 | 30249 |
| KANK2 | 197256 | 592903 | 10343 | 464861 | 30198 | | KCNC1 | 129159 | 638366 | 10419 | 491016 | 30250 |
| KANK2 | 197256 | 592215 | 10344 | N/A | | | KCNC1 | 129159 | 639325 | 10420 | 492663 | 30251 |
| KANK2 | 197256 | 590095 | 10345 | N/A | | | KCNC1 | 129159 | 640461 | 10421 | 491345 | 30252 |
| KANK2 | 197256 | 589427 | 10346 | N/A | | | KCNC1 | 129159 | 638825 | 10422 | 491247 | 30253 |
| KANK4 | 132854 | 317477 | 10347 | 321161 | 30199 | 30 | KCNC1 | 129159 | 525802 | 10423 | N/A | |
| KANK4 | 132854 | 371153 | 10348 | 360195 | 30200 | | KCNC1 | 129159 | 638395 | 10424 | N/A | |
| KANK4 | 132854 | 371150 | 10349 | 360192 | 30201 | | KCNC1 | 129159 | 526029 | 10425 | N/A | |
| KANK4 | 132854 | 354381 | 10350 | 346352 | 30202 | | KCNC2 | 166006 | 550433 | 10426 | 448301 | 30254 |
| KCNA1 | 111262 | 382545 | 10351 | 371985 | 30203 | | KCNC2 | 166006 | 548513 | 10427 | 449941 | 30255 |
| KCNA1 | 111262 | 543874 | 10352 | N/A | | | KCNC2 | 166006 | 549446 | 10428 | 449253 | 30256 |
| KCNA1 | 111262 | 639306 | 10353 | 492506 | 30204 | 35 | KCNC2 | 166006 | 350228 | 10429 | 319877 | 30257 |
| KCNA1 | 111262 | 639680 | 10354 | 492218 | 30205 | | KCNC2 | 166006 | 540018 | 10430 | 438423 | 30258 |
| KCNA2 | 177301 | 640680 | 10355 | N/A | | | KCNC2 | 166006 | 393288 | 10431 | 376966 | 30259 |
| KCNA2 | 177301 | 640450 | 10356 | N/A | | | KCNC2 | 166006 | 548243 | 10432 | N/A | |
| KCNA2 | 177301 | 525120 | 10357 | N/A | | | KCNC2 | 166006 | 546456 | 10433 | N/A | |
| KCNA2 | 177301 | 639227 | 10358 | N/A | | | KCNC2 | 166006 | 298972 | 10434 | 298972 | 30260 |
| KCNA2 | 177301 | 633222 | 10359 | 487785 | 30206 | 40 | KCNC3 | 131398 | 376959 | 10435 | 366158 | 30261 |
| KCNA2 | 177301 | 369770 | 10360 | 358785 | 30207 | | KCNC3 | 131398 | 474951 | 10436 | 432438 | 30262 |
| KCNA2 | 177301 | 639048 | 10361 | 491627 | 30208 | | KCNC3 | 131398 | 477616 | 10437 | 434241 | 30263 |
| KCNA2 | 177301 | 640774 | 10362 | 492008 | 30209 | | KCND3 | 171385 | 369697 | 10438 | 358711 | 30264 |
| KCNA2 | 177301 | 639233 | 10363 | 492716 | 30210 | | KCND3 | 171385 | 315987 | 10439 | 319591 | 30265 |
| KCNA2 | 177301 | 638477 | 10364 | 491354 | 30211 | | KCND3 | 171385 | 302127 | 10440 | 306923 | 30266 |
| KCNA2 | 177301 | 638616 | 10365 | 491977 | 30212 | | KCNF1 | 162975 | 295082 | 10441 | 295082 | 30267 |
| KCNA2 | 177301 | 316361 | 10366 | 314520 | 30213 | 45 | KCNG4 | 168418 | 308251 | 10442 | 312129 | 30268 |
| KCNA2 | 177301 | 638532 | 10367 | 491613 | 30214 | | KCNG4 | 168418 | 568181 | 10443 | 457897 | 30269 |
| KCNA2 | 177301 | 485317 | 10368 | 433109 | 30215 | | KCNH1 | 143473 | 367007 | 10444 | 355974 | 30270 |
| KCNA2 | 177301 | 640956 | 10369 | 491647 | 30216 | | KCNH1 | 143473 | 638498 | 10445 | 490983 | 30271 |
| KCNA3 | 177272 | 369769 | 10370 | 358784 | 30217 | | KCNH1 | 143473 | 640710 | 10446 | 492513 | 30272 |
| KCNA4 | 182255 | 328224 | 10371 | 328511 | 30218 | | KCNH1 | 143473 | 271751 | 10447 | 271751 | 30273 |
| KCNA4 | 182255 | 526518 | 10372 | N/A | | 50 | KCNH1 | 143473 | 639952 | 10448 | 492697 | 30274 |
| KCNAB1 | 169282 | 478609 | 10373 | N/A | | | KCNH1 | 143473 | 640528 | 10449 | 491725 | 30275 |
| KCNAB1 | 169282 | 477912 | 10374 | N/A | | | KCNH1 | 143473 | 638960 | 10450 | 492302 | 30276 |
| KCNAB1 | 169282 | 472028 | 10375 | 420755 | 30219 | | KCNH1 | 143473 | 640625 | 10451 | 492609 | 30277 |
| KCNAB1 | 169282 | 490337 | 10376 | 419952 | 30220 | | KCNH1 | 143473 | 638357 | 10452 | 492865 | 30278 |
| KCNAB1 | 169282 | 389636 | 10377 | 374287 | 30221 | | KCNH1 | 143473 | 640243 | 10453 | 492803 | 30279 |
| KCNAB1 | 169282 | 471742 | 10378 | 418956 | 30222 | 55 | KCNH1 | 143473 | 640044 | 10454 | 491434 | 30280 |
| KCNAB1 | 169282 | 475456 | 10379 | 420221 | 30223 | | KCNH1 | 143473 | 640566 | 10455 | 491302 | 30281 |
| KCNAB1 | 169282 | 302490 | 10380 | 305858 | 30224 | | KCNH1 | 143473 | 640522 | 10456 | 491019 | 30282 |
| KCNAB1 | 169282 | 389634 | 10381 | 374285 | 30225 | | KCNH1 | 143473 | 639754 | 10457 | N/A | |
| KCNAB1 | 169282 | 489036 | 10382 | 418048 | 30226 | | KCNH1 | 143473 | 640890 | 10458 | N/A | |
| KCNAB1 | 169282 | 476362 | 10383 | N/A | | | KCNH1 | 143473 | 639385 | 10459 | N/A | |
| KCNAB1 | 169282 | 461717 | 10384 | N/A | | 60 | KCNH1 | 143473 | 624583 | 10460 | N/A | |
| KCNAB1 | 169282 | 497291 | 10385 | N/A | | | KCNH1 | 283965 | 639262 | 10461 | 491565 | 30283 |
| KCNAB1 | 169282 | 496923 | 10386 | N/A | | | KCNH1 | 283965 | 639694 | 10462 | 492724 | 30284 |
| KCNAB1 | 169282 | 618897 | 10387 | 484368 | 30227 | | KCNH1 | 283965 | 639420 | 10463 | 492350 | 30285 |
| KCNAB2 | 069424 | 378111 | 10388 | 367351 | 30228 | | KCNH1 | 283965 | 638907 | 10464 | 492550 | 30286 |
| KCNAB2 | 069424 | 378097 | 10389 | 367337 | 30229 | | KCNH1 | 283965 | 638293 | 10465 | 491986 | 30287 |
| KCNAB2 | 069424 | 493807 | 10390 | N/A | | 65 | KCNH1 | 283965 | 640402 | 10466 | 491804 | 30288 |
| KCNAB2 | 069424 | 378092 | 10391 | 367332 | 30230 | | KCNH1 | 283965 | 639355 | 10467 | 491578 | 30289 |

-continued

-continued

| Symbol | ENSG | ENST | SEQ ID | ENSP | SEQ ID |
|---|---|---|---|---|---|
| KCNH1 | 283965 | 638734 | 10468 | 492255 | 30290 |
| KCNH1 | 283965 | 639736 | 10469 | 491426 | 30291 |
| KCNH1 | 283965 | 640738 | 10470 | 491522 | 30292 |
| KCNH1 | 283965 | 640013 | 10471 | 492387 | 30293 |
| KCNH1 | 283965 | 639281 | 10472 | 492092 | 30294 |
| KCNH1 | 283965 | 640966 | 10473 | 491901 | 30295 |
| KCNH1 | 283965 | 639471 | 10474 | N/A | |
| KCNH1 | 283965 | 639652 | 10475 | N/A | |
| KCNH1 | 283965 | 640802 | 10476 | N/A | |
| KCNH1 | 283965 | 635558 | 10477 | N/A | |
| KCNH5 | 140015 | 322893 | 10478 | 321427 | 30296 |
| KCNH5 | 140015 | 420622 | 10479 | 395439 | 30297 |
| KCNH5 | 140015 | 394968 | 10480 | 378419 | 30298 |
| KCNH5 | 140015 | 394964 | 10481 | N/A | |
| KCNH7 | 184611 | 332142 | 10482 | 331727 | 30299 |
| KCNH7 | 184611 | 328032 | 10483 | 333781 | 30300 |
| KCNH7 | 184611 | 477019 | 10484 | N/A | |
| KCNH7 | 184611 | 621889 | 10485 | 483158 | 30301 |
| KCNH7 | 184611 | 618399 | 10486 | 482818 | 30302 |
| KCNH8 | 183960 | 328405 | 10487 | 328813 | 30303 |
| KCNH8 | 183960 | 452398 | 10488 | 412141 | 30304 |
| KCNH8 | 183960 | 475063 | 10489 | N/A | |
| KCNIP1 | 182132 | 518527 | 10490 | N/A | |
| KCNIP1 | 182132 | 377360 | 10491 | 366577 | 30305 |
| KCNIP1 | 182132 | 517344 | 10492 | 431053 | 30306 |
| KCNIP1 | 182132 | 328939 | 10493 | 329686 | 30307 |
| KCNIP1 | 182132 | 520740 | 10494 | 431102 | 30308 |
| KCNIP1 | 182132 | 434108 | 10495 | 414886 | 30309 |
| KCNIP1 | 182132 | 411494 | 10496 | 395323 | 30310 |
| KCNIP1 | 182132 | 636734 | 10497 | 489903 | 30311 |
| KCNIP1 | 182132 | 390656 | 10498 | 375071 | 30312 |
| KCNIP1 | 182132 | 616807 | 10499 | 478151 | 30313 |
| KCNIP2 | 120049 | 348850 | 10500 | 239118 | 30314 |
| KCNIP2 | 120049 | 355657 | 10501 | N/A | |
| KCNIP2 | 120049 | 356640 | 10502 | 349055 | 30315 |
| KCNIP2 | 120049 | 460388 | 10503 | N/A | |
| KCNIP2 | 120049 | 370046 | 10504 | 359063 | 30316 |
| KCNIP2 | 120049 | 472764 | 10505 | N/A | |
| KCNIP2 | 120049 | 434163 | 10506 | 411679 | 30317 |
| KCNIP2 | 120049 | 353068 | 10507 | 341624 | 30318 |
| KCNIP2 | 120049 | 461105 | 10508 | 420040 | 30319 |
| KCNIP2 | 120049 | 343195 | 10509 | 344169 | 30320 |
| KCNIP2 | 120049 | 239117 | 10510 | 239117 | 30321 |
| KCNIP2 | 120049 | 483385 | 10511 | N/A | |
| KCNIP2 | 120049 | 358038 | 10512 | 350733 | 30322 |
| KCNIP4 | 185774 | 382148 | 10513 | 371583 | 30323 |
| KCNIP4 | 185774 | 447367 | 10514 | 399080 | 30324 |
| KCNIP4 | 185774 | 382150 | 10515 | 371585 | 30325 |
| KCNIP4 | 185774 | 382152 | 10516 | 371587 | 30326 |
| KCNIP4 | 185774 | 509207 | 10517 | 423257 | 30327 |
| KCNIP4 | 185774 | 382149 | 10518 | N/A | |
| KCNIP4 | 185774 | 515786 | 10519 | 445321 | 30328 |
| KCNIP4 | 185774 | 515373 | 10520 | N/A | |
| KCNIP4 | 185774 | 512102 | 10521 | N/A | |
| KCNIP4 | 185774 | 359001 | 10522 | 351892 | 30329 |
| KCNIP4 | 281758 | 629874 | 10523 | N/A | |
| KCNIP4 | 281758 | 629040 | 10524 | 486886 | 30330 |
| KCNIP4 | 281758 | 630138 | 10525 | N/A | |
| KCNJ10 | 177807 | 639408 | 10526 | 491635 | 30331 |
| KCNJ10 | 177807 | 637644 | 10527 | 490282 | 30332 |
| KCNJ10 | 177807 | 640914 | 10528 | 491175 | 30333 |
| KCNJ10 | 177807 | 509700 | 10529 | 491416 | 30334 |
| KCNJ10 | 177807 | 368089 | 10530 | 357068 | 30335 |
| KCNJ10 | 177807 | 636689 | 10531 | N/A | |
| KCNJ10 | 177807 | 638840 | 10532 | 492249 | 30336 |
| KCNJ10 | 177807 | 640017 | 10533 | 491337 | 30337 |
| KCNJ10 | 177807 | 638728 | 10534 | 492619 | 30338 |
| KCNJ10 | 177807 | 638868 | 10535 | 491250 | 30339 |
| KCNJ12 | 184185 | 583088 | 10536 | 463778 | 30340 |
| KCNJ12 | 184185 | 331718 | 10537 | 328150 | 30341 |
| KCNJ16 | 153822 | 591891 | 10538 | 465646 | 30342 |
| KCNJ16 | 153822 | 588112 | 10539 | N/A | |
| KCNJ16 | 153822 | 589377 | 10540 | 465967 | 30343 |
| KCNJ16 | 153822 | 586462 | 10541 | 467568 | 30344 |
| KCNJ16 | 153822 | 585558 | 10542 | 465295 | 30345 |
| KCNJ16 | 153822 | 587698 | 10543 | 466132 | 30346 |

| Symbol | ENSG | ENST | SEQ ID | ENSP | SEQ ID |
|---|---|---|---|---|---|
| KCNJ16 | 153822 | 587892 | 10544 | 465163 | 30347 |
| KCNJ16 | 153822 | 283936 | 10545 | 283936 | 30348 |
| KCNJ16 | 153822 | 392670 | 10546 | 376438 | 30349 |
| KCNJ16 | 153822 | 392671 | 10547 | 376439 | 30350 |
| KCNJ16 | 153822 | 615244 | 10548 | 479817 | 30351 |
| KCNJ3 | 162989 | 295101 | 10549 | 295101 | 30352 |
| KCNJ3 | 162989 | 493505 | 10550 | N/A | |
| KCNJ3 | 162989 | 544049 | 10551 | 438410 | 30353 |
| KCNJ4 | 168135 | 303592 | 10552 | 306497 | 30354 |
| KCNJ6 | 157542 | 609713 | 10553 | 477437 | 30355 |
| KCNK1 | 135750 | 366621 | 10554 | 355580 | 30356 |
| KCNK1 | 135750 | 472190 | 10555 | N/A | |
| KCNK1 | 135750 | 366620 | 10556 | N/A | |
| KCNK1 | 135750 | 487728 | 10557 | N/A | |
| KCNK1 | 135750 | 446915 | 10558 | 409626 | 30357 |
| KCNK1 | 135750 | 472869 | 10559 | N/A | |
| KCNK10 | 100433 | 340700 | 10560 | 343104 | 30358 |
| KCNK10 | 100433 | 312350 | 10561 | 310568 | 30359 |
| KCNK10 | 100433 | 319231 | 10562 | 312811 | 30360 |
| KCNK10 | 100433 | 556282 | 10563 | 452587 | 30361 |
| KCNK12 | 184261 | 327876 | 10564 | 327611 | 30362 |
| KCNK12 | 184261 | 493527 | 10565 | N/A | |
| KCNK13 | 152315 | 282146 | 10566 | 282146 | 30363 |
| KCNK3 | 171303 | 302909 | 10567 | 306275 | 30364 |
| KCNK3 | 171303 | 620977 | 10568 | 483136 | 30365 |
| KCNMA1 | 156113 | 604624 | 10569 | 473714 | 30366 |
| KCNMA1 | 156113 | 639601 | 10570 | 492806 | 30367 |
| KCNMA1 | 156113 | 638991 | 10571 | 490978 | 30368 |
| KCNMA1 | 156113 | 639913 | 10572 | 492241 | 30369 |
| KCNMA1 | 156113 | 639205 | 10573 | 492718 | 30370 |
| KCNMA1 | 156113 | 639486 | 10574 | 492005 | 30371 |
| KCNMA1 | 156113 | 639498 | 10575 | 492835 | 30372 |
| KCNMA1 | 156113 | 640523 | 10576 | 491795 | 30373 |
| KCNMA1 | 156113 | 372443 | 10577 | 361520 | 30374 |
| KCNMA1 | 156113 | 638223 | 10578 | 492492 | 30375 |
| KCNMA1 | 156113 | 639344 | 10579 | 492559 | 30376 |
| KCNMA1 | 156113 | 638848 | 10580 | 492414 | 30377 |
| KCNMA1 | 156113 | 639090 | 10581 | 491673 | 30378 |
| KCNMA1 | 156113 | 639489 | 10582 | 491927 | 30379 |
| KCNMA1 | 156113 | 639069 | 10583 | N/A | |
| KCNMA1 | 156113 | 639657 | 10584 | N/A | |
| KCNMA1 | 156113 | 372408 | 10585 | 361485 | 30380 |
| KCNMA1 | 156113 | 639995 | 10586 | 491902 | 30381 |
| KCNMA1 | 156113 | 639483 | 10587 | 492406 | 30382 |
| KCNMA1 | 156113 | 639691 | 10588 | 491040 | 30383 |
| KCNMA1 | 156113 | 638512 | 10589 | N/A | |
| KCNMA1 | 156113 | 372421 | 10590 | 361498 | 30384 |
| KCNMA1 | 156113 | 640570 | 10591 | N/A | |
| KCNMA1 | 156113 | 372437 | 10592 | 361514 | 30385 |
| KCNMA1 | 156113 | 638895 | 10593 | 491207 | 30386 |
| KCNMA1 | 156113 | 457953 | 10594 | 396608 | 30387 |
| KCNMA1 | 156113 | 404771 | 10595 | 385717 | 30388 |
| KCNMA1 | 156113 | 638351 | 10596 | 491156 | 30389 |
| KCNMA1 | 156113 | 372440 | 10597 | 361517 | 30390 |
| KCNMA1 | 156113 | 638306 | 10598 | 491008 | 30391 |
| KCNMA1 | 156113 | 640182 | 10599 | 492510 | 30392 |
| KCNMA1 | 156113 | 638606 | 10600 | 491981 | 30393 |
| KCNMA1 | 156113 | 639591 | 10601 | 492793 | 30394 |
| KCNMA1 | 156113 | 640605 | 10602 | 491435 | 30395 |
| KCNMA1 | 156113 | 638252 | 10603 | 491123 | 30396 |
| KCNMA1 | 156113 | 639968 | 10604 | 491723 | 30397 |
| KCNMA1 | 156113 | 372403 | 10605 | 361480 | 30398 |
| KCNMA1 | 156113 | 640626 | 10606 | 491545 | 30399 |
| KCNMA1 | 156113 | 639851 | 10607 | N/A | |
| KCNMA1 | 156113 | 468471 | 10608 | N/A | |
| KCNMA1 | 156113 | 640934 | 10609 | 491539 | 30400 |
| KCNMA1 | 156113 | 640029 | 10610 | 491463 | 30401 |
| KCNMA1 | 156113 | 404857 | 10611 | 385806 | 30402 |
| KCNMA1 | 156113 | 640093 | 10612 | 492224 | 30403 |
| KCNMA1 | 156113 | 638252 | 10613 | 492178 | 30404 |
| KCNMA1 | 156113 | 639544 | 10614 | 492075 | 30405 |
| KCNMA1 | 156113 | 640807 | 10615 | 491555 | 30406 |
| KCNMA1 | 156113 | 434208 | 10616 | 402150 | 30407 |
| KCNMA1 | 156113 | 286627 | 10617 | 286627 | 30408 |
| KCNMA1 | 156113 | 286628 | 10618 | 286628 | 30409 |
| KCNMA1 | 156113 | 638283 | 10619 | 491300 | 30410 |

-continued

-continued

| Symbol | ENSG | ENST | SEQ ID | ENSP | SEQ ID |
|---|---|---|---|---|---|
| KCNMA1 | 156113 | 639730 | 10620 | 492519 | 30411 |
| KCNMA1 | 156113 | 639370 | 10621 | 491277 | 30412 |
| KCNMA1 | 156113 | 639716 | 10622 | 491131 | 30413 |
| KCNMA1 | 156113 | 640141 | 10623 | 491418 | 30414 |
| KCNMA1 | 156113 | 638754 | 10624 | 491166 | 30415 |
| KCNMA1 | 156113 | 638632 | 10625 | N/A | |
| KCNMA1 | 156113 | 640969 | 10626 | 492200 | 30416 |
| KCNMA1 | 156113 | 638751 | 10627 | 492172 | 30417 |
| KCNMA1 | 156113 | 639406 | 10628 | 491732 | 30418 |
| KCNMA1 | 156113 | 639823 | 10629 | 490982 | 30419 |
| KCNMA1 | 156113 | 640834 | 10630 | 491920 | 30420 |
| KCNMA1 | 156113 | 626620 | 10631 | 485867 | 30421 |
| KCNMA1 | 156113 | 638759 | 10632 | 492632 | 30422 |
| KCNMA1 | 156113 | 638575 | 10633 | 492049 | 30423 |
| KCNMA1 | 156113 | 638999 | 10634 | N/A | |
| KCNMA1 | 156113 | 638514 | 10635 | 491840 | 30424 |
| KCNMA1 | 156113 | 640353 | 10636 | 492153 | 30425 |
| KCNMA1 | 156113 | 640773 | 10637 | 491173 | 30426 |
| KCNMA1 | 156113 | 639321 | 10638 | N/A | |
| KCNMA1 | 156113 | 638370 | 10639 | N/A | |
| KCNMA1 | 156113 | 638361 | 10640 | N/A | |
| KCNMA1 | 156113 | 484507 | 10641 | N/A | |
| KCNMA1 | 156113 | 637862 | 10642 | 490881 | 30427 |
| KCNMA1 | 156113 | 475352 | 10643 | 491045 | 30428 |
| KCNMA1 | 156113 | 450795 | 10644 | 388370 | 30429 |
| KCNMA1 | 156113 | 638249 | 10645 | 492837 | 30430 |
| KCNMA1 | 156113 | 640386 | 10646 | 491313 | 30431 |
| KCNMA1 | 156113 | 640632 | 10647 | 492854 | 30432 |
| KCNMA1 | 156113 | 428546 | 10648 | N/A | |
| KCNMA1 | 156113 | 638506 | 10649 | 492740 | 30433 |
| KCNMA1 | 156113 | 639120 | 10650 | 492236 | 30434 |
| KCNMA1 | 156113 | 484343 | 10651 | 492283 | 30435 |
| KCNMA1 | 156113 | 638531 | 10652 | 491374 | 30436 |
| KCNMA1 | 156113 | 640311 | 10653 | N/A | |
| KCNMA1 | 156113 | 640824 | 10654 | N/A | |
| KCNMA1 | 156113 | 639282 | 10655 | N/A | |
| KCNMA1 | 156113 | 639204 | 10656 | N/A | |
| KCNMA1 | 156113 | 480683 | 10657 | 474686 | 30437 |
| KCNMA1 | 156113 | 618048 | 10658 | 482747 | 30438 |
| KCNMA1 | 156113 | 481070 | 10659 | 475086 | 30439 |
| KCNMA1 | 156113 | 406533 | 10660 | 385552 | 30440 |
| KCNMA1 | 156113 | 354353 | 10661 | 346321 | 30441 |
| KCNN3 | 143603 | 271915 | 10662 | 271915 | 30442 |
| KCNN3 | 143603 | 515643 | 10663 | N/A | |
| KCNN3 | 143603 | 361147 | 10664 | 354764 | 30443 |
| KCNN3 | 143603 | 358505 | 10665 | 351295 | 30444 |
| KCNN3 | 143603 | 618040 | 10666 | 481848 | 30445 |
| KCNQ3 | 184156 | 388996 | 10667 | 373648 | 30446 |
| KCNQ3 | 184156 | 639496 | 10668 | 491165 | 30447 |
| KCNQ3 | 184156 | 521134 | 10669 | 429799 | 30448 |
| KCNQ3 | 184156 | 519445 | 10670 | 428790 | 30449 |
| KCNQ3 | 184156 | 519589 | 10671 | N/A | |
| KCNQ3 | 184156 | 638588 | 10672 | 491940 | 30450 |
| KCNQ3 | 184156 | 639358 | 10673 | 492691 | 30451 |
| KCNQ3 | 184156 | 621976 | 10674 | 482510 | 30452 |
| KCNQ5 | 185760 | 342056 | 10675 | 345055 | 30453 |
| KCNQ5 | 185760 | 628967 | 10676 | 486187 | 30454 |
| KCNQ5 | 185760 | 370398 | 10677 | 359425 | 30455 |
| KCNQ5 | 185760 | 370392 | 10678 | 359419 | 30456 |
| KCNQ5 | 185760 | 629977 | 10679 | 485743 | 30457 |
| KCNQ5 | 185760 | 443915 | 10680 | 414829 | 30458 |
| KCNQ5 | 185760 | 441538 | 10681 | 391971 | 30459 |
| KCNQ5 | 185760 | 427928 | 10682 | 388098 | 30460 |
| KCNQ5 | 185760 | 403813 | 10683 | 384453 | 30461 |
| KCNQ5 | 185760 | 414165 | 10684 | 409861 | 30462 |
| KCNQ5 | 185760 | 355194 | 10685 | 347326 | 30463 |
| KCNQ5 | 185760 | 402622 | 10686 | 385501 | 30464 |
| KCNQ5 | 185760 | 355635 | 10687 | 347853 | 30465 |
| KCNT2 | 162687 | 367433 | 10688 | 356403 | 30466 |
| KCNT2 | 162687 | 498426 | 10689 | N/A | |
| KCNT2 | 162687 | 609185 | 10690 | 476657 | 30467 |
| KCNT2 | 162687 | 294725 | 10691 | 294725 | 30468 |
| KCNT2 | 162687 | 610076 | 10692 | N/A | |
| KCNT2 | 162687 | 466914 | 10693 | 477456 | 30469 |
| KCNT2 | 162687 | 451324 | 10694 | 405474 | 30470 |
| KCNV1 | 164794 | 524391 | 10695 | 435954 | 30471 |

| Symbol | ENSG | ENST | SEQ ID | ENSP | SEQ ID |
|---|---|---|---|---|---|
| KCNV1 | 164794 | 297404 | 10696 | 297404 | 30472 |
| KCTD13 | 174943 | 308768 | 10697 | 311202 | 30473 |
| KCTD13 | 174943 | 568000 | 10698 | 455785 | 30474 |
| KCTD13 | 174943 | 566842 | 10699 | 459104 | 30475 |
| KCTD13 | 174943 | 568995 | 10700 | 454282 | 30476 |
| KCTD13 | 174943 | 563955 | 10701 | N/A | |
| KCTD13 | 174943 | 563264 | 10702 | N/A | |
| KCTD13 | 174943 | 566413 | 10703 | 460526 | 30477 |
| KCTD13 | 174943 | 561540 | 10704 | 458486 | 30478 |
| KCTD13 | 174943 | 568721 | 10705 | N/A | |
| KCTD21-AS1 | 246174 | 532831 | 10706 | N/A | |
| KCTD21-AS1 | 246174 | 523626 | 10707 | N/A | |
| KCTD21-AS1 | 246174 | 530261 | 10708 | N/A | |
| KCTD21-AS1 | 246174 | 500113 | 10709 | N/A | |
| KCTD21-AS1 | 246174 | 527321 | 10710 | N/A | |
| KCTD21-AS1 | 246174 | 528468 | 10711 | N/A | |
| KCTD21-AS1 | 246174 | 600795 | 10712 | N/A | |
| KCTD3 | 136636 | 259154 | 10713 | 259154 | 30479 |
| KCTD3 | 136636 | 448333 | 10714 | 396726 | 30480 |
| KCTD3 | 136636 | 452413 | 10715 | 399962 | 30481 |
| KCTD3 | 136636 | 495537 | 10716 | N/A | |
| KCTD3 | 136636 | 465650 | 10717 | N/A | |
| KDELR3 | 100196 | 216014 | 10718 | 216014 | 30482 |
| KDELR3 | 100196 | 409006 | 10719 | 386918 | 30483 |
| KDELR3 | 100196 | 471268 | 10720 | N/A | |
| KDM5C | 126012 | 375401 | 10721 | 364550 | 30484 |
| KDM5C | 126012 | 404049 | 10722 | 385394 | 30485 |
| KDM5C | 126012 | 375379 | 10723 | 364528 | 30486 |
| KDM5C | 126012 | 375383 | 10724 | 364532 | 30487 |
| KDM5C | 126012 | 477109 | 10725 | N/A | |
| KDM5C | 126012 | 497100 | 10726 | N/A | |
| KDM5C | 126012 | 465402 | 10727 | N/A | |
| KDM5C | 126012 | 481369 | 10728 | N/A | |
| KDM5C | 126012 | 497995 | 10729 | N/A | |
| KDM5C | 126012 | 429877 | 10730 | 409757 | 30488 |
| KDM5C | 126012 | 495519 | 10731 | N/A | |
| KDM5C | 126012 | 467093 | 10732 | N/A | |
| KDM5C | 126012 | 428012 | 10733 | 407277 | 30489 |
| KDM5C | 126012 | 349663 | 10734 | 344004 | 30490 |
| KDM5C | 126012 | 452825 | 10735 | 445176 | 30491 |
| KDM5D | 012817 | 469599 | 10736 | N/A | |
| KDM5D | 012817 | 317961 | 10737 | 322408 | 30492 |
| KDM5D | 012817 | 382806 | 10738 | 372256 | 30493 |
| KDM5D | 012817 | 492117 | 10739 | N/A | |
| KDM5D | 012817 | 440077 | 10740 | 398543 | 30494 |
| KDM5D | 012817 | 415360 | 10741 | 389433 | 30495 |
| KDM5D | 012817 | 485154 | 10742 | N/A | |
| KDM5D | 012817 | 478891 | 10743 | N/A | |
| KDM5D | 012817 | 447300 | 10744 | 416377 | 30496 |
| KDM5D | 012817 | 541639 | 10745 | 444293 | 30497 |
| KEL | 197993 | 355265 | 10746 | 347409 | 30498 |
| KEL | 197993 | 470850 | 10747 | N/A | |
| KEL | 197993 | 478969 | 10748 | N/A | |
| KEL | 197993 | 465697 | 10749 | N/A | |
| KEL | 197993 | 479768 | 10750 | N/A | |
| KEL | 197993 | 494148 | 10751 | N/A | |
| KEL | 197993 | 476829 | 10752 | 419889 | 30499 |
| KEL | 197993 | 467543 | 10753 | 420011 | 30500 |
| KEL | 197993 | 460479 | 10754 | 418886 | 30501 |
| KEL | 276615 | 615381 | 10755 | 477793 | 30502 |
| KEL | 276615 | 633816 | 10756 | N/A | |
| KEL | 276615 | 633860 | 10757 | N/A | |
| KEL | 276615 | 633614 | 10758 | N/A | |
| KEL | 276615 | 633778 | 10759 | N/A | |
| KEL | 276615 | 634110 | 10760 | N/A | |
| KEL | 276615 | 633704 | 10761 | 488896 | 30503 |
| KEL | 276615 | 632261 | 10762 | 488564 | 30504 |
| KEL | 276615 | 631527 | 10763 | 488333 | 30505 |
| KHDRBS3 | 131773 | 522578 | 10764 | N/A | |
| KHDRBS3 | 131773 | 521461 | 10765 | 428643 | 30506 |
| KHDRBS3 | 131773 | 518728 | 10766 | N/A | |
| KHDRBS3 | 131773 | 522433 | 10767 | N/A | |
| KHDRBS3 | 131773 | 522079 | 10768 | N/A | |
| KHDRBS3 | 131773 | 524282 | 10769 | 427841 | 30507 |
| KHDRBS3 | 131773 | 517859 | 10770 | 427851 | 30508 |
| KHDRBS3 | 131773 | 519600 | 10771 | N/A | |

-continued

-continued

| Symbol | ENSG | ENST | SEQ ID | ENSP | SEQ ID |
|---|---|---|---|---|---|
| KHDRBS3 | 131773 | 517394 | 10772 | 430284 | 30509 |
| KHDRBS3 | 131773 | 520981 | 10773 | 428607 | 30510 |
| KHDRBS3 | 131773 | 524199 | 10774 | 431022 | 30511 |
| KHDRBS3 | 131773 | 355849 | 10775 | 348108 | 30512 |
| KIAA0895 | 164542 | 297063 | 10776 | 297063 | 30513 |
| KIAA0895 | 164542 | 338533 | 10777 | 344805 | 30514 |
| KIAA0895 | 164542 | 317020 | 10778 | 319251 | 30515 |
| KIAA0895 | 164542 | 440378 | 10779 | 390837 | 30516 |
| KIAA0895 | 164542 | 436884 | 10780 | 389985 | 30517 |
| KIAA0895 | 164542 | 453212 | 10781 | 390183 | 30518 |
| KIAA0895 | 164542 | 483360 | 10782 | N/A | |
| KIAA0895 | 164542 | 480192 | 10783 | N/A | |
| KIAA0895 | 164542 | 483526 | 10784 | N/A | |
| KIAA0895 | 164542 | 431396 | 10785 | 399935 | 30519 |
| KIAA0895 | 164542 | 415803 | 10786 | 400749 | 30520 |
| KIAA0895 | 164542 | 493327 | 10787 | N/A | |
| KIAA0895 | 164542 | 429651 | 10788 | 390527 | 30521 |
| KIAA0895L | 196123 | 562514 | 10789 | N/A | |
| KIAA0895L | 196123 | 561679 | 10790 | N/A | |
| KIAA0895L | 196123 | 568563 | 10791 | 459322 | 30522 |
| KIAA0895L | 196123 | 561621 | 10792 | 457099 | 30523 |
| KIAA0895L | 196123 | 290881 | 10793 | 290881 | 30524 |
| KIAA0895L | 196123 | 563918 | 10794 | N/A | |
| KIAA0895L | 196123 | 563902 | 10795 | 456838 | 30525 |
| KIAA0895L | 196123 | 563831 | 10796 | N/A | |
| KIAA0895L | 196123 | 570009 | 10797 | N/A | |
| KIAA0895L | 196123 | 564835 | 10798 | N/A | |
| KIAA0895L | 196123 | 564423 | 10799 | N/A | |
| KIAA0895L | 196123 | 568165 | 10800 | N/A | |
| KIAA1456 | 250305 | 447063 | 10801 | 443288 | 30526 |
| KIAA1456 | 250305 | 525249 | 10802 | N/A | |
| KIAA1456 | 250305 | 524591 | 10803 | 432695 | 30527 |
| KIAA1456 | 250305 | 528335 | 10804 | N/A | |
| KIAA1456 | 250305 | 400069 | 10805 | 468715 | 30528 |
| KIAA1456 | 250305 | 528753 | 10806 | 466330 | 30529 |
| KIAA1456 | 250305 | 532376 | 10807 | 431717 | 30530 |
| KIAA1456 | 250305 | 529706 | 10808 | N/A | |
| KIAA1456 | 250305 | 529978 | 10809 | N/A | |
| KIAA1644 | 138944 | 381176 | 10810 | 370568 | 30531 |
| KIAA1644 | 138944 | 381176 | 10811 | 370568 | 30532 |
| KIF13A | 137177 | 378814 | 10812 | 368091 | 30533 |
| KIF13A | 137177 | 502297 | 10813 | 425616 | 30534 |
| KIF13A | 137177 | 259711 | 10814 | 259711 | 30535 |
| KIF13A | 137177 | 378843 | 10815 | 368120 | 30536 |
| KIF13A | 137177 | 378826 | 10816 | 368103 | 30537 |
| KIF13A | 137177 | 636847 | 10817 | 490031 | 30538 |
| KIF13A | 137177 | 358380 | 10818 | 351150 | 30539 |
| KIF13A | 137177 | 506044 | 10819 | 422808 | 30540 |
| KIF13A | 137177 | 514714 | 10820 | N/A | |
| KIF13A | 137177 | 503342 | 10821 | N/A | |
| KIF13A | 137177 | 507576 | 10822 | N/A | |
| KIF13A | 137177 | 505588 | 10823 | N/A | |
| KIF13A | 137177 | 502704 | 10824 | 425453 | 30541 |
| KIF13B | 197892 | 524189 | 10825 | 427900 | 30542 |
| KIF13B | 197892 | 523130 | 10826 | 429106 | 30543 |
| KIF13B | 197892 | 522355 | 10827 | 429027 | 30544 |
| KIF13B | 197892 | 521515 | 10828 | 429201 | 30545 |
| KIF13B | 197892 | 523968 | 10829 | 431006 | 30546 |
| KIF13B | 197892 | 522846 | 10830 | N/A | |
| KIF19 | 196169 | 551294 | 10831 | 449134 | 30547 |
| KIF19 | 196169 | 389916 | 10832 | 374566 | 30548 |
| KIF19 | 196169 | 551017 | 10833 | N/A | |
| KIF19 | 196169 | 359939 | 10834 | N/A | |
| KIF19 | 196169 | 547389 | 10835 | N/A | |
| KIF19 | 196169 | 549637 | 10836 | N/A | |
| KIF19 | 196169 | 551294 | 10837 | 449134 | 30549 |
| KIF19 | 196169 | 389916 | 10838 | 374566 | 30550 |
| KIF19 | 196169 | 551017 | 10839 | N/A | |
| KIF19 | 196169 | 359939 | 10840 | N/A | |
| KIF19 | 196169 | 547389 | 10841 | N/A | |
| KIF19 | 196169 | 549637 | 10842 | N/A | |
| KIF21B | 116852 | 332129 | 10843 | 328494 | 30551 |
| KIF21B | 116852 | 461742 | 10844 | 433808 | 30552 |
| KIF21B | 116852 | 360529 | 10845 | 353724 | 30553 |
| KIF21B | 116852 | 422435 | 10846 | 411831 | 30554 |
| KIF21B | 116852 | 534043 | 10847 | N/A | |

| Symbol | ENSG | ENST | SEQ ID | ENSP | SEQ ID |
|---|---|---|---|---|---|
| KIF26B | 162849 | 407071 | 10848 | 385545 | 30555 |
| KIF26B | 162849 | 479506 | 10849 | N/A | |
| KIF26B | 162849 | 366518 | 10850 | 355475 | 30556 |
| KIF26B | 162849 | 483253 | 10851 | N/A | |
| KIF26B | 281216 | 615502 | 10852 | N/A | |
| KIF26B | 281216 | 629409 | 10853 | 486478 | 30557 |
| KIF26B | 281216 | 626550 | 10854 | N/A | |
| KIF3B | 101350 | 375712 | 10855 | 364864 | 30558 |
| KIF6 | 164627 | 458470 | 10856 | 409417 | 30559 |
| KIF6 | 164627 | 287152 | 10857 | 287152 | 30560 |
| KIF6 | 164627 | 394362 | 10858 | 377889 | 30561 |
| KIF6 | 164627 | 229913 | 10859 | 229913 | 30562 |
| KIF6 | 164627 | 441975 | 10860 | 404856 | 30563 |
| KIF6 | 164627 | 482238 | 10861 | N/A | |
| KIF6 | 164627 | 465719 | 10862 | N/A | |
| KIF6 | 164627 | 538893 | 10863 | 441435 | 30564 |
| KIRREL1 | 183853 | 360089 | 10864 | 353202 | 30565 |
| KIRREL1 | 183853 | 359209 | 10865 | 352138 | 30566 |
| KIRREL1 | 183853 | 368172 | 10866 | 357154 | 30567 |
| KIRREL1 | 183853 | 368173 | 10867 | 357155 | 30568 |
| KIT | 157404 | 412167 | 10868 | 390987 | 30569 |
| KIT | 157404 | 288135 | 10869 | 288135 | 30570 |
| KIT | 157404 | 514582 | 10870 | N/A | |
| KIT | 157404 | 512959 | 10871 | N/A | |
| KITLG | 049130 | 378535 | 10872 | N/A | |
| KITLG | 049130 | 228280 | 10873 | 228280 | 30571 |
| KITLG | 049130 | 347404 | 10874 | 054216 | 30572 |
| KITLG | 049130 | 357116 | 10875 | 474021 | 30573 |
| KITLG | 049130 | 552044 | 10876 | 475042 | 30574 |
| KITLG | 049130 | 378535 | 10877 | N/A | |
| KITLG | 049130 | 228280 | 10878 | 228280 | 30575 |
| KITLG | 049130 | 347404 | 10879 | 054216 | 30576 |
| KITLG | 049130 | 357116 | 10880 | 474021 | 30577 |
| KITLG | 049130 | 552044 | 10881 | 475042 | 30578 |
| KLHDC4 | 104731 | 568444 | 10882 | N/A | |
| KLHDC4 | 104731 | 567298 | 10883 | 457570 | 30579 |
| KLHDC4 | 104731 | 568346 | 10884 | N/A | |
| KLHDC4 | 104731 | 568499 | 10885 | N/A | |
| KLHDC4 | 104731 | 316853 | 10886 | N/A | |
| KLHDC4 | 104731 | 353170 | 10887 | 262530 | 30580 |
| KLHDC4 | 104731 | 347925 | 10888 | 325717 | 30581 |
| KLHDC4 | 104731 | 566349 | 10889 | N/A | |
| KLHDC4 | 104731 | 270583 | 10890 | 270583 | 30582 |
| KLHDC4 | 104731 | 569487 | 10891 | N/A | |
| KLHDC4 | 104731 | 562155 | 10892 | 455824 | 30583 |
| KLHDC4 | 104731 | 562261 | 10893 | 455780 | 30584 |
| KLHDC4 | 104731 | 566661 | 10894 | N/A | |
| KLHDC4 | 104731 | 562913 | 10895 | N/A | |
| KLHDC4 | 104731 | 567513 | 10896 | N/A | |
| KLHDC4 | 104731 | 562872 | 10897 | N/A | |
| KLHDC4 | 104731 | 564484 | 10898 | N/A | |
| KLHDC4 | 104731 | 565328 | 10899 | N/A | |
| KLHDC4 | 104731 | 569747 | 10900 | 455666 | 30585 |
| KLHDC4 | 104731 | 564396 | 10901 | 455214 | 30586 |
| KLHDC4 | 104731 | 568502 | 10902 | N/A | |
| KLHDC4 | 104731 | 561825 | 10903 | 457990 | 30587 |
| KLHDC4 | 104731 | 568338 | 10904 | 457098 | 30588 |
| KLHDC4 | 104731 | 563845 | 10905 | 454681 | 30589 |
| KLHDC4 | 104731 | 566561 | 10906 | 457857 | 30590 |
| KLHDC4 | 104731 | 622456 | 10907 | 482433 | 30591 |
| KLHDC4 | 104731 | 446344 | 10908 | 392909 | 30592 |
| KLHL13 | 003096 | 371882 | 10909 | 360949 | 30593 |
| KLHL13 | 003096 | 371876 | 10910 | 360943 | 30594 |
| KLHL13 | 003096 | 371878 | 10911 | 360945 | 30595 |
| KLHL13 | 003096 | 262820 | 10912 | 262820 | 30596 |
| KLHL13 | 003096 | 469946 | 10913 | 419803 | 30597 |
| KLHL13 | 003096 | 453826 | 10914 | 393807 | 30598 |
| KLHL13 | 003096 | 545703 | 10915 | 440707 | 30599 |
| KLHL13 | 003096 | 540167 | 10916 | 441029 | 30600 |
| KLHL13 | 003096 | 541812 | 10917 | 444450 | 30601 |
| KLHL15 | 174010 | 328016 | 10918 | 332791 | 30602 |
| KLHL22 | 099910 | 328879 | 10919 | 331682 | 30603 |
| KLHL22 | 099910 | 487090 | 10920 | N/A | |
| KLHL22 | 099910 | 479601 | 10921 | N/A | |
| KLHL22 | 099910 | 451553 | 10922 | 400095 | 30604 |
| KLHL22 | 099910 | 444967 | 10923 | 403999 | 30605 |

-continued

| Symbol | ENSG | ENST | SEQ ID | ENSP | SEQ ID |
|---|---|---|---|---|---|
| KLHL22 | 099910 | 458248 | 10924 | 398616 | 30606 |
| KLHL22 | 099910 | 443285 | 10925 | 397882 | 30607 |
| KLHL22 | 099910 | 494929 | 10926 | N/A | |
| KLHL22 | 099910 | 431430 | 10927 | 409092 | 30608 |
| KLHL22 | 099910 | 470335 | 10928 | N/A | |
| KLHL22 | 099910 | 490556 | 10929 | N/A | |
| KLHL22 | 099910 | 423364 | 10930 | 402746 | 30609 |
| KLHL5 | 109790 | 261425 | 10931 | 261425 | 30610 |
| KLHL5 | 109790 | 508137 | 10932 | 423080 | 30611 |
| KLHL5 | 109790 | 504108 | 10933 | 423897 | 30612 |
| KLHL5 | 109790 | 381930 | 10934 | 371355 | 30613 |
| KLHL5 | 109790 | 261426 | 10935 | 261426 | 30614 |
| KLHL5 | 109790 | 514399 | 10936 | 426949 | 30615 |
| KLHL5 | 109790 | 515612 | 10937 | 425512 | 30616 |
| KLK6 | 167755 | 376851 | 10938 | 366047 | 30617 |
| KLK6 | 167755 | 310157 | 10939 | 309148 | 30618 |
| KLK6 | 167755 | 597379 | 10940 | 469630 | 30619 |
| KLK6 | 167755 | 594641 | 10941 | 470482 | 30620 |
| KLK6 | 167755 | 599881 | 10942 | 471948 | 30621 |
| KLK6 | 167755 | 599690 | 10943 | 469702 | 30622 |
| KLK6 | 167755 | 391808 | 10944 | 375684 | 30623 |
| KNDC1 | 171798 | 301613 | 10945 | 304437 | 30624 |
| KNDC1 | 171798 | 478074 | 10946 | N/A | |
| KNDC1 | 171798 | 485110 | 10947 | N/A | |
| KNDC1 | 171798 | 530127 | 10948 | N/A | |
| KNDC1 | 171798 | 368571 | 10949 | 357560 | 30625 |
| KNOP1 | 103550 | 219837 | 10950 | 219837 | 30626 |
| KNOP1 | 103550 | 568230 | 10951 | 455015 | 30627 |
| KNOP1 | 103550 | 567367 | 10952 | 455369 | 30628 |
| KNOP1 | 103550 | 565844 | 10953 | N/A | |
| KNOP1 | 103550 | 564480 | 10954 | 454329 | 30629 |
| KNTC1 | 184445 | 535410 | 10955 | N/A | |
| KNTC1 | 184445 | 450485 | 10956 | 397992 | 30630 |
| KNTC1 | 184445 | 333479 | 10957 | 328236 | 30631 |
| KNTC1 | 184445 | 535186 | 10958 | N/A | |
| KNTC1 | 184445 | 423927 | 10959 | 397140 | 30632 |
| KNTC1 | 184445 | 545065 | 10960 | N/A | |
| KNTC1 | 184445 | 377192 | 10961 | N/A | |
| KNTC1 | 184445 | 436959 | 10962 | 408760 | 30633 |
| KNTC1 | 184445 | 541466 | 10963 | N/A | |
| KNTC1 | 184445 | 546125 | 10964 | 439119 | 30634 |
| KNTC1 | 184445 | 536625 | 10965 | N/A | |
| KNTC1 | 184445 | 542727 | 10966 | N/A | |
| KNTC1 | 184445 | 539013 | 10967 | N/A | |
| KNTC1 | 184445 | 541427 | 10968 | N/A | |
| KNTC1 | 184445 | 534995 | 10969 | 437344 | 30635 |
| KRT222 | 213424 | 394049 | 10970 | 377613 | 30636 |
| KRT222 | 213424 | 394052 | 10971 | 377616 | 30637 |
| KRT222 | 213424 | 581564 | 10972 | 463865 | 30638 |
| KRT222 | 213424 | 580719 | 10973 | 464647 | 30639 |
| KRT24 | 167916 | 264651 | 10974 | 264651 | 30640 |
| KRTAP12-2 | 221864 | 360770 | 10975 | 354001 | 30641 |
| KSR2 | 171435 | 339824 | 10976 | 339952 | 30642 |
| KSR2 | 171435 | 545002 | 10977 | N/A | |
| KSR2 | 171435 | 543793 | 10978 | N/A | |
| KSR2 | 171435 | 425217 | 10979 | 389715 | 30643 |
| L1CAM | 198910 | 370060 | 10980 | 359077 | 30644 |
| L1CAM | 198910 | 370055 | 10981 | 359072 | 30645 |
| L1CAM | 198910 | 370058 | 10982 | 359075 | 30646 |
| L1CAM | 198910 | 361699 | 10983 | 355380 | 30647 |
| L1CAM | 198910 | 491983 | 10984 | N/A | |
| L1CAM | 198910 | 474853 | 10985 | N/A | |
| L1CAM | 198910 | 455590 | 10986 | 397792 | 30648 |
| L1CAM | 198910 | 496122 | 10987 | N/A | |
| L1CAM | 198910 | 484652 | 10988 | N/A | |
| L1CAM | 198910 | 439496 | 10989 | 402407 | 30649 |
| L1CAM | 198910 | 407935 | 10990 | 384902 | 30650 |
| L1CAM | 198910 | 464967 | 10991 | N/A | |
| L1CAM | 198910 | 420165 | 10992 | 392524 | 30651 |
| L1CAM | 198910 | 458029 | 10993 | 396079 | 30652 |
| L1CAM | 198910 | 460553 | 10994 | N/A | |
| L1CAM | 198910 | 616195 | 10995 | N/A | |
| L1CAM | 198910 | 361981 | 10996 | 354712 | 30653 |
| L3HYPDH | 126790 | 466522 | 10997 | N/A | |
| L3HYPDH | 126790 | 247194 | 10998 | 247194 | 30654 |
| L3HYPDH | 126790 | 463432 | 10999 | N/A | |

-continued

| Symbol | ENSG | ENST | SEQ ID | ENSP | SEQ ID |
|---|---|---|---|---|---|
| L3HYPDH | 126790 | 478430 | 11000 | N/A | |
| L3HYPDH | 126790 | 532049 | 11001 | N/A | |
| L3HYPDH | 126790 | 543619 | 11002 | N/A | |
| L3HYPDH | 126790 | 487285 | 11003 | 431608 | 30655 |
| L3HYPDH | 126790 | 481608 | 11004 | 423874 | 30656 |
| L3HYPDH | 126790 | 527981 | 11005 | N/A | |
| L3MBTL2 | 100395 | 216237 | 11006 | 216237 | 30657 |
| L3MBTL2 | 100395 | 481902 | 11007 | N/A | |
| L3MBTL2 | 100395 | 489136 | 11008 | N/A | |
| L3MBTL2 | 100395 | 466589 | 11009 | N/A | |
| L3MBTL2 | 100395 | 453659 | 11010 | 405849 | 30658 |
| L3MBTL2 | 100395 | 479978 | 11011 | N/A | |
| L3MBTL2 | 100395 | 452106 | 11012 | 414423 | 30659 |
| L3MBTL2 | 100395 | 449635 | 11013 | 399405 | 30660 |
| L3MBTL2 | 100395 | 450939 | 11014 | 403767 | 30661 |
| LACTB2-AS1 | 246366 | 499227 | 11015 | N/A | |
| LACTB2-AS1 | 246366 | 519358 | 11016 | N/A | |
| LACTB2-AS1 | 246366 | 518553 | 11017 | N/A | |
| LACTB2-AS1 | 246366 | 518152 | 11018 | N/A | |
| LACTB2-AS1 | 246366 | 519167 | 11019 | N/A | |
| LAMA1 | 101680 | 389658 | 11020 | 374309 | 30662 |
| LAMA1 | 101680 | 492048 | 11021 | N/A | |
| LAMA1 | 101680 | 488064 | 11022 | N/A | |
| LAMA1 | 101680 | 579014 | 11023 | N/A | |
| LAMA1 | 101680 | 488089 | 11024 | N/A | |
| LAMA1 | 101680 | 490190 | 11025 | N/A | |
| LAMA1 | 101680 | 484335 | 11026 | N/A | |
| LAMA1 | 101680 | 585178 | 11027 | N/A | |
| LAMA1 | 101680 | 638611 | 11028 | 491821 | 30663 |
| LAMA2 | 196569 | 421865 | 11029 | 400365 | 30664 |
| LAMA2 | 196569 | 466230 | 11030 | N/A | |
| LAMA2 | 196569 | 498257 | 11031 | N/A | |
| LAMA2 | 196569 | 494137 | 11032 | N/A | |
| LAMA2 | 196569 | 618192 | 11033 | 480802 | 30665 |
| LAMA2 | 196569 | 617695 | 11034 | 481744 | 30666 |
| LAMA3 | 053747 | 313654 | 11035 | 324532 | 30667 |
| LAMA3 | 053747 | 585600 | 11036 | 468316 | 30668 |
| LAMA3 | 053747 | 399516 | 11037 | 382432 | 30669 |
| LAMA3 | 053747 | 591749 | 11038 | N/A | |
| LAMA3 | 053747 | 592519 | 11039 | 467662 | 30670 |
| LAMA3 | 053747 | 269217 | 11040 | 269217 | 30671 |
| LAMA3 | 053747 | 587184 | 11041 | 466557 | 30672 |
| LAMA3 | 053747 | 586751 | 11042 | 464836 | 30673 |
| LAMA3 | 053747 | 588770 | 11043 | N/A | |
| LAMA3 | 053747 | 586709 | 11044 | N/A | |
| LAMA3 | 053747 | 588164 | 11045 | 467473 | 30674 |
| LAMA3 | 053747 | 592442 | 11046 | N/A | |
| LAMA3 | 053747 | 590104 | 11047 | 466658 | 30675 |
| LAMA3 | 053747 | 588004 | 11048 | 468315 | 30676 |
| LAMA4 | 112769 | 230538 | 11049 | 230538 | 30677 |
| LAMA4 | 112769 | 522006 | 11050 | 429488 | 30678 |
| LAMA4 | 112769 | 389463 | 11051 | 374114 | 30679 |
| LAMA4 | 112769 | 424408 | 11052 | 416470 | 30680 |
| LAMA4 | 112769 | 604740 | 11053 | N/A | |
| LAMA4 | 112769 | 521693 | 11054 | N/A | |
| LAMA4 | 112769 | 519245 | 11055 | N/A | |
| LAMA4 | 112769 | 523765 | 11056 | 427837 | 30681 |
| LAMA4 | 112769 | 521187 | 11057 | N/A | |
| LAMA4 | 112769 | 521732 | 11058 | 427865 | 30682 |
| LAMA4 | 112769 | 368640 | 11059 | 357629 | 30683 |
| LAMA4 | 112769 | 521398 | 11060 | 430336 | 30684 |
| LAMA4 | 112769 | 518842 | 11061 | N/A | |
| LAMA4 | 112769 | 524032 | 11062 | N/A | |
| LAMA4 | 112769 | 423735 | 11063 | N/A | |
| LAMA4 | 112769 | 519932 | 11064 | 428583 | 30685 |
| LAMA4 | 112769 | 431543 | 11065 | 412136 | 30686 |
| LAMA4 | 112769 | 243219 | 11066 | 243219 | 30687 |
| LAMA4 | 112769 | 521690 | 11067 | 430415 | 30688 |
| LAMA4 | 112769 | 368638 | 11068 | 357627 | 30689 |
| LAMA4 | 112769 | 453937 | 11069 | 398226 | 30690 |
| LAMA4 | 112769 | 455073 | 11070 | 408604 | 30691 |
| LAMB1 | 091136 | 472714 | 11071 | N/A | |
| LAMB1 | 091136 | 393561 | 11072 | 377191 | 30692 |
| LAMB1 | 091136 | 222399 | 11073 | 222399 | 30693 |
| LAMB1 | 091136 | 474380 | 11074 | N/A | |
| LAMB1 | 091136 | 468518 | 11075 | N/A | |

-continued

-continued

| Symbol | ENSG | ENST | SEQ ID | ENSP | SEQ ID |
|---|---|---|---|---|---|
| LAMB1 | 091136 | 491196 | 11076 | N/A | |
| LAMB1 | 091136 | 470995 | 11077 | N/A | |
| LAMB1 | 091136 | 468999 | 11078 | N/A | |
| LAMB1 | 091136 | 476039 | 11079 | N/A | |
| LAMB1 | 091136 | 479448 | 11080 | N/A | |
| LAMB1 | 091136 | 393560 | 11081 | 377190 | 30694 |
| LAMB1 | 091136 | 439976 | 11082 | 412686 | 30695 |
| LAMB1 | 091136 | 393559 | 11083 | 377189 | 30696 |
| LAMB2 | 172037 | 467506 | 11084 | N/A | |
| LAMB2 | 172037 | 418109 | 11085 | 388325 | 30697 |
| LAMB2 | 172037 | 484713 | 11086 | N/A | |
| LAMB2 | 172037 | 305544 | 11087 | 307156 | 30698 |
| LAMB2 | 172037 | 498377 | 11088 | N/A | |
| LAMB2 | 172037 | 469665 | 11089 | N/A | |
| LAMB2 | 172037 | 477225 | 11090 | N/A | |
| LAMB2 | 172037 | 480610 | 11091 | N/A | |
| LAMB2 | 172037 | 538659 | 11092 | N/A | |
| LAMB2 | 172037 | 542580 | 11093 | N/A | |
| LAMB2 | 172037 | 462930 | 11094 | N/A | |
| LAMB2 | 172037 | 464891 | 11095 | N/A | |
| LAMB2 | 172037 | 483057 | 11096 | N/A | |
| LAMB2 | 172037 | 486298 | 11097 | N/A | |
| LAMB2 | 172037 | 477701 | 11098 | N/A | |
| LAMB2 | 172037 | 493571 | 11099 | N/A | |
| LAMB2 | 172037 | 488638 | 11100 | N/A | |
| LAMB2 | 172037 | 483321 | 11101 | N/A | |
| LAMB2 | 172037 | 494831 | 11102 | 444751 | 30699 |
| LAMP5 | 125869 | 427562 | 11103 | 406360 | 30700 |
| LAMP5 | 125869 | 246070 | 11104 | 246070 | 30701 |
| LAPTM4B | 104341 | 445593 | 11105 | 402301 | 30702 |
| LAPTM4B | 104341 | 521545 | 11106 | 428409 | 30703 |
| LAPTM4B | 104341 | 517924 | 11107 | 429868 | 30704 |
| LAPTM4B | 104341 | 619747 | 11108 | 482533 | 30705 |
| LARP6 | 166173 | 299213 | 11109 | 299213 | 30706 |
| LARP6 | 166173 | 559316 | 11110 | 467334 | 30707 |
| LARP6 | 166173 | 560052 | 11111 | N/A | |
| LARP6 | 166173 | 344870 | 11112 | 343869 | 30708 |
| LARP6 | 166173 | 559140 | 11113 | 453551 | 30709 |
| LARS2 | 011376 | 265537 | 11114 | 265537 | 30710 |
| LARS2 | 011376 | 415258 | 11115 | 408576 | 30711 |
| LARS2 | 011376 | 431023 | 11116 | 406611 | 30712 |
| LARS2 | 011376 | 414984 | 11117 | 412893 | 30713 |
| LARS2 | 011376 | 430399 | 11118 | 401388 | 30714 |
| LARS2 | 011376 | 467936 | 11119 | N/A | |
| LARS2 | 011376 | 485461 | 11120 | N/A | |
| LARS2 | 011376 | 474585 | 11121 | N/A | |
| LBH | 213626 | 395323 | 11122 | 378733 | 30715 |
| LBH | 213626 | 412933 | 11123 | 392167 | 30716 |
| LBH | 213626 | 464412 | 11124 | N/A | |
| LBH | 213626 | 406087 | 11125 | 385409 | 30717 |
| LBH | 213626 | 404397 | 11126 | 384443 | 30718 |
| LBH | 213626 | 401506 | 11127 | 385703 | 30719 |
| LBH | 213626 | 467242 | 11128 | N/A | |
| LBH | 213626 | 407930 | 11129 | 386106 | 30720 |
| LBH | 213626 | 484150 | 11130 | N/A | |
| LBX1 | 138136 | 370193 | 11131 | 359212 | 30721 |
| LCAT | 213398 | 264005 | 11132 | 264005 | 30722 |
| LCAT | 213398 | 573538 | 11133 | 463220 | 30723 |
| LCAT | 213398 | 570369 | 11134 | 459014 | 30724 |
| LCAT | 213398 | 570980 | 11135 | 464651 | 30725 |
| LCAT | 213398 | 575467 | 11136 | 460653 | 30726 |
| LCAT | 213398 | 576450 | 11137 | 458141 | 30727 |
| LCAT | 213398 | 570396 | 11138 | 459291 | 30728 |
| LCAT | 213398 | 573846 | 11139 | N/A | |
| LCAT | 213398 | 575277 | 11140 | N/A | |
| LCN8 | 204001 | 480597 | 11141 | N/A | |
| LCN8 | 204001 | 479767 | 11142 | N/A | |
| LCN8 | 204001 | 482893 | 11143 | N/A | |
| LCN8 | 204001 | 371688 | 11144 | 360753 | 30729 |
| LCN8 | 204001 | 612714 | 11145 | 482512 | 30730 |
| LCORL | 178177 | 635767 | 11146 | 490600 | 30731 |
| LCORL | 178177 | 326877 | 11147 | 317566 | 30732 |
| LCORL | 178177 | 637787 | 11148 | 490873 | 30733 |
| LCORL | 178177 | 510451 | 11149 | 423489 | 30734 |
| LCORL | 178177 | 510121 | 11150 | N/A | |
| LCORL | 178177 | 382224 | 11151 | 371659 | 30735 |

| Symbol | ENSG | ENST | SEQ ID | ENSP | SEQ ID |
|---|---|---|---|---|---|
| LCORL | 178177 | 512376 | 11152 | N/A | |
| LCORL | 178177 | 382226 | 11153 | 371661 | 30736 |
| LDAH | 118961 | 403006 | 11154 | 384267 | 30737 |
| LDAH | 118961 | 381090 | 11155 | 370480 | 30738 |
| LDAH | 118961 | 470099 | 11156 | N/A | |
| LDAH | 118961 | 237822 | 11157 | 237822 | 30739 |
| LDAH | 118961 | 626491 | 11158 | 487592 | 30740 |
| LDAH | 118961 | 432947 | 11159 | 396911 | 30741 |
| LDAH | 118961 | 412261 | 11160 | 400910 | 30742 |
| LDAH | 118961 | 402479 | 11161 | 385951 | 30743 |
| LDAH | 118961 | 419825 | 11162 | 414710 | 30744 |
| LDAH | 118961 | 619656 | 11163 | 483067 | 30745 |
| LDAH | 118961 | 541941 | 11164 | 440570 | 30746 |
| LDAH | 118961 | 440866 | 11165 | 400340 | 30747 |
| LDAH | 118961 | 435420 | 11166 | 388635 | 30748 |
| LDB2 | 169744 | 515064 | 11167 | 422552 | 30749 |
| LDB2 | 169744 | 441778 | 11168 | 392089 | 30750 |
| LDB2 | 169744 | 304523 | 11169 | 306772 | 30751 |
| LDB2 | 169744 | 509803 | 11170 | N/A | |
| LDB2 | 169744 | 502640 | 11171 | 423963 | 30752 |
| LDB2 | 169744 | 507464 | 11172 | 425754 | 30753 |
| LDB2 | 169744 | 508918 | 11173 | 424770 | 30754 |
| LDB2 | 169744 | 512345 | 11174 | 424676 | 30755 |
| LDB2 | 169744 | 503153 | 11175 | N/A | |
| LDB2 | 169744 | 504886 | 11176 | N/A | |
| LDB2 | 169744 | 506732 | 11177 | 421767 | 30756 |
| LDB2 | 169744 | 503829 | 11178 | N/A | |
| LDB2 | 169744 | 508804 | 11179 | N/A | |
| LDB2 | 169744 | 513457 | 11180 | N/A | |
| LDB2 | 169744 | 510825 | 11181 | N/A | |
| LDB2 | 169744 | 504189 | 11182 | N/A | |
| LDB3 | 122367 | 623056 | 11183 | 485500 | 30757 |
| LDB3 | 122367 | 372066 | 11184 | 361136 | 30758 |
| LDB3 | 122367 | 361373 | 11185 | 355296 | 30759 |
| LDB3 | 122367 | 623007 | 11186 | 485389 | 30760 |
| LDB3 | 122367 | 372056 | 11187 | 361126 | 30761 |
| LDB3 | 122367 | 263066 | 11188 | 263066 | 30762 |
| LDB3 | 122367 | 477489 | 11189 | 485538 | 30763 |
| LDB3 | 122367 | 429277 | 11190 | 401437 | 30764 |
| LDB3 | 122367 | 542786 | 11191 | 438866 | 30765 |
| CNMD | 136110 | 448904 | 11192 | 388576 | 30766 |
| CNMD | 136110 | 377962 | 11193 | 367198 | 30767 |
| CNMD | 136110 | 431550 | 11194 | 396035 | 30768 |
| LECT2 | 145826 | 522943 | 11195 | 429618 | 30769 |
| LECT2 | 145826 | 471827 | 11196 | N/A | |
| LECT2 | 145826 | 274507 | 11197 | 274507 | 30770 |
| LECT2 | 145826 | 512872 | 11198 | 427012 | 30771 |
| LECT2 | 145826 | 514447 | 11199 | 421123 | 30772 |
| LENG9 | 274495 | 614111 | 11200 | 483600 | 30773 |
| LENG9 | 275183 | 611161 | 11201 | 479355 | 30774 |
| LENG9 | 273574 | 622419 | 11202 | 477636 | 30775 |
| LENG9 | 278312 | 622643 | 11203 | 478498 | 30776 |
| LFNG | 106003 | 402506 | 11204 | 385764 | 30777 |
| LFNG | 106003 | 402045 | 11205 | 384786 | 30778 |
| LFNG | 106003 | 222725 | 11206 | 222725 | 30779 |
| LFNG | 106003 | 359574 | 11207 | 352579 | 30780 |
| LFNG | 106003 | 493850 | 11208 | N/A | |
| LFNG | 106003 | 338732 | 11209 | 343095 | 30781 |
| LFNG | 106003 | 614382 | 11210 | 483986 | 30782 |
| LGALS3 | 131981 | 553493 | 11211 | 451526 | 30783 |
| LGALS3 | 131981 | 254301 | 11212 | 254301 | 30784 |
| LGALS3 | 131981 | 553755 | 11213 | N/A | |
| LGALS3 | 131981 | 554715 | 11214 | 451381 | 30785 |
| LGALS3 | 131981 | 556438 | 11215 | N/A | |
| LGALS3 | 131981 | 556322 | 11216 | N/A | |
| LGALS3 | 131981 | 556263 | 11217 | N/A | |
| LGI2 | 153012 | 382114 | 11218 | 371548 | 30786 |
| LGI2 | 153012 | 512108 | 11219 | 426254 | 30787 |
| LGI4 | 153902 | 310123 | 11220 | 312273 | 30788 |
| LGI4 | 153902 | 392225 | 11221 | 376059 | 30789 |
| LGI4 | 153902 | 493050 | 11222 | N/A | |
| LGI4 | 153902 | 587780 | 11223 | 467044 | 30790 |
| LGI4 | 153902 | 591840 | 11224 | N/A | |
| LGI4 | 153902 | 593248 | 11225 | N/A | |
| LGI4 | 153902 | 591633 | 11226 | 467784 | 30791 |
| LGI4 | 153902 | 473160 | 11227 | N/A | |

-continued

| Symbol | ENSG | ENST | SEQ ID | ENSP | SEQ ID |
|---|---|---|---|---|---|
| LGI4 | 153902 | 592346 | 11228 | N/A | |
| LGR5 | 139292 | 266674 | 11229 | 266674 | 30792 |
| LGR5 | 139292 | 550851 | 11230 | N/A | |
| LGR5 | 139292 | 536515 | 11231 | 443033 | 30793 |
| LGR5 | 139292 | 540815 | 11232 | 441035 | 30794 |
| LGR5 | 139292 | 549015 | 11233 | N/A | |
| LGR5 | 139292 | 547310 | 11234 | N/A | |
| LGR6 | 133067 | 367278 | 11235 | 356247 | 30795 |
| LGR6 | 133067 | 255432 | 11236 | 255432 | 30796 |
| LGR6 | 133067 | 487787 | 11237 | 422143 | 30797 |
| LGR6 | 133067 | 423542 | 11238 | 402284 | 30798 |
| LGR6 | 133067 | 439764 | 11239 | 387869 | 30799 |
| LGR6 | 133067 | 503519 | 11240 | N/A | |
| LGR6 | 133067 | 308543 | 11241 | N/A | |
| LGR6 | 133067 | 506931 | 11242 | N/A | |
| LHFPL6 | 183722 | 379589 | 11243 | 368908 | 30800 |
| LHFPL6 | 183722 | 495922 | 11244 | N/A | |
| LHFPL2 | 145685 | 515007 | 11245 | 425906 | 30801 |
| LHFPL2 | 145685 | 502722 | 11246 | N/A | |
| LHFPL2 | 145685 | 503686 | 11247 | N/A | |
| LHFPL2 | 145685 | 512759 | 11248 | N/A | |
| LHFPL2 | 145685 | 510949 | 11249 | N/A | |
| LHFPL2 | 145685 | 515349 | 11250 | N/A | |
| LHFPL2 | 145685 | 514587 | 11251 | N/A | |
| LHFPL2 | 145685 | 380345 | 11252 | 369702 | 30802 |
| LHFPL3 | 187416 | 424859 | 11253 | 393128 | 30803 |
| LHFPL3 | 187416 | 401970 | 11254 | 385374 | 30804 |
| LHX1 | 274577 | 634033 | 11255 | N/A | |
| LHX1 | 274577 | 620305 | 11256 | 484449 | 30805 |
| LHX1 | 274577 | 631483 | 11257 | N/A | |
| LHX1 | 274577 | 631517 | 11258 | N/A | |
| LHX1 | 274577 | 633397 | 11259 | 488248 | 30806 |
| LHX1 | 273706 | 619297 | 11260 | N/A | |
| LHX1 | 273706 | 614239 | 11261 | 477829 | 30807 |
| LHX1 | 273706 | 619939 | 11262 | N/A | |
| LHX1 | 273706 | 616237 | 11263 | N/A | |
| LHX1 | 273706 | 621767 | 11264 | 481496 | 30808 |
| LHX5 | 089116 | 261731 | 11265 | 261731 | 30809 |
| LHX5 | 089116 | 557836 | 11266 | N/A | |
| LIMD1 | 144791 | 465039 | 11267 | N/A | |
| LIMD1 | 144791 | 440097 | 11268 | 394537 | 30810 |
| LIMD1 | 144791 | 273317 | 11269 | 273317 | 30811 |
| LIMD1 | 144791 | 474665 | 11270 | N/A | |
| LIMS2 | 072163 | 426981 | 11271 | 397253 | 30812 |
| LIMS2 | 072163 | 469300 | 11272 | N/A | |
| LIMS2 | 072163 | 494613 | 11273 | N/A | |
| LIMS2 | 072163 | 409286 | 11274 | 386252 | 30813 |
| LIMS2 | 072163 | 409754 | 11275 | 386345 | 30814 |
| LIMS2 | 072163 | 476932 | 11276 | N/A | |
| LIMS2 | 072163 | 324938 | 11277 | 326888 | 30815 |
| LIMS2 | 072163 | 484252 | 11278 | N/A | |
| LIMS2 | 072163 | 466410 | 11279 | N/A | |
| LIMS2 | 072163 | 409455 | 11280 | 386383 | 30816 |
| LIMS2 | 072163 | 355119 | 11281 | 347240 | 30817 |
| LIMS2 | 072163 | 409808 | 11282 | 386637 | 30818 |
| LIMS2 | 072163 | 410011 | 11283 | 387002 | 30819 |
| LIMS2 | 072163 | 410038 | 11284 | 386570 | 30820 |
| LIMS2 | 072163 | 545738 | 11285 | 443794 | 30821 |
| LIMS2 | 072163 | 413578 | 11286 | 388611 | 30822 |
| LIMS2 | 072163 | 409254 | 11287 | 386907 | 30823 |
| LIMS2 | 072163 | 582671 | 11288 | N/A | |
| LIN28B | 187772 | 345080 | 11289 | 344401 | 30824 |
| LIN28B | 187772 | 637759 | 11290 | 490468 | 30825 |
| LIN28B | 187772 | 635857 | 11291 | 489735 | 30826 |
| LIN7A | 111052 | 552864 | 11292 | 447488 | 30827 |
| LIN7A | 111052 | 261203 | 11293 | 261203 | 30828 |
| LIN7A | 111052 | 549417 | 11294 | 448975 | 30829 |
| LIN7A | 111052 | 552093 | 11295 | 448891 | 30830 |
| LINCMD1 | 225613 | 418518 | 11296 | N/A | |
| LINC00278 | 231535 | 444263 | 11297 | N/A | |
| LINC00278 | 231535 | 425031 | 11298 | N/A | |
| LINCW457 | 225179 | 440160 | 11299 | N/A | |
| LINC00457 | 225179 | 428706 | 11300 | N/A | |
| LINC00499 | 251372 | 502757 | 11301 | N/A | |
| LINC00499 | 251372 | 507145 | 11302 | N/A | |
| LINC00499 | 251372 | 515282 | 11303 | N/A | |

-continued

| Symbol | ENSG | ENST | SEQ ID | ENSP | SEQ ID |
|---|---|---|---|---|---|
| LINC00499 | 251372 | 510736 | 11304 | N/A | |
| LINC00844 | 237949 | 432535 | 11305 | N/A | |
| LINC00963 | 204054 | 454968 | 11306 | N/A | |
| LINC00963 | 204054 | 444184 | 11307 | N/A | |
| LINC00963 | 204054 | 608369 | 11308 | N/A | |
| LINC00963 | 204054 | 419300 | 11309 | N/A | |
| LINC00963 | 204054 | 423918 | 11310 | N/A | |
| LINC00963 | 204054 | 454635 | 11311 | N/A | |
| LINC00963 | 204054 | 625171 | 11312 | N/A | |
| LINC00963 | 204054 | 624138 | 11313 | N/A | |
| LINC00963 | 204054 | 624009 | 11314 | N/A | |
| LINC00963 | 204054 | 622972 | 11315 | N/A | |
| LINC00963 | 204054 | 624390 | 11316 | N/A | |
| LINC00963 | 204054 | 622680 | 11317 | N/A | |
| LINC00963 | 204054 | 623185 | 11318 | N/A | |
| LINC00963 | 204054 | 607931 | 11319 | N/A | |
| LINC00963 | 204054 | 622120 | 11320 | N/A | |
| LINC00963 | 204054 | 608272 | 11321 | N/A | |
| LINC00963 | 204054 | 453213 | 11322 | N/A | |
| LINC00963 | 204054 | 427778 | 11323 | N/A | |
| LINC00963 | 204054 | 608669 | 11324 | N/A | |
| LINC00963 | 204054 | 412141 | 11325 | N/A | |
| LINC01032 | 234871 | 451690 | 11326 | N/A | |
| LINC01158 | 233639 | 413121 | 11327 | N/A | |
| LINC01158 | 233639 | 443988 | 11328 | N/A | |
| LINC01158 | 233639 | 447876 | 11329 | N/A | |
| LINC01158 | 233639 | 458253 | 11330 | N/A | |
| LINC01158 | 233639 | 454729 | 11331 | N/A | |
| LINC01208 | 223715 | 434969 | 11332 | N/A | |
| LINC01208 | 223715 | 421034 | 11333 | N/A | |
| LINC01515 | 228065 | 433152 | 11334 | N/A | |
| LINC01515 | 228065 | 601979 | 11335 | N/A | |
| LINC01515 | 228065 | 599409 | 11336 | N/A | |
| LINC01515 | 228065 | 620859 | 11337 | N/A | |
| LINC01515 | 228065 | 608678 | 11338 | N/A | |
| LINC01515 | 228065 | 593568 | 11339 | N/A | |
| LINC01515 | 228065 | 595269 | 11340 | N/A | |
| LINC01515 | 228065 | 598092 | 11341 | N/A | |
| LINC01515 | 228065 | 618687 | 11342 | N/A | |
| LINC01515 | 228065 | 601389 | 11343 | N/A | |
| LINC01515 | 228065 | 598902 | 11344 | N/A | |
| LINC01515 | 228065 | 595737 | 11345 | N/A | |
| LINC01515 | 228065 | 601926 | 11346 | N/A | |
| LINC01515 | 228065 | 601888 | 11347 | N/A | |
| LINC01515 | 228065 | 629716 | 11348 | N/A | |
| LINC01515 | 228065 | 626101 | 11349 | N/A | |
| LINC01515 | 228065 | 626907 | 11350 | N/A | |
| LINC01515 | 228065 | 596743 | 11351 | N/A | |
| LINC01515 | 228065 | 594054 | 11352 | N/A | |
| LINC01515 | 228065 | 600848 | 11353 | N/A | |
| LINC01515 | 283079 | 634651 | 11354 | N/A | |
| LINC01515 | 283079 | 634872 | 11355 | N/A | |
| LINC01515 | 283079 | 635412 | 11356 | N/A | |
| LINC01515 | 283079 | 635635 | 11357 | N/A | |
| LINC01515 | 283079 | 634807 | 11358 | N/A | |
| LINC01515 | 283079 | 634663 | 11359 | N/A | |
| LINC01515 | 283079 | 634943 | 11360 | N/A | |
| LINC01515 | 283079 | 635203 | 11361 | N/A | |
| LINC01515 | 283079 | 634292 | 11362 | N/A | |
| LINC01515 | 283079 | 634289 | 11363 | N/A | |
| LINC01515 | 283079 | 635024 | 11364 | N/A | |
| LINC01515 | 283079 | 634792 | 11365 | N/A | |
| LINC01515 | 283079 | 634691 | 11366 | N/A | |
| LINC01515 | 283079 | 635204 | 11367 | N/A | |
| LINC01515 | 283079 | 635232 | 11368 | N/A | |
| LINC01515 | 283079 | 634685 | 11369 | N/A | |
| LINC01515 | 283079 | 634668 | 11370 | N/A | |
| LINC01515 | 283079 | 634507 | 11371 | N/A | |
| LINC01515 | 283079 | 635143 | 11372 | N/A | |
| LINC01515 | 283079 | 635709 | 11373 | N/A | |
| LINC01544 | 260440 | 567801 | 11374 | N/A | |
| LINGO1 | 169783 | 355300 | 11375 | 347451 | 30831 |
| LINGO1 | 169783 | 561030 | 11376 | 453853 | 30832 |
| LINGO1 | 169783 | 557798 | 11377 | 453780 | 30833 |
| LINGO1 | 169783 | 561686 | 11378 | 455605 | 30834 |
| LINGO1 | 169783 | 567726 | 11379 | 454465 | 30835 |

-continued

-continued

| Symbol | ENSG | ENST | SEQ ID | ENSP | SEQ ID |
|---|---|---|---|---|---|
| LINGO1 | 169783 | 566711 | 11380 | 454687 | 30836 |
| LINGO1 | 169783 | 559893 | 11381 | 454051 | 30837 |
| LINGO1 | 169783 | 564472 | 11382 | 454245 | 30838 |
| LINGO1 | 169783 | 570216 | 11383 | 454577 | 30839 |
| LINGO1 | 169783 | 562933 | 11384 | 456516 | 30840 |
| LINGO1 | 169783 | 563316 | 11385 | 457101 | 30841 |
| LINGO1 | 169783 | 567605 | 11386 | N/A | |
| LINGO1 | 169783 | 568951 | 11387 | N/A | |
| LINGO1 | 169783 | 564066 | 11388 | N/A | |
| LINGO2 | 174482 | 379992 | 11389 | 369328 | 30842 |
| LINGO2 | 174482 | 493941 | 11390 | N/A | |
| LINGO2 | 174482 | 613945 | 11391 | 479634 | 30843 |
| LINGO2 | 174482 | 308675 | 11392 | 310126 | 30844 |
| LIPG | 101670 | 577628 | 11393 | 463835 | 30845 |
| LIPG | 101670 | 583083 | 11394 | 463077 | 30846 |
| LIPG | 101670 | 261292 | 11395 | 261292 | 30847 |
| LIPG | 101670 | 427224 | 11396 | 387978 | 30848 |
| LIPG | 101670 | 580036 | 11397 | 462420 | 30849 |
| LIPG | 101670 | 579750 | 11398 | 462480 | 30850 |
| LIPG | 101670 | 623277 | 11399 | N/A | |
| LITAF | 189067 | 571688 | 11400 | 459533 | 30851 |
| LITAF | 189067 | 413364 | 11401 | 397958 | 30852 |
| LITAF | 189067 | 339430 | 11402 | 340118 | 30853 |
| LITAF | 189067 | 570904 | 11403 | 459138 | 30854 |
| LITAF | 189067 | 571459 | 11404 | 459603 | 30855 |
| LITAF | 189067 | 575426 | 11405 | 459094 | 30856 |
| LITAF | 189067 | 573332 | 11406 | 460873 | 30857 |
| LITAF | 189067 | 572255 | 11407 | 458836 | 30858 |
| LITAF | 189067 | 576036 | 11408 | 461667 | 30859 |
| LITAF | 189067 | 574763 | 11409 | 461813 | 30860 |
| LITAF | 189067 | 571627 | 11410 | 460743 | 30861 |
| LITAF | 189067 | 570798 | 11411 | 458871 | 30862 |
| LITAF | 189067 | 574701 | 11412 | 458981 | 30863 |
| LITAF | 189067 | 571976 | 11413 | 460133 | 30864 |
| LITAF | 189067 | 574703 | 11414 | 459913 | 30865 |
| LITAF | 189067 | 574848 | 11415 | 459898 | 30866 |
| LITAF | 189067 | 571277 | 11416 | 459026 | 30867 |
| LITAF | 189067 | 576334 | 11417 | 458538 | 30868 |
| LITAF | 189067 | 620789 | 11418 | 481589 | 30869 |
| LITAF | 189067 | 622633 | 11419 | 483114 | 30870 |
| LITAF | 189067 | 381810 | 11420 | 371231 | 30871 |
| LMCD1 | 071282 | 157600 | 11421 | 157600 | 30872 |
| LMCD1 | 071282 | 426878 | 11422 | 411222 | 30873 |
| LMCD1 | 071282 | 415597 | 11423 | 400555 | 30874 |
| LMCD1 | 071282 | 470776 | 11424 | N/A | |
| LMCD1 | 071282 | 454244 | 11425 | 396515 | 30875 |
| LMCD1 | 071282 | 456506 | 11426 | 405049 | 30876 |
| LMCD1 | 071282 | 397386 | 11427 | 380542 | 30877 |
| LMNTD2 | 275873 | 632043 | 11428 | N/A | |
| LMNTD2 | 275873 | 621319 | 11429 | 478197 | 30878 |
| LMNTD2 | 275873 | 631419 | 11430 | 488238 | 30879 |
| LMNTD2 | 275873 | 633856 | 11431 | 488391 | 30880 |
| LMNTD2 | 275873 | 631522 | 11432 | N/A | |
| LMNTD2 | 185522 | 469990 | 11433 | N/A | |
| LMNTD2 | 185522 | 329451 | 11434 | 331167 | 30881 |
| LMNTD2 | 185522 | 441853 | 11435 | 393529 | 30882 |
| LMNTD2 | 185522 | 486629 | 11436 | 435529 | 30883 |
| LMNTD2 | 185522 | 492515 | 11437 | N/A | |
| LMO2 | 135363 | 464025 | 11438 | N/A | |
| LMO2 | 135363 | 411482 | 11439 | 401967 | 30884 |
| LMO2 | 135363 | 395833 | 11440 | 379175 | 30885 |
| LMO2 | 135363 | 257818 | 11441 | 257818 | 30886 |
| LMO2 | 135363 | 465614 | 11442 | N/A | |
| LMO2 | 135363 | 493667 | 11443 | N/A | |
| AC027575.2 | 264278 | 585258 | 11444 | N/A | |
| AL691447.2 | 232063 | 454869 | 11445 | N/A | |
| RPL13 | 167526 | 311528 | 11446 | 307889 | 30887 |
| RPL13 | 167526 | 491523 | 11447 | N/A | |
| RPL13 | 167526 | 563749 | 11448 | N/A | |
| RPL13 | 167526 | 484610 | 11449 | N/A | |
| RPL13 | 167526 | 563270 | 11450 | 457686 | 30888 |
| RPL13 | 167526 | 567815 | 11451 | 455009 | 30889 |
| RPL13 | 167526 | 487034 | 11452 | N/A | |
| RPL13 | 167526 | 562879 | 11453 | 457174 | 30890 |
| RPL13 | 167526 | 565571 | 11454 | N/A | |
| RPL13 | 167526 | 452368 | 11455 | 438959 | 30891 |

| Symbol | ENSG | ENST | SEQ ID | ENSP | SEQ ID |
|---|---|---|---|---|---|
| RPL13 | 167526 | 467736 | 11456 | 464612 | 30892 |
| RPL13 | 167526 | 393099 | 11457 | 376811 | 30893 |
| RPL13 | 167526 | 399461 | 11458 | N/A | |
| RPL13 | 167526 | 570149 | 11459 | N/A | |
| RPL13 | 167526 | 472354 | 11460 | 462380 | 30894 |
| TEX52 | 283297 | 637658 | 11461 | 489863 | 30895 |
| TEX52 | 283297 | 637658 | 11462 | 489863 | 30896 |
| AC006213.2 | 267058 | 587128 | 11463 | N/A | |
| AC006213.2 | 267058 | 591815 | 11464 | N/A | |
| LINC02398 | 256287 | 536666 | 11465 | N/A | |
| PRSS51 | 253649 | 523024 | 11466 | N/A | |
| PRSS51 | 253649 | 521149 | 11467 | N/A | |
| PRSS51 | 253649 | 636217 | 11468 | 490515 | 30897 |
| PRSS51 | 253649 | 637190 | 11469 | 490582 | 30898 |
| SPRY4-AS1 | 231185 | 510311 | 11470 | N/A | |
| SPRY4-AS1 | 231185 | 515288 | 11471 | N/A | |
| SPRY4-AS1 | 231185 | 514303 | 11472 | N/A | |
| SPRY4-AS1 | 231185 | 443800 | 11473 | N/A | |
| SPRY4-AS1 | 231185 | 425963 | 11474 | N/A | |
| SPRY4-AS1 | 231185 | 414314 | 11475 | N/A | |
| AC010230.1 | 246316 | 514115 | 11476 | N/A | |
| AC010230.1 | 246316 | 506265 | 11477 | N/A | |
| LINC02405 | 249345 | 512624 | 11478 | N/A | |
| LINC02405 | 249345 | 540244 | 11479 | N/A | |
| LINC02405 | 249345 | 546062 | 11480 | N/A | |
| AC074035.1 | 236513 | 420725 | 11481 | N/A | |
| LINC02125 | 250514 | 512279 | 11482 | N/A | |
| AC012349.1 | 254254 | 518662 | 11483 | N/A | |
| AC012349.1 | 254254 | 522511 | 11484 | N/A | |
| AL451060.1 | 226251 | 443448 | 11485 | N/A | |
| AL451060.1 | 226251 | 412221 | 11486 | N/A | |
| AL451060.1 | 226251 | 431307 | 11487 | N/A | |
| AC104123.1 | 251314 | 502645 | 11488 | N/A | |
| AC104123.1 | 251314 | 511775 | 11489 | N/A | |
| AC104123.1 | 251314 | 513158 | 11490 | N/A | |
| AC002985.2 | 269019 | 601106 | 11491 | N/A | |
| AC022639.1 | 253554 | 523191 | 11492 | N/A | |
| AC022639.1 | 253554 | 524360 | 11493 | N/A | |
| AC022639.1 | 253554 | 521958 | 11494 | N/A | |
| AC022639.1 | 253554 | 520365 | 11495 | N/A | |
| AC109927.1 | 250195 | 505607 | 11496 | N/A | |
| AC109927.1 | 250195 | 511951 | 11497 | N/A | |
| AC109927.1 | 250195 | 507038 | 11498 | N/A | |
| BX248123.1 | 226676 | 421256 | 11499 | N/A | |
| BX248123.1 | 226676 | 429070 | 11500 | N/A | |
| LINC02112 | 249781 | 512976 | 11501 | N/A | |
| LINC02112 | 249781 | 511616 | 11502 | N/A | |
| LINC02112 | 249781 | 606744 | 11503 | N/A | |
| LINC02112 | 249781 | 606222 | 11504 | N/A | |
| LINC02112 | 249781 | 606169 | 11505 | N/A | |
| AC010210.1 | 250608 | 502521 | 11506 | N/A | |
| AC010210.1 | 250608 | 511699 | 11507 | N/A | |
| AC010210.1 | 250608 | 513905 | 11508 | N/A | |
| AC010210.1 | 250608 | 441345 | 11509 | N/A | |
| C3orf67 | 163689 | 486145 | 11510 | 421046 | 30899 |
| C3orf67 | 163689 | 470454 | 11511 | 419245 | 30900 |
| C3orf67 | 163689 | 484535 | 11512 | 419949 | 30901 |
| C3orf67 | 163689 | 460459 | 11513 | 417917 | 30902 |
| C3orf67 | 163689 | 295966 | 11514 | 295966 | 30903 |
| C3orf67 | 163689 | 482387 | 11515 | 417122 | 30904 |
| C3orf67 | 163689 | 468415 | 11516 | 419142 | 30905 |
| C3orf67 | 163689 | 495572 | 11517 | 417881 | 30906 |
| C3orf67 | 163689 | 472469 | 11518 | 417271 | 30907 |
| C3orf67 | 163689 | 479931 | 11519 | 419028 | 30908 |
| C3orf67 | 163689 | 491845 | 11520 | 418832 | 30909 |
| C3orf67 | 163689 | 471288 | 11521 | 417639 | 30910 |
| C3orf67 | 163689 | 478363 | 11522 | N/A | |
| BX890604.1 | 205664 | 461011 | 11523 | N/A | |
| BX890604.1 | 205664 | 469903 | 11524 | N/A | |
| BX890604.1 | 205664 | 483854 | 11525 | N/A | |
| BX890604.1 | 205664 | 475317 | 11526 | N/A | |
| BX890604.1 | 205664 | 425492 | 11527 | N/A | |
| BX890604.1 | 205664 | 471090 | 11528 | N/A | |
| BX890604.1 | 205664 | 486571 | 11529 | N/A | |
| BX890604.1 | 205664 | 490920 | 11530 | N/A | |
| AL512625.3 | 234665 | 586625 | 11531 | N/A | |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| AL512625.3 | 234665 | 591993 | 11532 | N/A | | 5 | LPP | 145012 | 426274 | 11608 | 397017 | 30958 |
| AL512625.3 | 234665 | 445604 | 11533 | N/A | | | LPP | 145012 | 420410 | 11609 | 405138 | 30959 |
| AL512625.3 | 234665 | 438699 | 11534 | N/A | | | LPP | 145012 | 443217 | 11610 | 404679 | 30960 |
| AL512625.3 | 234665 | 585533 | 11535 | N/A | | | LPP | 145012 | 618621 | 11611 | 482617 | 30961 |
| AL512625.3 | 234665 | 612590 | 11536 | N/A | | | LPP | 145012 | 457242 | 11612 | 403825 | 30962 |
| AL512625.3 | 234665 | 609749 | 11537 | N/A | | | LPP | 145012 | 494233 | 11613 | N/A | |
| KRTAP10-1 | 215455 | 400375 | 11538 | 383226 | 30911 | 10 | LPP | 145012 | 474472 | 11614 | N/A | |
| KRTAP10-10 | 221859 | 380095 | 11539 | 369438 | 30912 | | LPP | 145012 | 484468 | 11615 | N/A | |
| KRTAP10-11 | 243489 | 334670 | 11540 | 334197 | 30913 | | LPP | 145012 | 462758 | 11616 | N/A | |
| KRTAP10-12 | 189169 | 400365 | 11541 | 383216 | 30914 | | LPP | 145012 | 471917 | 11617 | N/A | |
| KRTAP10-12 | 189169 | 618832 | 11542 | 482575 | 30915 | | LPP | 145012 | 487347 | 11618 | N/A | |
| KRTAP10-2 | 205445 | 391621 | 11543 | 375479 | 30916 | | LPP | 145012 | 415906 | 11619 | 393008 | 30963 |
| KRTAP10-2 | 205445 | 498210 | 11544 | N/A | | 15 | LPP | 145012 | 483938 | 11620 | N/A | |
| KRTAP10-3 | 212935 | 391620 | 11545 | 375478 | 30917 | | LPP | 145012 | 494044 | 11621 | N/A | |
| KRTAP10-4 | 215454 | 400374 | 11546 | 383225 | 30918 | | LPP | 145012 | 459897 | 11622 | N/A | |
| KRTAP10-4 | 215454 | 622352 | 11547 | 484068 | 30919 | | LPP | 145012 | 640853 | 11623 | 491657 | 30964 |
| KRTAP10-4 | 215454 | 616689 | 11548 | 481165 | 30920 | | LPP | 145012 | 617246 | 11624 | 478901 | 30965 |
| KRTAP10-5 | 241123 | 400372 | 11549 | 383223 | 30921 | | LRCH1 | 136141 | 311191 | 11625 | 308493 | 30966 |
| KRTAP10-6 | 188155 | 400368 | 11550 | 383219 | 30922 | 20 | LRCH1 | 136141 | 443945 | 11626 | N/A | |
| KRTAP10-7 | 272804 | 609664 | 11551 | 476821 | 30923 | | LRCH1 | 136141 | 389798 | 11627 | 374448 | 30967 |
| KRTAP10-8 | 187766 | 334662 | 11552 | 335565 | 30924 | | LRCH1 | 136141 | 389797 | 11628 | 374447 | 30968 |
| KRTAP10-9 | 221837 | 397911 | 11553 | 381009 | 30925 | | LRCH1 | 136141 | 463929 | 11629 | 417121 | 30969 |
| KRTAP10-9 | 221837 | 484861 | 11554 | N/A | | | LRCH1 | 136141 | 478412 | 11630 | 419256 | 30970 |
| KRTAP10-9 | 221837 | 616529 | 11555 | 477523 | 30926 | | LRIG1 | 144749 | 273261 | 11631 | 273261 | 30971 |
| LONRF2 | 170500 | 393437 | 11556 | 377086 | 30927 | | LRIG1 | 144749 | 383703 | 11632 | 373208 | 30972 |
| LONRF2 | 170500 | 409647 | 11557 | 386823 | 30928 | 25 | LRIG1 | 144749 | 496559 | 11633 | N/A | |
| LOXL2 | 134013 | 389131 | 11558 | 373783 | 30929 | | LRIG1 | 144749 | 495037 | 11634 | N/A | |
| LOXL2 | 134013 | 520617 | 11559 | N/A | | | LRIG1 | 144749 | 491821 | 11635 | N/A | |
| LOXL2 | 134013 | 523833 | 11560 | 473322 | 30930 | | LRIG1 | 144749 | 497721 | 11636 | N/A | |
| LOXL2 | 134013 | 520349 | 11561 | 427907 | 30931 | | LRIG1 | 144749 | 498287 | 11637 | N/A | |
| LOXL2 | 134013 | 518878 | 11562 | 427826 | 30932 | | LRIG1 | 144749 | 475366 | 11638 | N/A | |
| LOXL2 | 134013 | 522446 | 11563 | N/A | | 30 | LRIG1 | 144749 | 495671 | 11639 | N/A | |
| LOXL2 | 134013 | 519809 | 11564 | N/A | | | LRIG1 | 282243 | 631853 | 11640 | 488729 | 30973 |
| LOXL2 | 134013 | 520925 | 11565 | N/A | | | LRIG1 | 282243 | 633161 | 11641 | 488182 | 30974 |
| LOXL2 | 134013 | 518472 | 11566 | N/A | | | LRIG1 | 282243 | 632666 | 11642 | N/A | |
| LOXL2 | 134013 | 524144 | 11567 | 427883 | 30933 | | LRIG1 | 282243 | 632591 | 11643 | N/A | |
| LOXL2 | 134013 | 520871 | 11568 | 429778 | 30934 | | LRIG1 | 282243 | 631562 | 11644 | N/A | |
| LOXL2 | 134013 | 518083 | 11569 | 430519 | 30935 | 35 | LRIG1 | 282243 | 631537 | 11645 | N/A | |
| LOXL2 | 134013 | 524168 | 11570 | 428497 | 30936 | | LRIG1 | 282243 | 633144 | 11616 | N/A | |
| LOXL2 | 134013 | 519243 | 11571 | 428933 | 30937 | | LRIG1 | 282243 | 631476 | 11617 | N/A | |
| LOXL2 | 134013 | 524075 | 11572 | N/A | | | LRIG1 | 282243 | 631776 | 11618 | N/A | |
| LPAR1 | 198121 | 374431 | 11573 | 363553 | 30938 | | LRP1 | 123384 | 553277 | 11619 | 451449 | 30975 |
| LPAR1 | 198121 | 374430 | 11574 | 363552 | 30939 | | LRP1 | 123384 | 243077 | 11650 | 243077 | 30976 |
| LPAR1 | 198121 | 358883 | 11575 | 351755 | 30940 | 40 | LRP1 | 123384 | 338962 | 11651 | 341264 | 30977 |
| LPAR1 | 198121 | 441240 | 11576 | 401810 | 30941 | | LRP1 | 123384 | 554174 | 11652 | 451737 | 30978 |
| LPAR1 | 198121 | 541779 | 11577 | 445697 | 30942 | | LRP1 | 123384 | 556830 | 11653 | N/A | |
| LPCAT2 | 087253 | 262134 | 11578 | 262134 | 30943 | | LRP1 | 123384 | 553446 | 11654 | N/A | |
| LPCAT2 | 087253 | 566911 | 11579 | N/A | | | LRP1 | 123384 | 554118 | 11655 | 451622 | 30979 |
| LPCAT2 | 087253 | 564084 | 11580 | 457496 | 30944 | | LRP1 | 123384 | 555941 | 11656 | N/A | |
| LPCAT2 | 087253 | 566915 | 11581 | N/A | | | LRP1 | 123384 | 555124 | 11657 | 451012 | 30980 |
| LPCAT2 | 087253 | 563095 | 11582 | N/A | | 45 | LRP1 | 123384 | 556247 | 11658 | N/A | |
| LPCAT2 | 087253 | 566375 | 11583 | N/A | | | LRP1 | 123384 | 451724 | 11659 | N/A | |
| LPCAT2 | 087253 | 565056 | 11584 | N/A | | | LRP1 | 123384 | 556356 | 11660 | N/A | |
| LPCAT2 | 087253 | 562299 | 11585 | N/A | | | LRP1B | 168702 | 389484 | 11661 | 374135 | 30981 |
| LPCAT4 | 176454 | 314891 | 11586 | 317300 | 30945 | | LRP1B | 168702 | 437977 | 11662 | 415052 | 30982 |
| LPCAT4 | 176454 | 563748 | 11587 | N/A | | | LRP1B | 168702 | 442974 | 11663 | 393859 | 30983 |
| LPCAT4 | 176454 | 567507 | 11588 | 454422 | 30946 | 50 | LRP1B | 168702 | 434794 | 11664 | 413239 | 30984 |
| LPCAT4 | 176454 | 563240 | 11589 | N/A | | | LRP1B | 168702 | 486364 | 11665 | N/A | |
| LPCAT4 | 176454 | 562404 | 11590 | N/A | | | LRP2 | 081479 | 263816 | 11666 | 263816 | 30985 |
| LPCAT4 | 176454 | 566581 | 11591 | N/A | | | LRP2 | 081479 | 491228 | 11667 | N/A | |
| LPCAT4 | 176454 | 623384 | 11592 | N/A | | | LRP2 | 081479 | 461418 | 11668 | N/A | |
| LPCAT4 | 176454 | 569804 | 11593 | N/A | | | LRP2 | 081479 | 443831 | 11669 | 409813 | 30986 |
| LPCAT4 | 176454 | 562431 | 11594 | N/A | | 55 | LRP2 | 081479 | 493501 | 11670 | N/A | |
| LPCAT4 | 176454 | 617710 | 11595 | 478003 | 30947 | | LRPAP1 | 163956 | 500728 | 11671 | 421922 | 30987 |
| LPL | 175445 | 520959 | 11596 | 428496 | 30948 | | LRPAP1 | 163956 | 296325 | 11672 | N/A | |
| LPL | 175445 | 524029 | 11597 | 428237 | 30949 | | LRPAP1 | 163956 | 515119 | 11673 | 421648 | 30988 |
| LPL | 175445 | 522701 | 11598 | 428557 | 30950 | | LRPAP1 | 163956 | 509198 | 11674 | N/A | |
| LPL | 175445 | 311322 | 11599 | 309757 | 30951 | | LRRC1 | 137269 | 487251 | 11675 | 435217 | 30989 |
| LPL | 175445 | 519773 | 11600 | 431028 | 30952 | 60 | LRRC1 | 137269 | 370888 | 11676 | 359925 | 30990 |
| LPL | 175445 | 521994 | 11601 | N/A | | | LRRC1 | 137269 | 370882 | 11677 | 359919 | 30991 |
| LPL | 175445 | 523696 | 11602 | N/A | | | LRRC1 | 137269 | 490222 | 11678 | N/A | |
| LPP | 145012 | 448637 | 11603 | 393602 | 30953 | | LRRC2 | 163827 | 395905 | 11679 | 379241 | 30992 |
| LPP | 145012 | 416784 | 11604 | 410340 | 30954 | | LRRC2 | 163827 | 296144 | 11680 | 296144 | 30993 |
| LPP | 145012 | 430340 | 11605 | 397166 | 30955 | | LRRC2 | 163827 | 496388 | 11681 | N/A | |
| LPP | 145012 | 414139 | 11606 | 392667 | 30956 | 65 | LRRC2 | 163827 | 469912 | 11682 | N/A | |
| LPP | 145012 | 454789 | 11607 | 394257 | 30957 | | LRRC20 | 172731 | 355790 | 11683 | 348043 | 30994 |

-continued

-continued

| Symbol | ENSG | ENST | SEQ ID | ENSP | SEQ ID |
|---|---|---|---|---|---|
| LRRC20 | 172731 | 373224 | 11684 | 362321 | 30995 |
| LRRC20 | 172731 | 358141 | 11685 | 350860 | 30996 |
| LRRC20 | 172731 | 357631 | 11686 | 350255 | 30997 |
| LRRC20 | 172731 | 446961 | 11687 | 413745 | 30998 |
| LRRC20 | 172731 | 395011 | 11688 | 378458 | 30999 |
| LRRC20 | 172731 | 395010 | 11689 | 378457 | 31000 |
| LRRC3B | 162494 | 376085 | 11690 | 365253 | 31001 |
| LRRC3B | 179796 | 396641 | 11691 | 379880 | 31002 |
| LRRC3B | 179796 | 414619 | 11692 | 389764 | 31003 |
| LRRC3B | 179796 | 432010 | 11693 | 398184 | 31004 |
| LRRC3B | 179796 | 417744 | 11694 | 406370 | 31005 |
| LRRC3B | 179796 | 469437 | 11695 | N/A | |
| LRRC3B | 179796 | 456208 | 11696 | 394940 | 31006 |
| LRRC4C | 148948 | 278198 | 11697 | 278198 | 31007 |
| LRRC4C | 148948 | 527150 | 11698 | 436976 | 31008 |
| LRRC4C | 148948 | 528697 | 11699 | 437132 | 31009 |
| LRRC4C | 148948 | 530763 | 11700 | 434761 | 31010 |
| LRRC4C | 148948 | 533474 | 11701 | 431363 | 31011 |
| LRRC4C | 148948 | 534577 | 11702 | N/A | |
| LRRC4C | 148948 | 619527 | 11703 | 480903 | 31012 |
| LRRC69 | 214954 | 518304 | 11704 | 428285 | 31013 |
| LRRC69 | 214954 | 520099 | 11705 | 428537 | 31014 |
| LRRC69 | 214954 | 343709 | 11706 | 343221 | 31015 |
| LRRC69 | 214954 | 448384 | 11707 | 400803 | 31016 |
| LRRC69 | 214954 | 522144 | 11708 | N/A | |
| LRRC69 | 214954 | 518487 | 11709 | N/A | |
| LRRC69 | 214954 | 521519 | 11710 | N/A | |
| LRRC7 | 033122 | 310961 | 11711 | 309245 | 31017 |
| LRRC7 | 033122 | 370958 | 11712 | 359997 | 31018 |
| LRRC7 | 033122 | 035383 | 11713 | 035383 | 31019 |
| LRRC7 | 033122 | 588515 | 11714 | 466082 | 31020 |
| LRRC7 | 033122 | 609498 | 11715 | 476660 | 31021 |
| LRRC7 | 033122 | 608815 | 11716 | 476307 | 31022 |
| LRRC7 | 033122 | 608744 | 11717 | 477399 | 31023 |
| LRRC7 | 033122 | 609072 | 11718 | N/A | |
| LRRC7 | 033122 | 608470 | 11719 | N/A | |
| LRRC7 | 033122 | 607936 | 11720 | N/A | |
| LRRC7 | 033122 | 565615 | 11721 | N/A | |
| LRRC7 | 033122 | 441830 | 11722 | N/A | |
| LRRC7 | 033122 | 415775 | 11723 | 394867 | 31024 |
| LRRK2 | 188906 | 416796 | 11724 | 398726 | 31025 |
| LRRK2 | 188906 | 343742 | 11725 | 341930 | 31026 |
| LRRK2 | 188906 | 298910 | 11726 | 298910 | 31027 |
| LRRK2 | 188906 | 474202 | 11727 | N/A | |
| LRRK2 | 188906 | 430804 | 11728 | 410821 | 31028 |
| LRRK2 | 188906 | 479187 | 11729 | N/A | |
| LRRK2 | 188906 | 481256 | 11730 | N/A | |
| LRRK2 | 188906 | 636518 | 11731 | 490200 | 31029 |
| LRRTM4 | 176204 | 409911 | 11732 | 387228 | 31030 |
| LRRTM4 | 176204 | 409884 | 11733 | 387297 | 31031 |
| LRRTM4 | 176204 | 409093 | 11734 | 386357 | 31032 |
| LRRTM4 | 176204 | 409088 | 11735 | 386236 | 31033 |
| LRRTM4 | 176204 | 409282 | 11736 | 386286 | 31034 |
| LRRTM4 | 176204 | 456154 | 11737 | 408722 | 31035 |
| LRRTM4 | 176204 | 491242 | 11738 | N/A | |
| LRTM1 | 144771 | 273286 | 11739 | 273286 | 31036 |
| LRTM1 | 144771 | 493075 | 11740 | 419772 | 31037 |
| LSM5 | 106355 | 450169 | 11741 | 410758 | 31038 |
| LSM5 | 106355 | 409909 | 11742 | 386363 | 31039 |
| LSM5 | 106355 | 409292 | 11743 | 386814 | 31040 |
| LSM5 | 106355 | 468872 | 11744 | N/A | |
| LSM5 | 106355 | 410044 | 11745 | 386707 | 31041 |
| LSM5 | 106355 | 409987 | 11746 | 386275 | 31042 |
| LSM5 | 106355 | 223084 | 11747 | 223084 | 31043 |
| LSM5 | 106355 | 409782 | 11748 | 387109 | 31044 |
| LSM5 | 106355 | 409952 | 11749 | 387126 | 31045 |
| LSM5 | 106355 | 480956 | 11750 | N/A | |
| LTBP2 | 119681 | 261978 | 11751 | 261978 | 31046 |
| LTBP2 | 119681 | 553939 | 11752 | 452110 | 31047 |
| LTBP2 | 119681 | 554861 | 11753 | N/A | |
| LTBP2 | 119681 | 556690 | 11754 | 451477 | 31048 |
| LTBP2 | 119681 | 556206 | 11755 | 450668 | 31049 |
| LTBP2 | 119681 | 557425 | 11756 | N/A | |
| LTK | 062524 | 355166 | 11757 | 347293 | 31050 |
| LTK | 062524 | 263800 | 11758 | 263800 | 31051 |
| LTK | 062524 | 563518 | 11759 | N/A | |

| Symbol | ENSG | ENST | SEQ ID | ENSP | SEQ ID |
|---|---|---|---|---|---|
| LTK | 062524 | 561619 | 11760 | 458111 | 31052 |
| LTK | 062524 | 453182 | 11761 | 392196 | 31053 |
| LTK | 062524 | 569283 | 11762 | N/A | |
| LURAP1 | 171357 | 371980 | 11763 | 361048 | 31054 |
| LURAP1L | 153714 | 319264 | 11764 | 321026 | 31055 |
| LURAP1L | 153714 | 489107 | 11765 | N/A | |
| LY6E | 160932 | 517503 | 11766 | 428427 | 31056 |
| LY6E | 160932 | 292494 | 11767 | 292494 | 31057 |
| LY6E | 160932 | 429120 | 11768 | 414307 | 31058 |
| LY6E | 160932 | 521699 | 11769 | 427915 | 31059 |
| LY6E | 160932 | 520531 | 11770 | 430131 | 31060 |
| LY6E | 160932 | 520466 | 11771 | 428572 | 31061 |
| LY6E | 160932 | 521003 | 11772 | 428169 | 31062 |
| LY6E | 160932 | 522528 | 11773 | 428365 | 31063 |
| LY6E | 160932 | 522971 | 11774 | 428159 | 31064 |
| LY6E | 160932 | 519611 | 11775 | 430796 | 31065 |
| LY6E | 160932 | 521182 | 11776 | 430770 | 31066 |
| LY6E | 160932 | 519546 | 11777 | 428467 | 31067 |
| LY6E | 160932 | 523847 | 11778 | 430700 | 31068 |
| LY6E | 160932 | 522024 | 11779 | 428442 | 31069 |
| LY6E | 160932 | 519615 | 11780 | N/A | |
| LY6E | 278032 | 633898 | 11781 | 488311 | 31070 |
| LY6E | 278032 | 619718 | 11782 | 482517 | 31071 |
| LY6E | 278032 | 632424 | 11783 | 488421 | 31072 |
| LY6E | 278032 | 632519 | 11784 | 488443 | 31073 |
| LY6E | 278032 | 633934 | 11785 | 488115 | 31074 |
| LY6E | 278032 | 632812 | 11786 | 488556 | 31075 |
| LY6E | 278032 | 632516 | 11787 | 487664 | 31076 |
| LY6E | 278032 | 632232 | 11788 | 488743 | 31077 |
| LY6E | 278032 | 631568 | 11789 | 488891 | 31078 |
| LY6E | 278032 | 632902 | 11790 | 488121 | 31079 |
| LY6E | 278032 | 632978 | 11791 | 488414 | 31080 |
| LY6E | 278032 | 632618 | 11792 | 487700 | 31081 |
| LY6E | 278032 | 633551 | 11793 | 488627 | 31082 |
| LY6E | 278032 | 633451 | 11794 | 488559 | 31083 |
| LY6E | 278032 | 631680 | 11795 | N/A | |
| LYPD1 | 150551 | 397463 | 11796 | 380605 | 31084 |
| LYPD1 | 150551 | 345008 | 11797 | 340563 | 31085 |
| LYPD1 | 150551 | 449209 | 11798 | 396651 | 31086 |
| LYPD6 | 187123 | 334166 | 11799 | 334463 | 31087 |
| LYPD6 | 187123 | 418762 | 11800 | 396855 | 31088 |
| LYPD6 | 187123 | 414420 | 11801 | 392286 | 31089 |
| LYPD6 | 187123 | 392854 | 11802 | 376594 | 31090 |
| LYPD6 | 187123 | 409381 | 11803 | 386413 | 31091 |
| LYPD6B | 150556 | 473800 | 11804 | N/A | |
| LYPD6B | 150556 | 409642 | 11805 | 387077 | 31092 |
| LYPD6B | 150556 | 409876 | 11806 | 386479 | 31093 |
| LYPD6B | 150556 | 409029 | 11807 | 386650 | 31094 |
| LYPD6B | 150556 | 480545 | 11808 | N/A | |
| LYPD6B | 150556 | 473975 | 11809 | N/A | |
| LYPD6B | 150556 | 437627 | 11810 | 388361 | 31095 |
| LYPD6B | 150556 | 450639 | 11811 | 412070 | 31096 |
| LYPD6B | 150556 | 442722 | 11812 | 410840 | 31097 |
| LYPD6B | 150556 | 498249 | 11813 | N/A | |
| LYPD6B | 150556 | 280115 | 11814 | 280115 | 31098 |
| LYRM1 | 102897 | 564457 | 11815 | N/A | |
| LYRM1 | 102897 | 568663 | 11816 | 454826 | 31099 |
| LYRM1 | 102897 | 412082 | 11817 | 396868 | 31100 |
| LYRM1 | 102897 | 567165 | 11818 | 457743 | 31101 |
| LYRM1 | 102897 | 569023 | 11819 | 454551 | 31102 |
| LYRM1 | 102897 | 568820 | 11820 | 454890 | 31103 |
| LYRM1 | 102897 | 562740 | 11821 | 454759 | 31104 |
| LYRM1 | 102897 | 567954 | 11822 | 457333 | 31105 |
| LYRM1 | 102897 | 396052 | 11823 | 379367 | 31106 |
| LYRM1 | 102897 | 439021 | 11824 | 407883 | 31107 |
| LYRM1 | 102897 | 219168 | 11825 | 219168 | 31108 |
| LYZL4 | 157093 | 287748 | 11826 | 287748 | 31109 |
| LYZL4 | 157093 | 441172 | 11827 | 387897 | 31110 |
| LYZL4 | 157093 | 470991 | 11828 | N/A | |
| MAATS1 | 183833 | 468630 | 11829 | N/A | |
| MAATS1 | 183833 | 273390 | 11830 | 273390 | 31111 |
| MAATS1 | 183833 | 482573 | 11831 | 419520 | 31112 |
| MAATS1 | 183833 | 463700 | 11832 | 419489 | 31113 |
| MAATS1 | 183833 | 482927 | 11833 | 418601 | 31114 |
| MAATS1 | 183833 | 488533 | 11834 | N/A | |
| MAATS1 | 183833 | 469659 | 11835 | N/A | |

-continued

| Symbol | ENSG | ENST | SEQ ID | ENSP | SEQ ID |
|---|---|---|---|---|---|
| MAATS1 | 183833 | 475093 | 11836 | 419972 | 31115 |
| MAATS1 | 183833 | 483134 | 11837 | N/A | |
| MAATS1 | 183833 | 498167 | 11838 | 419554 | 31116 |
| MAATS1 | 183833 | 461322 | 11839 | N/A | |
| MAATS1 | 183833 | 470948 | 11840 | N/A | |
| MAATS1 | 183833 | 482995 | 11841 | N/A | |
| MAATS1 | 183833 | 472117 | 11842 | N/A | |
| MAATS1 | 183833 | 496010 | 11843 | N/A | |
| MAATS1 | 183833 | 475543 | 11844 | N/A | |
| MAF | 178573 | 569649 | 11845 | 455097 | 31117 |
| MAF | 178573 | 326043 | 11846 | 327048 | 31118 |
| MAF | 178573 | 393350 | 11847 | 377019 | 31119 |
| MAFF | 185022 | 624676 | 11848 | N/A | |
| MAFF | 185022 | 338483 | 11849 | 345393 | 31120 |
| MAFF | 185022 | 441709 | 11850 | 391589 | 31121 |
| MAFF | 185022 | 417948 | 11851 | 416493 | 31122 |
| MAFF | 185022 | 407965 | 11852 | 384094 | 31123 |
| MAFF | 185022 | 538999 | 11853 | 441482 | 31124 |
| MAFF | 185022 | 426621 | 11854 | 388882 | 31125 |
| MAFF | 185022 | 538320 | 11855 | 442060 | 31126 |
| MAG | 105695 | 600291 | 11856 | 470772 | 31127 |
| MAG | 105695 | 392213 | 11857 | 376048 | 31128 |
| MAG | 105695 | 361922 | 11858 | 355234 | 31129 |
| MAG | 105695 | 595791 | 11859 | 473125 | 31130 |
| MAG | 105695 | 597035 | 11860 | 473245 | 31131 |
| MAG | 105695 | 537831 | 11861 | 440695 | 31132 |
| MAG | 105695 | 593348 | 11862 | N/A | |
| MAG | 105695 | 597162 | 11863 | N/A | |
| MAG | 105695 | 600291 | 11864 | 470772 | 31133 |
| MAG | 105695 | 392213 | 11865 | 376048 | 31134 |
| MAG | 105695 | 361922 | 11866 | 355234 | 31135 |
| MAG | 105695 | 595791 | 11867 | 473125 | 31136 |
| MAG | 105695 | 597035 | 11868 | 473245 | 31137 |
| MAG | 105695 | 537831 | 11869 | 440695 | 31138 |
| MAG | 105695 | 593348 | 11870 | N/A | |
| MAG | 105695 | 597162 | 11871 | N/A | |
| MAGI3 | 081026 | 369617 | 11872 | 358630 | 31139 |
| MAGI3 | 081026 | 307546 | 11873 | 304604 | 31140 |
| MAGI3 | 081026 | 369615 | 11874 | 358628 | 31141 |
| MAGI3 | 081026 | 369611 | 11875 | 358624 | 31142 |
| MAGI3 | 081026 | 486456 | 11876 | N/A | |
| MAGI3 | 081026 | 477955 | 11877 | N/A | |
| MAGT1 | 102158 | 358075 | 11878 | 354649 | 31143 |
| MAGT1 | 102158 | 618282 | 11879 | 480732 | 31144 |
| MAGT1 | 102158 | 476168 | 11880 | N/A | |
| MAGT1 | 102158 | 373336 | 11881 | 362433 | 31145 |
| MAGT1 | 102158 | 610432 | 11882 | 478379 | 31146 |
| MAK | 111837 | 313243 | 11883 | 313021 | 31147 |
| MAK | 111837 | 474039 | 11884 | 476067 | 31148 |
| MAK | 111837 | 354489 | 11885 | 346484 | 31149 |
| MAK | 111837 | 536370 | 11886 | 442221 | 31150 |
| MAK | 111837 | 538030 | 11887 | 442250 | 31151 |
| MAL | 172005 | 489399 | 11888 | N/A | |
| MAL | 172005 | 309988 | 11889 | 310880 | 31152 |
| MAL | 172005 | 353004 | 11890 | 306568 | 31153 |
| MAL | 172005 | 354078 | 11891 | 304924 | 31154 |
| MAL | 172005 | 349807 | 11892 | 322860 | 31155 |
| MAL2 | 147676 | 522112 | 11893 | 483044 | 31156 |
| MAL2 | 147676 | 534619 | 11894 | 482729 | 31157 |
| MAL2 | 147676 | 614891 | 11895 | 479708 | 31158 |
| MAL2 | 147676 | 531508 | 11896 | 484544 | 31159 |
| MAMSTR | 176909 | 318083 | 11897 | 324175 | 31160 |
| MAMSTR | 176909 | 356751 | 11898 | 349192 | 31161 |
| MAMSTR | 176909 | 594582 | 11899 | 471590 | 31162 |
| MAMSTR | 176909 | 599703 | 11900 | 469544 | 31163 |
| MAMSTR | 176909 | 595591 | 11901 | 469127 | 31164 |
| MAN1A1 | 111885 | 368468 | 11902 | 357453 | 31165 |
| MAN1C1 | 117643 | 374332 | 11903 | 363452 | 31166 |
| MAN1C1 | 117643 | 263979 | 11904 | 263979 | 31167 |
| MAN1C1 | 117643 | 473891 | 11905 | N/A | |
| MAN1C1 | 117643 | 374329 | 11906 | 363449 | 31168 |
| MAN1C1 | 117643 | 496532 | 11907 | N/A | |
| MAN1C1 | 117643 | 475314 | 11908 | N/A | |
| MAN1C1 | 117643 | 487493 | 11909 | N/A | |
| MAN1C1 | 117643 | 611903 | 11910 | 482317 | 31169 |
| MAN2A1 | 112893 | 261483 | 11911 | 261483 | 31170 |

-continued

| Symbol | ENSG | ENST | SEQ ID | ENSP | SEQ ID |
|---|---|---|---|---|---|
| MAN2A1 | 112893 | 502261 | 11912 | N/A | |
| MAN2A1 | 112893 | 508043 | 11913 | N/A | |
| MAN2A1 | 112893 | 513921 | 11914 | N/A | |
| MAN2A1 | 112893 | 505313 | 11915 | N/A | |
| MAN2A1 | 112893 | 503970 | 11916 | N/A | |
| MAP2K6 | 108984 | 590474 | 11917 | 468348 | 31171 |
| MAP2K6 | 108984 | 586641 | 11918 | N/A | |
| MAP2K6 | 108984 | 359094 | 11919 | 351997 | 31172 |
| MAP2K6 | 108984 | 589295 | 11920 | 466143 | 31173 |
| MAP2K6 | 108984 | 588110 | 11921 | 464916 | 31174 |
| MAP2K6 | 108984 | 589647 | 11922 | 467213 | 31175 |
| MAP2K6 | 108984 | 591445 | 11923 | N/A | |
| MAP2K6 | 108984 | 592348 | 11924 | N/A | |
| MAP2K6 | 108984 | 613873 | 11925 | 477701 | 31176 |
| MAP6D1 | 180834 | 318631 | 11926 | 314560 | 31177 |
| MAP6D1 | 180834 | 431348 | 11927 | 388945 | 31178 |
| MAP6D1 | 180834 | 445426 | 11928 | 390816 | 31179 |
| MAP6D1 | 180834 | 463801 | 11929 | N/A | |
| MAP7 | 135525 | 354570 | 11930 | 346581 | 31180 |
| MAP7 | 135525 | 454590 | 11931 | 414712 | 31181 |
| MAP7 | 135525 | 544465 | 11932 | 445737 | 31182 |
| MAP7 | 135525 | 438100 | 11933 | 400790 | 31183 |
| MAP7 | 135525 | 611373 | 11934 | 482998 | 31184 |
| MAP7 | 135525 | 616617 | 11935 | 483511 | 31185 |
| MAP7 | 135525 | 432797 | 11936 | 414879 | 31186 |
| MAP7 | 135525 | 617204 | 11937 | 482335 | 31187 |
| MAP7 | 135525 | 618822 | 11938 | 482356 | 31188 |
| MAPK12 | 188130 | 497036 | 11939 | N/A | |
| MAPK12 | 188130 | 395780 | 11940 | 379126 | 31189 |
| MAPK12 | 188130 | 488504 | 11941 | N/A | |
| MAPK12 | 188130 | 215659 | 11942 | 215659 | 31190 |
| MAPK12 | 188130 | 467891 | 11943 | N/A | |
| MAPK12 | 188130 | 496942 | 11944 | N/A | |
| MAPK12 | 188130 | 482969 | 11945 | N/A | |
| MAPK12 | 188130 | 497738 | 11946 | N/A | |
| MAPK12 | 188130 | 492218 | 11947 | N/A | |
| MAPK12 | 188130 | 395778 | 11948 | 379124 | 31191 |
| MAPK12 | 188130 | 622558 | 11949 | 479972 | 31192 |
| MAPK4 | 141639 | 587823 | 11950 | N/A | |
| MAPK4 | 141639 | 588540 | 11951 | 465661 | 31193 |
| MAPK4 | 141639 | 586735 | 11952 | N/A | |
| MAPK4 | 141639 | 540640 | 11953 | 439231 | 31194 |
| MAPK4 | 141639 | 592595 | 11954 | 466233 | 31195 |
| MAPK4 | 141639 | 400384 | 11955 | 383234 | 31196 |
| MAPK4 | 282110 | 632577 | 11956 | N/A | |
| MAPK4 | 282110 | 632712 | 11957 | N/A | |
| MAPK4 | 282110 | 631501 | 11958 | N/A | |
| MAPK4 | 282110 | 631637 | 11959 | N/A | |
| MAPRE2 | 166974 | 591734 | 11960 | 468216 | 31197 |
| MAPRE2 | 166974 | 589180 | 11961 | 465939 | 31198 |
| MAPRE2 | 166974 | 590793 | 11962 | N/A | |
| MAPRE2 | 166974 | 587359 | 11963 | 466871 | 31199 |
| MAPRE2 | 166974 | 436190 | 11964 | 407723 | 31200 |
| MAPRE2 | 166974 | 588349 | 11965 | 468904 | 31201 |
| MAPRE2 | 166974 | 300249 | 11966 | 300249 | 31202 |
| MAPRE2 | 166974 | 538170 | 11967 | 446343 | 31203 |
| MAPRE2 | 166974 | 588910 | 11968 | 468588 | 31204 |
| MAPRE2 | 166974 | 585592 | 11969 | N/A | |
| MAPRE2 | 166974 | 589699 | 11970 | 464921 | 31205 |
| MAPRE2 | 166974 | 588085 | 11971 | N/A | |
| MAPRE2 | 166974 | 413393 | 11972 | 396074 | 31206 |
| MARC2 | 117791 | 469583 | 11973 | 435450 | 31207 |
| MARC2 | 117791 | 359316 | 11974 | 352266 | 31208 |
| MARC2 | 117791 | 366913 | 11975 | 355880 | 31209 |
| MARC2 | 117791 | 425560 | 11976 | 416442 | 31210 |
| MARC2 | 117791 | 496078 | 11977 | N/A | |
| MARC2 | 117791 | 472447 | 11978 | N/A | |
| MARCH1 | 145416 | 503008 | 11979 | 427223 | 31211 |
| MARCH1 | 145416 | 514618 | 11980 | 421322 | 31212 |
| MARCH1 | 145416 | 339875 | 11981 | 345676 | 31213 |
| MARCH1 | 145416 | 510786 | 11982 | 424089 | 31214 |
| MARCH1 | 145416 | 512214 | 11983 | N/A | |
| MARCH1 | 145416 | 505517 | 11984 | N/A | |
| MARCH1 | 145416 | 507270 | 11985 | 426731 | 31215 |
| MARCH1 | 145416 | 511245 | 11986 | N/A | |
| MARCH1 | 145416 | 510696 | 11987 | N/A | |

| Symbol | ENSG | ENST | SEQ ID | ENSP | SEQ ID |
|---|---|---|---|---|---|
| MARCH1 | 145416 | 503104 | 11988 | N/A | |
| MARCH1 | 145416 | 508725 | 11989 | N/A | |
| MARCH1 | 145416 | 505391 | 11990 | N/A | |
| MARCH1 | 145416 | 515471 | 11991 | N/A | |
| MARCH1 | 145416 | 510075 | 11992 | N/A | |
| MARCH1 | 145416 | 274056 | 11993 | 274056 | 31216 |
| MARCH11 | 183654 | 332432 | 11994 | 333181 | 31217 |
| MARCH11 | 183654 | 507111 | 11995 | 424425 | 31218 |
| MARCH11 | 183654 | 505509 | 11996 | N/A | |
| MARCKS | 277443 | 612661 | 11997 | 478061 | 31219 |
| MARCKSL1 | 175130 | 329421 | 11998 | 362638 | 31220 |
| MARVELD2 | 274671 | 622835 | 11999 | 480068 | 31221 |
| MARVELD2 | 274671 | 614617 | 12000 | 480044 | 31222 |
| MARVELD2 | 274671 | 611349 | 12001 | 480310 | 31223 |
| MARVELD2 | 274671 | 622563 | 12002 | 480479 | 31224 |
| MARVELD2 | 274671 | 611064 | 12003 | 477520 | 31225 |
| MARVELD2 | 274671 | 612528 | 12004 | 484889 | 31226 |
| MARVELD2 | 152939 | 325631 | 12005 | 323264 | 31227 |
| MARVELD2 | 152939 | 454295 | 12006 | 396244 | 31228 |
| MARVELD2 | 152939 | 515844 | 12007 | 421902 | 31229 |
| MARVELD2 | 152939 | 512803 | 12008 | 423490 | 31230 |
| MARVELD2 | 152939 | 436532 | 12009 | 414776 | 31231 |
| MARVELD2 | 152939 | 413223 | 12010 | 398922 | 31232 |
| MASP1 | 127241 | 337774 | 12011 | 336792 | 31233 |
| MASP1 | 127241 | 468121 | 12012 | N/A | |
| MASP1 | 127241 | 480349 | 12013 | N/A | |
| MASP1 | 127241 | 296280 | 12014 | 296280 | 31234 |
| MASP1 | 127241 | 392472 | 12015 | 376264 | 31235 |
| MASP1 | 127241 | 495249 | 12016 | N/A | |
| MASP1 | 127241 | 169293 | 12017 | 169293 | 31236 |
| MASP1 | 127241 | 392470 | 12018 | 376262 | 31237 |
| MASP1 | 127241 | 483719 | 12019 | N/A | |
| MASP1 | 127241 | 460839 | 12020 | N/A | |
| MASP1 | 127241 | 490558 | 12021 | N/A | |
| MASP1 | 127241 | 392475 | 12022 | 376267 | 31238 |
| MASP1 | 127241 | 465015 | 12023 | N/A | |
| MASP1 | 127241 | 439271 | 12024 | 412021 | 31239 |
| MASP1 | 127241 | 425937 | 12025 | 409047 | 31240 |
| MATN1 | 162510 | 373765 | 12026 | 362870 | 31241 |
| MATN1 | 162510 | 494561 | 12027 | N/A | |
| MATN1 | 162510 | 477320 | 12028 | N/A | |
| MATN4 | 124159 | 372756 | 12029 | 361842 | 31242 |
| MATN4 | 124159 | 372754 | 12030 | 361840 | 31243 |
| MATN4 | 124159 | 360607 | 12031 | 353819 | 31244 |
| MATN4 | 124159 | 353917 | 12032 | 243983 | 31245 |
| MATN4 | 124159 | 537548 | 12033 | 440328 | 31246 |
| MBOAT1 | 172197 | 324607 | 12034 | 324944 | 31247 |
| MBOAT2 | 143797 | 305997 | 12035 | 302177 | 31248 |
| MBOAT2 | 143797 | 471753 | 12036 | 419573 | 31249 |
| MBOAT2 | 143797 | 486315 | 12037 | N/A | |
| MBOAT2 | 143797 | 473432 | 12038 | N/A | |
| MBOAT2 | 143797 | 486484 | 12039 | N/A | |
| MBOAT2 | 143797 | 494760 | 12040 | N/A | |
| MBOAT2 | 143797 | 477073 | 12041 | 420114 | 31250 |
| MBOAT2 | 143797 | 474341 | 12042 | N/A | |
| MBOAT2 | 143797 | 462696 | 12043 | 417409 | 31251 |
| MBOAT2 | 143797 | 460786 | 12044 | N/A | |
| MBOAT7 | 278519 | 615453 | 12045 | 482625 | 31252 |
| MBOAT7 | 278519 | 621455 | 12046 | 477891 | 31253 |
| MBOAT7 | 278519 | 612053 | 12047 | 482884 | 31254 |
| MBOAT7 | 278322 | 621612 | 12048 | 478088 | 31255 |
| MBOAT7 | 278322 | 611602 | 12049 | 482369 | 31256 |
| MBOAT7 | 278322 | 620636 | 12050 | 482742 | 31257 |
| MBOAT7 | 277733 | 621875 | 12051 | 478041 | 31258 |
| MBOAT7 | 277733 | 621146 | 12052 | 481758 | 31259 |
| MBOAT7 | 277733 | 612567 | 12053 | 483526 | 31260 |
| MBOAT7 | 276935 | 617012 | 12054 | 484199 | 31261 |
| MBOAT7 | 276935 | 610862 | 12055 | 481119 | 31262 |
| MBOAT7 | 276935 | 622772 | 12056 | N/A | |
| MBOAT7 | 276935 | 613056 | 12057 | N/A | |
| MBOAT7 | 276935 | 616849 | 12058 | 484102 | 31263 |
| MBOAT7 | 276935 | 620231 | 12059 | 477618 | 31264 |
| MBOAT7 | 276935 | 615450 | 12060 | N/A | |
| MBOAT7 | 276935 | 618692 | 12061 | N/A | |
| MBOAT7 | 276935 | 611939 | 12062 | N/A | |
| MBOAT7 | 276935 | 615263 | 12063 | N/A | |
| MBOAT7 | 276935 | 621905 | 12064 | N/A | |
| MBOAT7 | 276935 | 619104 | 12065 | N/A | |
| MBOAT7 | 276935 | 614279 | 12066 | 480894 | 31265 |
| MBOAT7 | 125505 | 437868 | 12067 | 404915 | 31266 |
| MBOAT7 | 125505 | 338624 | 12068 | 344377 | 31267 |
| MBOAT7 | 125505 | 245615 | 12069 | 245615 | 31268 |
| MBOAT7 | 125505 | 494142 | 12070 | N/A | |
| MBOAT7 | 125505 | 449249 | 12071 | 406794 | 31269 |
| MBOAT7 | 125505 | 391754 | 12072 | 375634 | 31270 |
| MBOAT7 | 125505 | 495279 | 12073 | 472209 | 31271 |
| MBOAT7 | 125505 | 414665 | 12074 | 388250 | 31272 |
| MBOAT7 | 125505 | 453320 | 12075 | 410320 | 31273 |
| MBOAT7 | 125505 | 464098 | 12076 | N/A | |
| MBOAT7 | 125505 | 474910 | 12077 | N/A | |
| MBOAT7 | 125505 | 491216 | 12078 | N/A | |
| MBOAT7 | 125505 | 495968 | 12079 | N/A | |
| MBOAT7 | 125505 | 431666 | 12080 | 410503 | 31274 |
| MBOAT7 | 273592 | 614745 | 12081 | N/A | |
| MBOAT7 | 273592 | 619855 | 12082 | 484954 | 31275 |
| MBOAT7 | 273592 | 610921 | 12083 | N/A | |
| MBOAT7 | 273592 | 614760 | 12084 | N/A | |
| MBOAT7 | 273592 | 618899 | 12085 | 480531 | 31276 |
| MBOAT7 | 273592 | 616653 | 12086 | N/A | |
| MBOAT7 | 273592 | 617324 | 12087 | 478623 | 31277 |
| MBOAT7 | 273592 | 619692 | 12088 | N/A | |
| MBOAT7 | 273592 | 617095 | 12089 | 482316 | 31278 |
| MBOAT7 | 273592 | 616410 | 12090 | N/A | |
| MBOAT7 | 273592 | 618614 | 12091 | N/A | |
| MBOAT7 | 273592 | 611302 | 12092 | N/A | |
| MBOAT7 | 273592 | 620371 | 12093 | 479760 | 31279 |
| MBOAT7 | 275118 | 615872 | 12094 | 481141 | 31280 |
| MBOAT7 | 275118 | 615282 | 12095 | 483987 | 31281 |
| MBOAT7 | 275118 | 613746 | 12096 | 484933 | 31282 |
| MBOAT7 | 275118 | 610768 | 12097 | N/A | |
| MBOAT7 | 275118 | 621334 | 12098 | 483561 | 31283 |
| MBOAT7 | 275118 | 619670 | 12099 | 479750 | 31284 |
| MBOAT7 | 275118 | 612092 | 12100 | 482357 | 31285 |
| MBOAT7 | 275118 | 619844 | 12101 | 480282 | 31286 |
| MBOAT7 | 275118 | 612519 | 12102 | 479717 | 31287 |
| MBOAT7 | 275118 | 621649 | 12103 | N/A | |
| MBOAT7 | 275118 | 621527 | 12104 | N/A | |
| MBOAT7 | 275118 | 611912 | 12105 | N/A | |
| MBOAT7 | 275118 | 621865 | 12106 | N/A | |
| MBOAT7 | 274194 | 613506 | 12107 | 478965 | 31288 |
| MBOAT7 | 274194 | 617656 | 12108 | 481864 | 31289 |
| MBOAT7 | 274194 | 617772 | 12109 | 480575 | 31290 |
| MBOAT7 | 277025 | 618378 | 12110 | 482252 | 31291 |
| MBOAT7 | 277025 | 619745 | 12111 | 481544 | 31292 |
| MBOAT7 | 277025 | 611239 | 12112 | 481947 | 31293 |
| MBOAT7 | 277923 | 619842 | 12113 | 481455 | 31294 |
| MBOAT7 | 277923 | 618826 | 12114 | 483839 | 31295 |
| MBOAT7 | 277923 | 620311 | 12115 | 478522 | 31296 |
| MBP | 197971 | 382582 | 12116 | 372025 | 31297 |
| MBP | 197971 | 490319 | 12117 | N/A | |
| MBP | 197971 | 585201 | 12118 | 462734 | 31298 |
| MBP | 197971 | 397531 | 12119 | 380973 | 31299 |
| MBP | 197971 | 397866 | 12120 | 380964 | 31300 |
| MBP | 197971 | 397865 | 12121 | 380963 | 31301 |
| MBP | 197971 | 527041 | 12122 | 435243 | 31302 |
| MBP | 197971 | 359645 | 12123 | 352667 | 31303 |
| MBP | 197971 | 528160 | 12124 | 436830 | 31304 |
| MBP | 197971 | 577755 | 12125 | 462780 | 31305 |
| MBP | 197971 | 527975 | 12126 | 431267 | 31306 |
| MBP | 197971 | 578715 | 12127 | N/A | |
| MBP | 197971 | 397869 | 12128 | 380967 | 31307 |
| MBP | 197971 | 354542 | 12129 | 346545 | 31308 |
| MBP | 197971 | 531144 | 12130 | 431335 | 31309 |
| MBP | 197971 | 583474 | 12131 | 462758 | 31310 |
| MBP | 197971 | 533278 | 12132 | 434011 | 31311 |
| MBP | 197971 | 526111 | 12133 | 435641 | 31312 |
| MBP | 197971 | 580402 | 12134 | 462223 | 31313 |
| MBP | 197971 | 579129 | 12135 | 463780 | 31314 |
| MBP | 197971 | 578193 | 12136 | 463403 | 31315 |
| MBP | 197971 | 397868 | 12137 | N/A | |
| MBP | 197971 | 447114 | 12138 | 405882 | 31316 |
| MBP | 197971 | 581179 | 12139 | N/A | |

-continued

| Symbol | ENSG | ENST | SEQ ID | ENSP | SEQ ID |
|---|---|---|---|---|---|
| MBP | 197971 | 580473 | 12140 | N/A | |
| MBP | 197971 | 582282 | 12141 | N/A | |
| MBP | 197971 | 473302 | 12142 | 432988 | 31317 |
| MBP | 197971 | 483025 | 12143 | 442393 | 31318 |
| MBP | 197971 | 493623 | 12144 | 436951 | 31319 |
| MBP | 197971 | 585216 | 12145 | N/A | |
| MBP | 197971 | 484548 | 12146 | N/A | |
| MBP | 197971 | 583118 | 12147 | N/A | |
| MBP | 197971 | 578873 | 12148 | 463137 | 31320 |
| MBP | 197971 | 467108 | 12149 | N/A | |
| MBP | 197971 | 459948 | 12150 | 435322 | 31321 |
| MBP | 197971 | 482445 | 12151 | N/A | |
| MBP | 197971 | 498683 | 12152 | 437063 | 31322 |
| MBP | 197971 | 583266 | 12153 | N/A | |
| MBP | 197971 | 397863 | 12154 | 380961 | 31323 |
| MBP | 197971 | 397860 | 12155 | 380958 | 31324 |
| MBP | 197971 | 581878 | 12156 | 462374 | 31325 |
| MBP | 197971 | 487778 | 12157 | N/A | |
| MBP | 197971 | 490754 | 12158 | N/A | |
| MBP | 197971 | 495162 | 12159 | N/A | |
| MBP | 197971 | 497479 | 12160 | N/A | |
| MBP | 197971 | 493247 | 12161 | N/A | |
| MBP | 197971 | 583798 | 12162 | 463164 | 31326 |
| MBP | 197971 | 355994 | 12163 | 348273 | 31327 |
| MCAM | 076706 | 264036 | 12164 | 264036 | 31328 |
| MCAM | 076706 | 528533 | 12165 | N/A | |
| MCAM | 076706 | 525586 | 12166 | N/A | |
| MCAM | 076706 | 524940 | 12167 | N/A | |
| MCAM | 076706 | 528976 | 12168 | N/A | |
| MCAM | 076706 | 530706 | 12169 | N/A | |
| MCAM | 076706 | 529257 | 12170 | N/A | |
| MCAM | 076706 | 529295 | 12171 | N/A | |
| MCAM | 076706 | 530006 | 12172 | N/A | |
| MCAM | 076706 | 530937 | 12173 | N/A | |
| MCAM | 076706 | 528502 | 12174 | N/A | |
| MCAM | 076706 | 529686 | 12175 | N/A | |
| MCAM | 076706 | 526190 | 12176 | N/A | |
| MCAM | 076706 | 525555 | 12177 | N/A | |
| MCAM | 076706 | 534522 | 12178 | N/A | |
| MCAM | 076706 | 530144 | 12179 | N/A | |
| MCAM | 076706 | 526992 | 12180 | N/A | |
| MCC | 171444 | 302475 | 12181 | 305617 | 31329 |
| MCC | 171444 | 515367 | 12182 | 421615 | 31330 |
| MCC | 171444 | 408903 | 12183 | 386227 | 31331 |
| MCC | 171444 | 624689 | 12184 | 485492 | 31332 |
| MCC | 171444 | 514701 | 12185 | 485220 | 31333 |
| MCC | 171444 | 502648 | 12186 | N/A | |
| MCC | 171444 | 505604 | 12187 | N/A | |
| MCC | 171444 | 506605 | 12188 | N/A | |
| MCC | 171444 | 511847 | 12189 | N/A | |
| MCC | 171444 | 511242 | 12190 | N/A | |
| MCL1 | 143384 | 369026 | 12191 | 358022 | 31334 |
| MCL1 | 143384 | 464132 | 12192 | N/A | |
| MCL1 | 143384 | 307940 | 12193 | 309973 | 31335 |
| MCL1 | 143384 | 620947 | 12194 | 477624 | 31336 |
| MCTP1 | 175471 | 514010 | 12195 | N/A | |
| MCTP1 | 175471 | 515393 | 12196 | 424126 | 31337 |
| MCTP1 | 175471 | 429576 | 12197 | 391639 | 31338 |
| MCTP1 | 175471 | 505078 | 12198 | 426417 | 31339 |
| MCTP1 | 175471 | 312216 | 12199 | 308957 | 31340 |
| MCTP1 | 175471 | 509850 | 12200 | N/A | |
| MCTP1 | 175471 | 508509 | 12201 | 423410 | 31341 |
| MCTP1 | 175471 | 512425 | 12202 | 431075 | 31342 |
| MCTP1 | 175471 | 505208 | 12203 | 426438 | 31343 |
| MCTP1 | 175471 | 506568 | 12204 | 426294 | 31344 |
| MCTP1 | 175471 | 503301 | 12205 | 425515 | 31345 |
| MCTP1 | 175471 | 507214 | 12206 | 424936 | 31346 |
| MCTP1 | 175471 | 514780 | 12207 | 421543 | 31347 |
| MCTP1 | 175471 | 512568 | 12208 | N/A | |
| MCTP1 | 175471 | 510732 | 12209 | 422219 | 31348 |
| MCTP1 | 175471 | 513695 | 12210 | N/A | |
| MCTP1 | 175471 | 505465 | 12211 | 422317 | 31349 |
| MCTP1 | 175471 | 513857 | 12212 | N/A | |
| MDFI | 112559 | 432027 | 12213 | 413226 | 31350 |
| MDFI | 112559 | 419164 | 12214 | 393881 | 31351 |
| MDFI | 112559 | 373051 | 12215 | 362142 | 31352 |
| MDFI | 112559 | 441667 | 12216 | 406600 | 31353 |
| MDFI | 112559 | 230321 | 12217 | 230321 | 31354 |
| MDFI | 112559 | 373050 | 12218 | 362141 | 31355 |
| MDFI | 112559 | 446650 | 12219 | 411829 | 31356 |
| MDFI | 112559 | 435476 | 12220 | 403587 | 31357 |
| MDFI | 112559 | 471092 | 12221 | N/A | |
| MDGA1 | 112139 | 434837 | 12222 | 402584 | 31358 |
| MDGA1 | 112139 | 373401 | 12223 | N/A | |
| MDGA1 | 112139 | 505425 | 12224 | 422042 | 31359 |
| MDGA1 | 112139 | 503419 | 12225 | N/A | |
| MDGA1 | 112139 | 418178 | 12226 | 393330 | 31360 |
| MDGA1 | 112139 | 502298 | 12227 | 425911 | 31361 |
| MDGA1 | 112139 | 510077 | 12228 | N/A | |
| MDGA1 | 112139 | 478143 | 12229 | N/A | |
| MDGA1 | 112139 | 515437 | 12230 | 421510 | 31362 |
| MDGA1 | 112139 | 508399 | 12231 | 427645 | 31363 |
| MDGA2 | 139915 | 399232 | 12232 | 382178 | 31364 |
| MDGA2 | 139915 | 357362 | 12233 | 349925 | 31365 |
| MDGA2 | 139915 | 557238 | 12234 | 452593 | 31366 |
| MDGA2 | 139915 | 557516 | 12235 | N/A | |
| MDGA2 | 139915 | 555521 | 12236 | N/A | |
| MDGA2 | 139915 | 554762 | 12237 | 450827 | 31367 |
| MDGA2 | 139915 | 482848 | 12238 | 434991 | 31368 |
| MDGA2 | 139915 | 486952 | 12239 | 452515 | 31369 |
| MDGA2 | 139915 | 472499 | 12240 | N/A | |
| MDGA2 | 139915 | 426342 | 12241 | 405456 | 31370 |
| MED12L | 144893 | 469768 | 12242 | N/A | |
| MED12L | 144893 | 422248 | 12243 | 403308 | 31371 |
| MED12L | 144893 | 309237 | 12244 | 310760 | 31372 |
| MED12L | 144893 | 474524 | 12245 | 417235 | 31373 |
| MED12L | 144893 | 273432 | 12246 | 273432 | 31374 |
| MED12L | 144893 | 480026 | 12247 | 417420 | 31375 |
| MED12L | 144893 | 491549 | 12248 | N/A | |
| MED12L | 144893 | 468305 | 12249 | N/A | |
| MED12L | 144893 | 488092 | 12250 | N/A | |
| MEF2C | 081189 | 504921 | 12251 | 421925 | 31376 |
| MEF2C | 081189 | 340208 | 12252 | 340874 | 31377 |
| MEF2C | 081189 | 424173 | 12253 | 389610 | 31378 |
| MEF2C | 081189 | 637481 | 12254 | 490354 | 31379 |
| MEF2C | 081189 | 636998 | 12255 | 490630 | 31380 |
| MEF2C | 081189 | 625674 | 12256 | 487430 | 31381 |
| MEF2C | 081189 | 437473 | 12257 | 396219 | 31382 |
| MEF2C | 081189 | 625585 | 12258 | 487538 | 31383 |
| MEF2C | 081189 | 514028 | 12259 | 426665 | 31384 |
| MEF2C | 081189 | 510942 | 12260 | 422390 | 31385 |
| MEF2C | 081189 | 506554 | 12261 | 425636 | 31386 |
| MEF2C | 081189 | 637732 | 12262 | 490241 | 31387 |
| MEF2C | 081189 | 514015 | 12263 | 424606 | 31388 |
| MEF2C | 081189 | 629612 | 12264 | 486554 | 31389 |
| MEF2C | 081189 | 636143 | 12265 | N/A | |
| MEF2C | 081189 | 636294 | 12266 | 490473 | 31390 |
| MEF2C | 081189 | 627659 | 12267 | 486490 | 31391 |
| MEF2C | 081189 | 508569 | 12268 | 423597 | 31392 |
| MEF2C | 081189 | 627170 | 12269 | 487157 | 31393 |
| MEF2C | 081189 | 627717 | 12270 | 486932 | 31394 |
| MEF2C | 081189 | 503554 | 12271 | 487437 | 31395 |
| MEF2C | 081189 | 626391 | 12272 | 487184 | 31396 |
| MEF2C | 081189 | 628656 | 12273 | 487311 | 31397 |
| MEF2C | 081189 | 510980 | 12274 | N/A | |
| MEF2C | 081189 | 515715 | 12275 | N/A | |
| MEF2C | 081189 | 513252 | 12276 | 423826 | 31398 |
| MEF2C | 081189 | 506716 | 12277 | 423656 | 31399 |
| MEF2C | 081189 | 637664 | 12278 | N/A | |
| MEF2C | 081189 | 631026 | 12279 | 485972 | 31400 |
| MEF2C | 081189 | 502831 | 12280 | 427286 | 31401 |
| MEF2C | 081189 | 507984 | 12281 | 424331 | 31402 |
| MEF2C | 081189 | 502983 | 12282 | 427163 | 31403 |
| MEF2C | 081189 | 508610 | 12283 | 426442 | 31404 |
| MEF2C | 081189 | 636541 | 12284 | 489865 | 31405 |
| MEF2C | 081189 | 637372 | 12285 | N/A | |
| MEF2C | 081189 | 636517 | 12286 | N/A | |
| MEF2C | 081189 | 503075 | 12287 | 426465 | 31406 |
| MEF2C | 081189 | 637506 | 12288 | N/A | |
| MEF2C | 081189 | 637754 | 12289 | N/A | |
| MEF2C | 081189 | 637531 | 12290 | N/A | |
| MEF2C | 081189 | 511086 | 12291 | N/A | |

-continued

-continued

| Symbol | ENSG | ENST | SEQ ID | ENSP | SEQ ID |
|---|---|---|---|---|---|
| MEF2C | 081189 | 635898 | 12292 | 490525 | 31407 |
| MEF2C | 081189 | 509373 | 12293 | 427309 | 31408 |
| MEF2C | 081189 | 515093 | 12294 | N/A | |
| MEF2C | 081189 | 509349 | 12295 | N/A | |
| MEF2C | 081189 | 636336 | 12296 | N/A | |
| MEF2C | 081189 | 637048 | 12297 | N/A | |
| MEF2C | 081189 | 637801 | 12298 | N/A | |
| MEF2C | 081189 | 629847 | 12299 | N/A | |
| MEF2C | 081189 | 637663 | 12300 | N/A | |
| MEF2C | 081189 | 636061 | 12301 | N/A | |
| MEF2C | 081189 | 635837 | 12302 | N/A | |
| MEF2C | 081189 | 503955 | 12303 | N/A | |
| MEF2C | 081189 | 637231 | 12304 | N/A | |
| MEF2C | 081189 | 636349 | 12305 | N/A | |
| MEF2C | 081189 | 637167 | 12306 | N/A | |
| MEF2C-AS1 | 248309 | 511100 | 12307 | N/A | |
| MEF2C-AS1 | 248309 | 514794 | 12308 | N/A | |
| MEF2C-AS1 | 248309 | 512585 | 12309 | N/A | |
| MEF2C-AS1 | 248309 | 513704 | 12310 | N/A | |
| MEF2C-AS1 | 248309 | 514011 | 12311 | N/A | |
| MEF2C-AS1 | 248309 | 509179 | 12312 | N/A | |
| MEF2C-AS1 | 248309 | 514092 | 12313 | N/A | |
| MEF2C-AS1 | 248309 | 511876 | 12314 | N/A | |
| MEF2C-AS1 | 248309 | 508718 | 12315 | N/A | |
| MEF2C-AS1 | 248309 | 514158 | 12316 | N/A | |
| MEF2C-AS1 | 248309 | 506665 | 12317 | N/A | |
| MEF2C-AS1 | 248309 | 639552 | 12318 | N/A | |
| MEF2C-AS1 | 248309 | 508521 | 12319 | N/A | |
| MEF2C-AS1 | 248309 | 514571 | 12320 | N/A | |
| MEF2C-AS1 | 248309 | 508742 | 12321 | N/A | |
| MEG8 | 225746 | 553584 | 12322 | N/A | |
| MEG8 | 225746 | 554852 | 12323 | N/A | |
| MEG8 | 225746 | 636052 | 12324 | N/A | |
| MEG8 | 225746 | 553465 | 12325 | N/A | |
| MEG8 | 225746 | 554323 | 12326 | N/A | |
| MEG8 | 225746 | 556475 | 12327 | N/A | |
| MEG8 | 225746 | 553421 | 12328 | N/A | |
| MEG8 | 225746 | 638012 | 12329 | N/A | |
| MEG8 | 225746 | 556720 | 12330 | N/A | |
| MEG8 | 225746 | 555354 | 12331 | N/A | |
| MEG8 | 225746 | 554485 | 12332 | N/A | |
| MEG8 | 225746 | 427085 | 12333 | N/A | |
| MEG8 | 225746 | 414488 | 12334 | N/A | |
| MEG8 | 225746 | 434716 | 12335 | N/A | |
| MEG8 | 225746 | 554369 | 12336 | N/A | |
| MEG8 | 225746 | 556637 | 12337 | N/A | |
| MEG8 | 225746 | 443252 | 12338 | N/A | |
| MEG8 | 225746 | 423708 | 12339 | N/A | |
| MEG8 | 225746 | 442197 | 12340 | N/A | |
| MEG8 | 225746 | 636391 | 12341 | N/A | |
| MEG8 | 225746 | 554693 | 12342 | N/A | |
| MEG8 | 225746 | 637332 | 12343 | N/A | |
| MEG8 | 225746 | 614605 | 12344 | N/A | |
| MEGF10 | 145794 | 503335 | 12345 | 423354 | 31409 |
| MEGF10 | 145794 | 508365 | 12346 | 423195 | 31410 |
| MEGF10 | 145794 | 418761 | 12347 | 416284 | 31411 |
| MEGF10 | 145794 | 274473 | 12348 | 274473 | 31412 |
| MEGF10 | 145794 | 515002 | 12349 | N/A | |
| MEGF10 | 145794 | 506709 | 12350 | N/A | |
| MEGF10 | 145794 | 510513 | 12351 | N/A | |
| MEGF10 | 145794 | 510828 | 12352 | N/A | |
| MEGF10 | 145794 | 507158 | 12353 | N/A | |
| MEGF10 | 145794 | 515622 | 12354 | N/A | |
| MEGF11 | 157890 | 409699 | 12355 | 386908 | 31413 |
| MEGF11 | 157890 | 288745 | 12356 | 288745 | 31414 |
| MEGF11 | 157890 | 395614 | 12357 | 378976 | 31415 |
| MEGF11 | 157890 | 478721 | 12358 | N/A | |
| MEGF11 | 157890 | 490495 | 12359 | 456118 | 31416 |
| MEGF11 | 157890 | 489275 | 12360 | 478311 | 31417 |
| MEGF11 | 157890 | 562154 | 12361 | 483007 | 31418 |
| MEGF11 | 157890 | 493192 | 12362 | N/A | |
| MEGF11 | 157890 | 478590 | 12363 | N/A | |
| MEGF11 | 157890 | 564573 | 12364 | 477691 | 31419 |
| MEGF11 | 157890 | 455812 | 12365 | 401400 | 31420 |
| MEGF11 | 157890 | 484618 | 12366 | N/A | |
| MEGF11 | 157890 | 474398 | 12367 | N/A | |

| Symbol | ENSG | ENST | SEQ ID | ENSP | SEQ ID |
|---|---|---|---|---|---|
| MEGF11 | 157890 | 469917 | 12368 | N/A | |
| MEGF11 | 157890 | 422354 | 12369 | 414475 | 31421 |
| MEGF11 | 277848 | 615799 | 12370 | N/A | |
| MEGF11 | 277848 | 612969 | 12371 | N/A | |
| MEGF11 | 277848 | 618218 | 12372 | N/A | |
| MEGF11 | 277848 | 617841 | 12373 | N/A | |
| MEGF11 | 277848 | 614417 | 12374 | 480105 | 31422 |
| MEGF11 | 277848 | 621793 | 12375 | N/A | |
| MEGF11 | 277848 | 615866 | 12376 | 478094 | 31423 |
| MEGF11 | 277848 | 614717 | 12377 | 480614 | 31424 |
| MEGF11 | 277848 | 622356 | 12378 | 488336 | 31425 |
| MEGF11 | 277848 | 613422 | 12379 | N/A | |
| MEGF11 | 277848 | 614563 | 12380 | N/A | |
| MEGF11 | 277848 | 620966 | 12381 | N/A | |
| MEGF11 | 277848 | 614471 | 12382 | N/A | |
| MEI4 | 269964 | 602452 | 12383 | 473370 | 31426 |
| MEIS1 | 143995 | 496248 | 12384 | N/A | |
| MEIS1 | 143995 | 560281 | 12385 | 454209 | 31427 |
| MEIS1 | 143995 | 491706 | 12386 | N/A | |
| MEIS1 | 143995 | 272369 | 12387 | 272369 | 31428 |
| MEIS1 | 143995 | 488550 | 12388 | 475161 | 31429 |
| MEIS1 | 143995 | 490726 | 12389 | N/A | |
| MEIS1 | 143995 | 398506 | 12390 | 381518 | 31430 |
| MEIS1 | 143995 | 495021 | 12391 | 440571 | 31431 |
| MEIS1 | 143995 | 409622 | 12392 | N/A | |
| MEIS1 | 143995 | 437869 | 12393 | 397418 | 31432 |
| MEIS1 | 143995 | 466811 | 12394 | N/A | |
| MEIS1 | 143995 | 498705 | 12395 | N/A | |
| MEIS1 | 143995 | 606455 | 12396 | N/A | |
| MEIS1 | 143995 | 475239 | 12397 | N/A | |
| MEIS1 | 143995 | 409517 | 12398 | N/A | |
| MEIS1 | 143995 | 542964 | 12399 | N/A | |
| MEIS1 | 143995 | 450027 | 12400 | N/A | |
| MEIS2 | 134138 | 561208 | 12401 | 453793 | 31433 |
| MEIS2 | 134138 | 338564 | 12402 | 341400 | 31434 |
| MEIS2 | 134138 | 397624 | 12403 | 380749 | 31435 |
| MEIS2 | 134138 | 560702 | 12404 | N/A | |
| MEIS2 | 134138 | 314177 | 12405 | 326296 | 31436 |
| MEIS2 | 134138 | 559085 | 12406 | 453390 | 31437 |
| MEIS2 | 134138 | 560570 | 12407 | 453481 | 31438 |
| MEIS2 | 134138 | 557796 | 12408 | 452693 | 31439 |
| MEIS2 | 134138 | 397620 | 12409 | 380745 | 31440 |
| MEIS2 | 134138 | 424352 | 12410 | 404185 | 31441 |
| MEIS2 | 134138 | 559972 | 12411 | N/A | |
| MEIS2 | 134138 | 561264 | 12412 | N/A | |
| MEIS2 | 134138 | 561284 | 12413 | N/A | |
| MEIS2 | 134138 | 559371 | 12414 | N/A | |
| MEIS2 | 134138 | 557992 | 12415 | N/A | |
| MEIS2 | 134138 | 558643 | 12416 | N/A | |
| MEIS2 | 134138 | 559561 | 12417 | 453497 | 31442 |
| MEIS2 | 134138 | 559408 | 12418 | N/A | |
| MEIS2 | 134138 | 607277 | 12419 | 475899 | 31443 |
| MEIS2 | 134138 | 561163 | 12420 | N/A | |
| MEIS2 | 134138 | 606653 | 12421 | 475660 | 31444 |
| MEIS2 | 134138 | 561422 | 12422 | N/A | |
| MEIS2 | 134138 | 560617 | 12423 | 452874 | 31445 |
| MEIS2 | 134138 | 558313 | 12424 | 453782 | 31446 |
| MEIS2 | 134138 | 560697 | 12425 | 452770 | 31447 |
| MEIS2 | 134138 | 559129 | 12426 | N/A | |
| MEIS2 | 134138 | 340545 | 12427 | 339549 | 31448 |
| MEIS3 | 105419 | 561204 | 12428 | N/A | |
| MEIS3 | 105419 | 441740 | 12429 | 388667 | 31449 |
| MEIS3 | 105419 | 331559 | 12430 | 333552 | 31450 |
| MEIS3 | 105419 | 560245 | 12431 | 453757 | 31451 |
| MEIS3 | 105419 | 561096 | 12432 | 453934 | 31452 |
| MEIS3 | 105419 | 561293 | 12433 | 453307 | 31453 |
| MEIS3 | 105419 | 560253 | 12434 | N/A | |
| MEIS3 | 105419 | 558555 | 12435 | 454073 | 31454 |
| MEIS3 | 105419 | 559524 | 12436 | 452854 | 31455 |
| MEIS3 | 105419 | 607695 | 12437 | 475941 | 31456 |
| MEIS3 | 105419 | 559338 | 12438 | 453249 | 31457 |
| MEIS3 | 105419 | 557833 | 12439 | 476248 | 31458 |
| MEIS3 | 105419 | 607330 | 12440 | N/A | |
| MEIS3 | 105419 | 561040 | 12441 | N/A | |
| MERTK | 153208 | 295408 | 12442 | 295408 | 31459 |
| MERTK | 153208 | 409780 | 12443 | 387277 | 31460 |

-continued

-continued

| Symbol | ENSG | ENST | SEQ ID | ENSP | SEQ ID |
|---|---|---|---|---|---|
| MERTK | 153208 | 439966 | 12444 | 402129 | 31461 |
| MERTK | 153208 | 473065 | 12445 | N/A | |
| MERTK | 153208 | 449344 | 12446 | 412660 | 31462 |
| MERTK | 153208 | 421804 | 12447 | 389152 | 31463 |
| MERTK | 153208 | 616902 | 12448 | 482824 | 31464 |
| METRN | 103260 | 568223 | 12449 | 455068 | 31465 |
| METRN | 103260 | 570132 | 12450 | 456647 | 31466 |
| METRN | 103260 | 219542 | 12451 | 219542 | 31467 |
| METRN | 103260 | 567076 | 12452 | 459900 | 31468 |
| METRN | 103260 | 564661 | 12453 | N/A | |
| METRN | 103260 | 568415 | 12454 | 457702 | 31469 |
| METTL7A | 185432 | 548553 | 12455 | 448785 | 31470 |
| METTL7A | 185432 | 550502 | 12456 | 450239 | 31471 |
| METTL7A | 185432 | 547104 | 12457 | 447542 | 31472 |
| METTL7A | 185432 | 550097 | 12458 | 448286 | 31473 |
| METTL7A | 185432 | 332160 | 12459 | 331787 | 31474 |
| METTL9 | 197006 | 563026 | 12460 | N/A | |
| METTL9 | 197006 | 567404 | 12461 | 454733 | 31475 |
| METTL9 | 197006 | 358154 | 12462 | 350874 | 31476 |
| METTL9 | 197006 | 396014 | 12463 | 379335 | 31477 |
| METTL9 | 197006 | 562379 | 12464 | 457311 | 31478 |
| METTL9 | 197006 | 570074 | 12465 | 456345 | 31479 |
| METTL9 | 197006 | 562961 | 12466 | 454239 | 31480 |
| METTL9 | 197006 | 568826 | 12467 | 455285 | 31481 |
| METTL9 | 197006 | 569290 | 12468 | 455720 | 31482 |
| METTL9 | 197006 | 564733 | 12469 | N/A | |
| METTL9 | 197006 | 615720 | 12470 | 480710 | 31483 |
| METTL9 | 284548 | 640479 | 12471 | 491241 | 31484 |
| METTL9 | 284548 | 640441 | 12472 | 492687 | 31485 |
| METTL9 | 284548 | 639291 | 12473 | N/A | |
| METTL9 | 284548 | 638803 | 12474 | 491526 | 31486 |
| METTL9 | 284548 | 638391 | 12475 | 492407 | 31487 |
| METTL9 | 284548 | 640147 | 12476 | 491618 | 31488 |
| METTL9 | 284548 | 638433 | 12477 | 491636 | 31489 |
| METTL9 | 284548 | 639220 | 12478 | 492878 | 31490 |
| METTL9 | 284548 | 638363 | 12479 | 492569 | 31491 |
| METTL9 | 284548 | 638474 | 12480 | 492256 | 31492 |
| METTL9 | 284548 | 638846 | 12481 | N/A | |
| MFAP3L | 198948 | 393704 | 12482 | 377307 | 31493 |
| MFAP3L | 198948 | 361618 | 12483 | 354583 | 31494 |
| MFAP3L | 198948 | 512698 | 12484 | 422791 | 31495 |
| MFAP3L | 198948 | 502832 | 12485 | 423722 | 31496 |
| MFAP3L | 198948 | 507601 | 12486 | 423802 | 31497 |
| MFAP3L | 198948 | 393702 | 12487 | 377305 | 31498 |
| MFAP3L | 198948 | 506110 | 12488 | 422571 | 31499 |
| MFAP3L | 198948 | 504999 | 12489 | 425303 | 31500 |
| MFAP3L | 198948 | 506764 | 12490 | 426247 | 31501 |
| MFAP3L | 198948 | 510306 | 12491 | 423549 | 31502 |
| MFAP3L | 198948 | 514683 | 12492 | N/A | |
| MFF | 168958 | 423098 | 12493 | 390165 | 31503 |
| MFF | 168958 | 304593 | 12494 | 304898 | 31504 |
| MFF | 168958 | 476924 | 12495 | N/A | |
| MFF | 168958 | 489696 | 12496 | N/A | |
| MFF | 168958 | 353339 | 12497 | 302037 | 31505 |
| MFF | 168958 | 354503 | 12498 | 346498 | 31506 |
| MFF | 168958 | 530359 | 12499 | 431725 | 31507 |
| MFF | 168958 | 531278 | 12500 | 432447 | 31508 |
| MFF | 168958 | 409565 | 12501 | 386964 | 31509 |
| MFF | 168958 | 452930 | 12502 | 415996 | 31510 |
| MFF | 168958 | 409616 | 12503 | 386641 | 31511 |
| MFF | 168958 | 460756 | 12504 | N/A | |
| MFF | 168958 | 337110 | 12505 | 338412 | 31512 |
| MFF | 168958 | 525195 | 12506 | 436920 | 31513 |
| MFF | 168958 | 470090 | 12507 | N/A | |
| MFF | 168958 | 534203 | 12508 | 435354 | 31514 |
| MFF | 168958 | 524634 | 12509 | 436289 | 31515 |
| MFF | 168958 | 349901 | 12510 | 304134 | 31516 |
| MFF | 168958 | 436237 | 12511 | 411386 | 31517 |
| MFF | 168958 | 443428 | 12512 | 391829 | 31518 |
| MFF | 168958 | 418961 | 12513 | 407547 | 31519 |
| MFF | 168958 | 436791 | 12514 | N/A | |
| MFF | 168958 | 456345 | 12515 | 415313 | 31520 |
| MFF | 168958 | 490857 | 12516 | N/A | |
| MFF | 168958 | 476262 | 12517 | N/A | |
| MFF | 168958 | 477362 | 12518 | N/A | |
| MFF | 168958 | 392059 | 12519 | 375912 | 31521 |

| Symbol | ENSG | ENST | SEQ ID | ENSP | SEQ ID |
|---|---|---|---|---|---|
| MFGE8 | 140545 | 558018 | 12520 | 452734 | 31522 |
| MFGE8 | 140545 | 268151 | 12521 | 268151 | 31523 |
| MFGE8 | 140545 | 268150 | 12522 | 268150 | 31524 |
| MFGE8 | 140545 | 566497 | 12523 | 456281 | 31525 |
| MFGE8 | 140545 | 560937 | 12524 | N/A | |
| MFGE8 | 140545 | 542878 | 12525 | 444332 | 31526 |
| MFGE8 | 140545 | 558029 | 12526 | 452926 | 31527 |
| MFGE8 | 140545 | 617199 | 12527 | N/A | |
| MFGE8 | 140545 | 613965 | 12528 | 478952 | 31528 |
| MFGE8 | 140545 | 560553 | 12529 | N/A | |
| MFGE8 | 140545 | 559259 | 12530 | N/A | |
| MFGE8 | 140545 | 559997 | 12531 | N/A | |
| MFGE8 | 140545 | 558352 | 12532 | N/A | |
| MFGE8 | 140545 | 559770 | 12533 | N/A | |
| MFGE8 | 140545 | 559143 | 12534 | N/A | |
| MFGE8 | 140545 | 558773 | 12535 | N/A | |
| MFGE8 | 140545 | 557944 | 12536 | N/A | |
| MFHAS1 | 147324 | 276282 | 12537 | 276282 | 31529 |
| MFHAS1 | 147324 | 521881 | 12538 | N/A | |
| MFHAS1 | 147324 | 520715 | 12539 | N/A | |
| MFHAS1 | 147324 | 520091 | 12540 | N/A | |
| MFSD2A | 168389 | 372811 | 12541 | 361898 | 31530 |
| MFSD2A | 168389 | 434861 | 12542 | 407606 | 31531 |
| MFSD2A | 168389 | 372809 | 12543 | 361895 | 31532 |
| MFSD2A | 168389 | 483824 | 12544 | N/A | |
| MFSD2A | 168389 | 469745 | 12545 | N/A | |
| MFSD2A | 168389 | 480630 | 12546 | N/A | |
| MFSD2A | 168389 | 491515 | 12547 | N/A | |
| MFSD2A | 168389 | 459917 | 12548 | N/A | |
| MFSD2A | 168389 | 481612 | 12549 | N/A | |
| MFSD2A | 168389 | 420632 | 12550 | 391261 | 31533 |
| MFSD9 | 135953 | 496253 | 12551 | N/A | |
| MFSD9 | 135953 | 258436 | 12552 | 258436 | 31534 |
| MFSD9 | 135953 | 438943 | 12553 | 408630 | 31535 |
| MFSD9 | 135953 | 437075 | 12554 | 414870 | 31536 |
| MFSD9 | 135953 | 411991 | 12555 | 392605 | 31537 |
| MFSD9 | 135953 | 428085 | 12556 | 413641 | 31538 |
| MFSD9 | 135953 | 421966 | 12557 | 402411 | 31539 |
| MFSD9 | 135953 | 462099 | 12558 | N/A | |
| MGAT3 | 128268 | 341184 | 12559 | 345270 | 31540 |
| MGAT3 | 128268 | 429402 | 12560 | 416226 | 31541 |
| MGAT3 | 128268 | 418314 | 12561 | 408075 | 31542 |
| MGAT4C | 182050 | 611864 | 12562 | 481096 | 31543 |
| MGAT4C | 182050 | 620241 | 12563 | 477650 | 31544 |
| MGAT4C | 182050 | 621808 | 12564 | 478300 | 31545 |
| MGAT4C | 182050 | 552808 | 12565 | 446647 | 31546 |
| MGAT4C | 182050 | 547225 | 12566 | 449172 | 31547 |
| MGAT4C | 182050 | 552435 | 12567 | 448093 | 31548 |
| MGAT4C | 182050 | 602941 | 12568 | N/A | |
| MGAT4C | 182050 | 550365 | 12569 | N/A | |
| MGAT4C | 182050 | 551921 | 12570 | N/A | |
| MGAT4C | 182050 | 551751 | 12571 | N/A | |
| MGAT4C | 182050 | 548651 | 12572 | 447253 | 31549 |
| MGAT4C | 283530 | 638103 | 12573 | 490547 | 31550 |
| MGAT4C | 283530 | 637661 | 12574 | 489751 | 31551 |
| MGAT4C | 283530 | 636626 | 12575 | 490784 | 31552 |
| MGAT4C | 283530 | 637362 | 12576 | 490416 | 31553 |
| MGAT4C | 283530 | 636211 | 12577 | 489618 | 31554 |
| MGAT4C | 283530 | 636470 | 12578 | 489858 | 31555 |
| MGAT4C | 283530 | 636416 | 12579 | 490212 | 31556 |
| MGAT4C | 283530 | 637408 | 12580 | N/A | |
| MGAT4C | 283530 | 637621 | 12581 | N/A | |
| MGAT4C | 283530 | 637470 | 12582 | N/A | |
| MGAT4C | 283530 | 635762 | 12583 | N/A | |
| MGAT5B | 167889 | 301618 | 12584 | 301618 | 31557 |
| MGAT5B | 167889 | 569840 | 12585 | 456037 | 31558 |
| MGAT5B | 167889 | 565675 | 12586 | 457614 | 31559 |
| MGAT5B | 167889 | 374998 | 12587 | N/A | |
| MGAT5B | 167889 | 428789 | 12588 | 391227 | 31560 |
| MGAT5B | 167889 | 565043 | 12589 | 455631 | 31561 |
| MGAT5B | 167889 | 563627 | 12590 | N/A | |
| MGAT5B | 167889 | 563153 | 12591 | N/A | |
| MGAT5B | 167889 | 568598 | 12592 | N/A | |
| MGLL | 074416 | 434178 | 12593 | 402798 | 31562 |
| MGLL | 074416 | 496306 | 12594 | 417060 | 31563 |
| MGLL | 074416 | 476682 | 12595 | N/A | |

-continued

-continued

| Symbol | ENSG | ENST | SEQ ID | ENSP | SEQ ID |
|---|---|---|---|---|---|
| MGLL | 074416 | 487473 | 12596 | 420125 | 31564 |
| MGLL | 074416 | 398101 | 12597 | 381173 | 31565 |
| MGLL | 074416 | 484451 | 12598 | 419340 | 31566 |
| MGLL | 074416 | 465597 | 12599 | N/A | |
| MGLL | 074416 | 479967 | 12600 | N/A | |
| MGLL | 074416 | 493611 | 12601 | 417689 | 31567 |
| MGLL | 074416 | 476654 | 12602 | N/A | |
| MGLL | 074416 | 494830 | 12603 | 417489 | 31568 |
| MGLL | 074416 | 265052 | 12604 | 265052 | 31569 |
| MGLL | 074416 | 398104 | 12605 | 381176 | 31570 |
| MGLL | 074416 | 453507 | 12606 | 404146 | 31571 |
| MGP | 111341 | 539261 | 12607 | 445907 | 31572 |
| MGP | 111341 | 545199 | 12608 | 445436 | 31573 |
| MGP | 111341 | 228938 | 12609 | 228938 | 31574 |
| MGP | 111341 | 507170 | 12610 | N/A | |
| MGST1 | 008394 | 536371 | 12611 | 442557 | 31575 |
| MGST1 | 008394 | 534835 | 12612 | N/A | |
| MGST1 | 008394 | 543076 | 12613 | 442767 | 31576 |
| MGST1 | 008394 | 396210 | 12614 | 379513 | 31577 |
| MGST1 | 008394 | 539036 | 12615 | N/A | |
| MGST1 | 008394 | 537878 | 12616 | N/A | |
| MGST1 | 008394 | 542256 | 12617 | N/A | |
| MGST1 | 008394 | 539708 | 12618 | N/A | |
| MGST1 | 008394 | 535309 | 12619 | 438308 | 31578 |
| MGST1 | 008394 | 540056 | 12620 | 437988 | 31579 |
| MGST1 | 008394 | 540126 | 12621 | 442970 | 31580 |
| MGST1 | 008394 | 538885 | 12622 | 440443 | 31581 |
| MGST1 | 008394 | 396207 | 12623 | 379510 | 31582 |
| MGST1 | 008394 | 538857 | 12624 | N/A | |
| MGST1 | 008394 | 535624 | 12625 | N/A | |
| MGST1 | 008394 | 624056 | 12626 | N/A | |
| MGST1 | 008394 | 359720 | 12627 | N/A | |
| MGST1 | 008394 | 010404 | 12628 | 010404 | 31583 |
| MGST1 | 008394 | 396209 | 12629 | 379512 | 31584 |
| MIAT | 225783 | 421867 | 12630 | N/A | |
| MIAT | 225783 | 418918 | 12631 | N/A | |
| MIAT | 225783 | 440347 | 12632 | N/A | |
| MIAT | 225783 | 450203 | 12633 | N/A | |
| MIAT | 225783 | 430483 | 12634 | N/A | |
| MIAT | 225783 | 439738 | 12635 | N/A | |
| MIAT | 225783 | 422403 | 12636 | N/A | |
| MIAT | 225783 | 436238 | 12637 | N/A | |
| MIAT | 225783 | 425476 | 12638 | N/A | |
| MIAT | 225783 | 455640 | 12639 | N/A | |
| MIAT | 225783 | 451141 | 12640 | N/A | |
| MIAT | 225783 | 452429 | 12641 | N/A | |
| MIAT | 225783 | 413665 | 12642 | N/A | |
| MIAT | 225783 | 616469 | 12643 | N/A | |
| MIAT | 225783 | 620145 | 12644 | N/A | |
| MIAT | 225783 | 616213 | 12645 | N/A | |
| MIAT | 225783 | 613780 | 12646 | N/A | |
| MIAT | 225783 | 458302 | 12647 | N/A | |
| MIAT | 225783 | 419237 | 12648 | N/A | |
| MIAT | 225783 | 449717 | 12649 | N/A | |
| MIAT | 225783 | 453023 | 12650 | N/A | |
| MICAL2 | 133816 | 532179 | 12651 | 434209 | 31585 |
| MICAL2 | 133816 | 526065 | 12652 | 435270 | 31586 |
| MICAL2 | 133816 | 532945 | 12653 | N/A | |
| MICAL2 | 133816 | 256194 | 12654 | 256194 | 31587 |
| MICAL2 | 133816 | 531732 | 12655 | N/A | |
| MICAL2 | 133816 | 530823 | 12656 | 434957 | 31588 |
| MICAL2 | 133816 | 532420 | 12657 | 433818 | 31589 |
| MICAL2 | 133816 | 527546 | 12658 | 433965 | 31590 |
| MICAL2 | 133816 | 524685 | 12659 | 437229 | 31591 |
| MICAL2 | 133816 | 525119 | 12660 | 433509 | 31592 |
| MICAL2 | 133816 | 533389 | 12661 | 433357 | 31593 |
| MICAL2 | 133816 | 528931 | 12662 | N/A | |
| MICAL2 | 133816 | 532166 | 12663 | N/A | |
| MICAL2 | 133816 | 527195 | 12664 | N/A | |
| MICAL2 | 133816 | 530691 | 12665 | N/A | |
| MICAL2 | 133816 | 524730 | 12666 | N/A | |
| MICAL2 | 133816 | 533219 | 12667 | N/A | |
| MICAL2 | 133816 | 529562 | 12668 | N/A | |
| MICAL2 | 133816 | 526475 | 12669 | N/A | |
| MICAL2 | 133816 | 525075 | 12670 | N/A | |
| MICAL2 | 133816 | 525216 | 12671 | N/A | |

| Symbol | ENSG | ENST | SEQ ID | ENSP | SEQ ID |
|---|---|---|---|---|---|
| MICAL2 | 133816 | 534563 | 12672 | N/A | |
| MICAL2 | 133816 | 525979 | 12673 | N/A | |
| MICAL2 | 133816 | 526672 | 12674 | N/A | |
| MICAL2 | 133816 | 525618 | 12675 | N/A | |
| MICAL2 | 133816 | 530021 | 12676 | N/A | |
| MICAL2 | 133816 | 526604 | 12677 | N/A | |
| MICAL2 | 133816 | 525444 | 12678 | N/A | |
| MICAL2 | 133816 | 379612 | 12679 | 368932 | 31594 |
| MICAL2 | 133816 | 342902 | 12680 | 344894 | 31595 |
| MICAL2 | 133816 | 537344 | 12681 | 441689 | 31596 |
| MICALCL | 133808 | 529028 | 12682 | N/A | |
| MICALCL | 133808 | 533534 | 12683 | 432324 | 31597 |
| MICALCL | 133808 | 256186 | 12684 | 256186 | 31598 |
| MID1 | 101871 | 380779 | 12685 | 370156 | 31599 |
| MID1 | 101871 | 380780 | 12686 | 370157 | 31600 |
| MID1 | 101871 | 380785 | 12687 | 370162 | 31601 |
| MID1 | 101871 | 380787 | 12688 | 370164 | 31602 |
| MID1 | 101871 | 380782 | 12689 | 370159 | 31603 |
| MID1 | 101871 | 479925 | 12690 | N/A | |
| MID1 | 101871 | 413894 | 12691 | 391154 | 31604 |
| MID1 | 101871 | 423614 | 12692 | 387771 | 31605 |
| MID1 | 101871 | 453318 | 12693 | 414521 | 31606 |
| MID1 | 101871 | 610939 | 12694 | 483707 | 31607 |
| MID1 | 101871 | 616003 | 12695 | 484712 | 31608 |
| MID1 | 101871 | 317552 | 12696 | 312678 | 31609 |
| MID2 | 080561 | 451923 | 12697 | 410730 | 31610 |
| MID2 | 080561 | 262843 | 12698 | 262843 | 31611 |
| MID2 | 080561 | 443968 | 12699 | 413976 | 31612 |
| MID2 | 080561 | 474517 | 12700 | N/A | |
| MIDN | 167470 | 586757 | 12701 | 466895 | 31613 |
| MIDN | 167470 | 591446 | 12702 | 467679 | 31614 |
| MIDN | 167470 | 591302 | 12703 | N/A | |
| MIDN | 167470 | 586843 | 12704 | 466835 | 31615 |
| MIDN | 167470 | 590136 | 12705 | N/A | |
| MIDN | 167470 | 300952 | 12706 | 300952 | 31616 |
| MIR136 | 207942 | 385207 | 12707 | N/A | |
| MIR31HG | 171889 | 304425 | 12708 | N/A | |
| MIR346 | 199104 | 362234 | 12709 | N/A | |
| MIR34C | 207562 | 384831 | 12710 | N/A | |
| MIR3671 | 265996 | 580455 | 12711 | N/A | |
| MIR384 | 283242 | 638003 | 12712 | N/A | |
| MIR646HG | 228340 | 426753 | 12713 | N/A | |
| MIR646HG | 228340 | 428772 | 12714 | N/A | |
| MIR646HG | 228340 | 431181 | 12715 | N/A | |
| MIR646HG | 228340 | 427691 | 12716 | N/A | |
| MIR646HG | 228340 | 439507 | 12717 | N/A | |
| MIR646HG | 228340 | 457508 | 12718 | N/A | |
| MIR646HG | 228340 | 458422 | 12719 | N/A | |
| MIR646HG | 228340 | 432910 | 12720 | N/A | |
| MIR646HG | 228340 | 437035 | 12721 | N/A | |
| MIR646HG | 228340 | 421257 | 12722 | N/A | |
| MIR646HG | 228340 | 427820 | 12723 | N/A | |
| MIR6723 | 278791 | 621981 | 12724 | N/A | |
| MIR7-3HG | 176840 | 317292 | 12725 | N/A | |
| MIR7-3HG | 176840 | 586721 | 12726 | N/A | |
| MIR7-3HG | 176840 | 592709 | 12727 | N/A | |
| MIR7-3HG | 176840 | 588711 | 12728 | N/A | |
| MIR7-3HG | 176840 | 589639 | 12729 | N/A | |
| MIR7-3HG | 176840 | 591008 | 12730 | N/A | |
| MIR7-3HG | 176840 | 592663 | 12731 | N/A | |
| MIR7-3HG | 176840 | 588758 | 12732 | N/A | |
| MIR7-3HG | 176840 | 588923 | 12733 | N/A | |
| MIR7-3HG | 176840 | 589368 | 12734 | N/A | |
| MIR9-3HG | 255571 | 536780 | 12735 | N/A | |
| MIR9-3HG | 255571 | 560008 | 12736 | N/A | |
| MIR9-3HG | 255571 | 561327 | 12737 | N/A | |
| MIR9-3HG | 255571 | 560663 | 12738 | N/A | |
| MIR9-3HG | 255571 | 560596 | 12739 | N/A | |
| MIR9-3HG | 255571 | 558692 | 12740 | N/A | |
| MIR9-3HG | 255571 | 538734 | 12741 | N/A | |
| MIR9-3HG | 255571 | 559235 | 12742 | N/A | |
| MIR9-3HG | 255571 | 558754 | 12743 | N/A | |
| MIR9-3HG | 255571 | 558982 | 12744 | N/A | |
| MIR9-3HG | 255571 | 561037 | 12745 | N/A | |
| MIR9-3HG | 255571 | 546186 | 12746 | N/A | |
| MKX | 150051 | 375790 | 12747 | 364946 | 31617 |

465
-continued

466
-continued

| Symbol | ENSG | ENST | SEQ ID | ENSP | SEQ ID | Symbol | ENSG | ENST | SEQ ID | ENSP | SEQ ID |
|---|---|---|---|---|---|---|---|---|---|---|---|
| MKX | 150051 | 460919 | 12748 | 452751 | 31618 | MOG | 204655 | 376898 | 12824 | 366095 | 31678 |
| MKX | 150051 | 561227 | 12749 | 453746 | 31619 | MOG | 204655 | 396701 | 12825 | 379929 | 31679 |
| MKX | 150051 | 419761 | 12750 | 400896 | 31620 | MOG | 204655 | 494692 | 12826 | 417405 | 31680 |
| MLC1 | 100427 | 395876 | 12751 | 379216 | 31621 | MOG | 204655 | 431798 | 12827 | 410866 | 31681 |
| MLC1 | 100427 | 311597 | 12752 | 310375 | 31622 | MOG | 204655 | 476244 | 12828 | N/A | |
| MLC1 | 100427 | 483836 | 12753 | N/A | | MOG | 204655 | 469603 | 12829 | N/A | |
| MLC1 | 100427 | 442311 | 12754 | 401385 | 31623 | MOG | 204655 | 485211 | 12830 | 418872 | 31682 |
| MLC1 | 100427 | 470008 | 12755 | N/A | | MOG | 204655 | 376889 | 12831 | 366086 | 31683 |
| MLLT11 | 213190 | 368921 | 12756 | 357917 | 31624 | MOG | 204655 | 485885 | 12832 | N/A | |
| MLYCD | 103150 | 262430 | 12757 | 262430 | 31625 | MOG | 234623 | 432271 | 12833 | 389221 | 31684 |
| MLYCD | 103150 | 569024 | 12758 | N/A | | MOG | 234623 | 462016 | 12834 | N/A | |
| MMD2 | 136297 | 406755 | 12759 | 385963 | 31626 | MOG | 234623 | 425145 | 12835 | 397101 | 31685 |
| MMD2 | 136297 | 404774 | 12760 | 384690 | 31627 | MOG | 234623 | 489187 | 12836 | N/A | |
| MMD2 | 136297 | 401401 | 12761 | 384141 | 31628 | MOG | 234623 | 452233 | 12837 | 394873 | 31686 |
| MMD2 | 136297 | 612910 | 12762 | 484193 | 31629 | MOG | 234623 | 427061 | 12838 | 395304 | 31687 |
| MMP14 | 157227 | 547279 | 12763 | 450323 | 31630 | MOG | 234623 | 434177 | 12839 | 398197 | 31688 |
| MMP14 | 157227 | 548761 | 12764 | 446989 | 31631 | MOG | 234623 | 430264 | 12840 | 403058 | 31689 |
| MMP14 | 157227 | 547596 | 12765 | N/A | | MOG | 234623 | 414889 | 12841 | 403380 | 31690 |
| MMP14 | 157227 | 311852 | 12766 | 308208 | 31632 | MOG | 234623 | 442629 | 12842 | 399240 | 31691 |
| MMP14 | 157227 | 547074 | 12767 | N/A | | MOG | 234623 | 417635 | 12843 | 401457 | 31692 |
| MMP14 | 157227 | 548162 | 12768 | N/A | | MOG | 234623 | 470893 | 12844 | N/A | |
| MMP15 | 102996 | 219271 | 12769 | 219271 | 31633 | MOG | 234623 | 497074 | 12845 | N/A | |
| MMP15 | 102996 | 570065 | 12770 | 457084 | 31634 | MOG | 234623 | 551175 | 12846 | 448879 | 31693 |
| MMP16 | 156103 | 286614 | 12771 | 286614 | 31635 | MOG | 234096 | 430351 | 12847 | 410268 | 31694 |
| MMP16 | 156103 | 544227 | 12772 | N/A | | MOG | 234096 | 428719 | 12848 | 397723 | 31695 |
| MMP16 | 156103 | 522726 | 12773 | 429147 | 31636 | MOG | 234096 | 418693 | 12849 | 396344 | 31696 |
| MMP16 | 156103 | 520568 | 12774 | N/A | | MOG | 234096 | 450851 | 12850 | 392661 | 31697 |
| MMP2 | 087245 | 570308 | 12775 | 461421 | 31637 | MOG | 234096 | 420045 | 12851 | 390682 | 31698 |
| MMP2 | 087245 | 568715 | 12776 | 457949 | 31638 | MOG | 234096 | 439634 | 12852 | 404957 | 31699 |
| MMP2 | 087245 | 219070 | 12777 | 219070 | 31639 | MOG | 234096 | 417019 | 12853 | 404537 | 31700 |
| MMP2 | 087245 | 564864 | 12778 | 456096 | 31640 | MOG | 234096 | 415546 | 12854 | 404149 | 31701 |
| MMP2 | 087245 | 543485 | 12779 | 444143 | 31641 | MOG | 234096 | 449096 | 12855 | 391898 | 31702 |
| MMP2 | 087245 | 437642 | 12780 | 394237 | 31642 | MOG | 234096 | 494200 | 12856 | N/A | |
| MMP2 | 087245 | 570283 | 12781 | 456518 | 31643 | MOG | 234096 | 477504 | 12857 | N/A | |
| MMP2 | 087245 | 566564 | 12782 | 461915 | 31644 | MOG | 234096 | 476989 | 12858 | N/A | |
| MMP24 | 125966 | 246186 | 12783 | 246186 | 31645 | MOG | 234096 | 477366 | 12859 | N/A | |
| MNS1 | 138587 | 566386 | 12784 | N/A | | MOG | 234096 | 548017 | 12860 | 448732 | 31703 |
| MNS1 | 138587 | 260453 | 12785 | 260453 | 31646 | MOG | 237834 | 488730 | 12861 | N/A | |
| MNS1 | 138587 | 558694 | 12786 | N/A | | MOG | 237834 | 383525 | 12862 | 373017 | 31704 |
| MOBP | 168314 | 451925 | 12787 | 410720 | 31647 | MOG | 237834 | 439884 | 12863 | 398394 | 31705 |
| MOBP | 168314 | 428261 | 12788 | 401312 | 31648 | MOG | 237834 | 473784 | 12864 | N/A | |
| MOBP | 168314 | 420739 | 12789 | 400491 | 31649 | MOG | 237834 | 383521 | 12865 | 373013 | 31706 |
| MOBP | 168314 | 415443 | 12790 | 388148 | 31650 | MOG | 237834 | 400671 | 12866 | 383512 | 31707 |
| MOBP | 168314 | 447324 | 12791 | 409730 | 31651 | MOG | 237834 | 444952 | 12867 | 400564 | 31708 |
| MOBP | 168314 | 383754 | 12792 | 373261 | 31652 | MOG | 237834 | 400669 | 12868 | 383510 | 31709 |
| MOBP | 168314 | 436143 | 12793 | 409071 | 31653 | MOG | 237834 | 412760 | 12869 | 404245 | 31710 |
| MOBP | 168314 | 441980 | 12794 | 388827 | 31654 | MOG | 237834 | 448816 | 12870 | 397837 | 31711 |
| MOBP | 168314 | 311042 | 12795 | 312293 | 31655 | MOG | 237834 | 421858 | 12871 | 403235 | 31712 |
| MOBP | 168314 | 452959 | 12796 | 405549 | 31656 | MOG | 237834 | 479627 | 12872 | N/A | |
| MOBP | 168314 | 424090 | 12797 | 389055 | 31657 | MOG | 237834 | 494392 | 12873 | N/A | |
| MOBP | 168314 | 442631 | 12798 | 413771 | 31658 | MOG | 237834 | 550849 | 12874 | 449683 | 31713 |
| MOBP | 168314 | 479860 | 12799 | N/A | | MOG | 230885 | 427289 | 12875 | 414489 | 31714 |
| MOG | 236561 | 447285 | 12800 | 401609 | 31659 | MOG | 230885 | 482220 | 12876 | N/A | |
| MOG | 236561 | 419309 | 12801 | 395005 | 31660 | MOG | 230885 | 423895 | 12877 | 390632 | 31715 |
| MOG | 236561 | 417639 | 12802 | 408039 | 31661 | MOG | 230885 | 472743 | 12878 | N/A | |
| MOG | 236561 | 441138 | 12803 | 402363 | 31662 | MOG | 230885 | 426782 | 12879 | 410699 | 31716 |
| MOG | 236561 | 419274 | 12804 | 411489 | 31663 | MOG | 230885 | 421125 | 12880 | 404362 | 31717 |
| MOG | 236561 | 442244 | 12805 | 391516 | 31664 | MOG | 230885 | 440561 | 12881 | 409534 | 31718 |
| MOG | 236561 | 457090 | 12806 | 415883 | 31665 | MOG | 230885 | 457626 | 12882 | 402139 | 31719 |
| MOG | 236561 | 483865 | 12807 | N/A | | MOG | 230885 | 444674 | 12883 | 390469 | 31720 |
| MOG | 236561 | 470227 | 12808 | N/A | | MOG | 230885 | 458179 | 12884 | 413370 | 31721 |
| MOG | 236561 | 433500 | 12809 | 413364 | 31666 | MOG | 230885 | 440073 | 12885 | 407143 | 31722 |
| MOG | 236561 | 438803 | 12810 | 414862 | 31667 | MOG | 230885 | 493966 | 12886 | N/A | |
| MOG | 236561 | 481712 | 12811 | N/A | | MOG | 230885 | 478704 | 12887 | N/A | |
| MOG | 236561 | 472402 | 12812 | N/A | | MOG | 230885 | 551993 | 12888 | 446871 | 31723 |
| MOG | 236561 | 553111 | 12813 | 447099 | 31668 | MOG | 232641 | 411455 | 12889 | 387448 | 31724 |
| MOG | 204655 | 376917 | 12814 | 366115 | 31669 | MOG | 232641 | 434870 | 12890 | 395146 | 31725 |
| MOG | 204655 | 376903 | 12815 | 366101 | 31670 | MOG | 232641 | 450634 | 12891 | 400681 | 31726 |
| MOG | 204655 | 376888 | 12816 | 366085 | 31671 | MOG | 232641 | 431084 | 12892 | 406627 | 31727 |
| MOG | 204655 | 376894 | 12817 | 366091 | 31672 | MOG | 232641 | 453271 | 12893 | 402247 | 31728 |
| MOG | 204655 | 469353 | 12818 | N/A | | MOG | 232641 | 459677 | 12894 | 420250 | 31729 |
| MOG | 204655 | 396701 | 12819 | 379932 | 31673 | MOG | 232641 | 452744 | 12895 | 389022 | 31730 |
| MOG | 204655 | 483013 | 12820 | 418090 | 31674 | MOG | 232641 | 400668 | 12896 | 383509 | 31731 |
| MOG | 204655 | 490127 | 12821 | 420350 | 31675 | MOG | 232641 | 429153 | 12897 | 390785 | 31732 |
| MOG | 204655 | 416766 | 12822 | 409394 | 31676 | MOG | 232641 | 495495 | 12898 | N/A | |
| MOG | 204655 | 376891 | 12823 | 366088 | 31677 | MOG | 232641 | 497130 | 12899 | N/A | |

| Symbol | ENSG | ENST | SEQ ID | ENSP | SEQ ID |
|---|---|---|---|---|---|
| MOG | 232641 | 425569 | 12900 | N/A | |
| MOG | 232641 | 495080 | 12901 | N/A | |
| MOG | 232641 | 639922 | 12902 | 491870 | 31733 |
| MOG | 137345 | 400691 | 12903 | 383528 | 31734 |
| MOG | 137345 | 383631 | 12904 | 373127 | 31735 |
| MOG | 137345 | 359539 | 12905 | 352534 | 31736 |
| MOG | 137345 | 400687 | 12906 | 383525 | 31737 |
| MOG | 137345 | 400688 | 12907 | 383526 | 31738 |
| MOG | 137345 | 383630 | 12908 | 373126 | 31739 |
| MOG | 137345 | 259891 | 12909 | 259891 | 31740 |
| MOG | 137345 | 415631 | 12910 | 394156 | 31741 |
| MOG | 137345 | 442444 | 12911 | 414146 | 31742 |
| MOG | 137345 | 461235 | 12912 | N/A | |
| MOG | 137345 | 484234 | 12913 | N/A | |
| MOG | 137345 | 492471 | 12914 | N/A | |
| MOG | 137345 | 465504 | 12915 | N/A | |
| MOG | 137345 | 547083 | 12916 | 449213 | 31743 |
| MORF4L2 | 123562 | 360458 | 12917 | 353643 | 31744 |
| MORF4L2 | 123562 | 441076 | 12918 | 391969 | 31745 |
| MORF4L2 | 123562 | 434230 | 12919 | 413664 | 31746 |
| MORF4L2 | 123562 | 418819 | 12920 | 393283 | 31747 |
| MORF4L2 | 123562 | 442614 | 12921 | 400938 | 31748 |
| MORF4L2 | 123562 | 492116 | 12922 | N/A | |
| MORF4L2 | 123562 | 422355 | 12923 | 408607 | 31749 |
| MORF4L2 | 123562 | 474653 | 12924 | N/A | |
| MORF4L2 | 123562 | 467755 | 12925 | N/A | |
| MORF4L2 | 123562 | 498064 | 12926 | N/A | |
| MORF4L2 | 123562 | 488331 | 12927 | N/A | |
| MORF4L2 | 123562 | 422154 | 12928 | 394417 | 31750 |
| MORF4L2 | 123562 | 433176 | 12929 | 415476 | 31751 |
| MORF4L2 | 123562 | 451301 | 12930 | 410532 | 31752 |
| MORF4L2 | 123562 | 423833 | 12931 | 416120 | 31753 |
| MPND | 008382 | 262966 | 12932 | 262966 | 31754 |
| MPND | 008382 | 359935 | 12933 | 353015 | 31755 |
| MPND | 008382 | 599840 | 12934 | 471735 | 31756 |
| MPND | 008382 | 594716 | 12935 | 470987 | 31757 |
| MPND | 008382 | 596722 | 12936 | 471715 | 31758 |
| MPND | 008382 | 597036 | 12937 | 471189 | 31759 |
| MPND | 008382 | 601877 | 12938 | 469230 | 31760 |
| MPND | 008382 | 594162 | 12939 | 469057 | 31761 |
| MPP6 | 105926 | 432190 | 12940 | 395859 | 31762 |
| MPP6 | 105926 | 222644 | 12941 | 222644 | 31763 |
| MPP6 | 105926 | 409761 | 12942 | 386262 | 31764 |
| MPP6 | 105926 | 396475 | 12943 | 379737 | 31765 |
| MPP6 | 105926 | 430180 | 12944 | 391020 | 31766 |
| MPP6 | 105926 | 426450 | 12945 | 400515 | 31767 |
| MPP6 | 105926 | 472674 | 12946 | N/A | |
| MPP6 | 105926 | 464384 | 12947 | 473560 | 31768 |
| MPP6 | 105926 | 625307 | 12948 | 487215 | 31769 |
| MPP7 | 150054 | 375732 | 12949 | 364884 | 31770 |
| MPP7 | 150054 | 496637 | 12950 | 473899 | 31771 |
| MPP7 | 150054 | 375719 | 12951 | 364871 | 31772 |
| MPP7 | 150054 | 441595 | 12952 | 398319 | 31773 |
| MPP7 | 150054 | 481244 | 12953 | N/A | |
| MPP7 | 150054 | 474731 | 12954 | N/A | |
| MPP7 | 150054 | 474682 | 12955 | N/A | |
| MPP7 | 150054 | 337532 | 12956 | 337907 | 31774 |
| MPPED1 | 186732 | 417669 | 12957 | 388137 | 31775 |
| MPPED1 | 186732 | 334209 | 12958 | 335568 | 31776 |
| MPPED1 | 186732 | 447567 | 12959 | 401378 | 31777 |
| MPPED1 | 186732 | 465861 | 12960 | N/A | |
| MPPED1 | 186732 | 480239 | 12961 | N/A | |
| MPPED1 | 186732 | 443721 | 12962 | 400686 | 31778 |
| MPZ | 158887 | 463290 | 12963 | 431538 | 31779 |
| MPZ | 158887 | 533357 | 12964 | 432943 | 31780 |
| MPZ | 158887 | 491222 | 12965 | 431441 | 31781 |
| MPZ | 158887 | 526189 | 12966 | 488104 | 31782 |
| MPZ | 158887 | 476410 | 12967 | N/A | |
| MPZ | 158887 | 488271 | 12968 | N/A | |
| MRAP2 | 135324 | 257776 | 12969 | 257776 | 31783 |
| MRGPRF | 172935 | 309099 | 12970 | 309782 | 31784 |
| MRGPRF | 172935 | 320913 | 12971 | 323414 | 31785 |
| MRGPRF | 172935 | 441623 | 12972 | 403660 | 31786 |
| MRLN | 227877 | 628562 | 12973 | 488429 | 31787 |
| MRLN | 227877 | 430431 | 12974 | 488299 | 31788 |
| MRLN | 227877 | 414264 | 12975 | 488748 | 31789 |

| Symbol | ENSG | ENST | SEQ ID | ENSP | SEQ ID |
|---|---|---|---|---|---|
| MRLN | 227877 | 594536 | 12976 | 488584 | 31790 |
| MRLN | 227877 | 598384 | 12977 | N/A | |
| MRLN | 227877 | 600486 | 12978 | N/A | |
| MRLN | 227877 | 602051 | 12979 | 488673 | 31791 |
| MRLN | 227877 | 599605 | 12980 | 487738 | 31792 |
| MRLN | 227877 | 612853 | 12981 | N/A | |
| MRLN | 227877 | 621566 | 12982 | N/A | |
| MRLN | 227877 | 629130 | 12983 | N/A | |
| MRM2 | 122687 | 467199 | 12984 | N/A | |
| MRM2 | 122687 | 242257 | 12985 | 242257 | 31793 |
| MRM2 | 122687 | 486040 | 12986 | N/A | |
| MRM2 | 122687 | 407040 | 12987 | 384423 | 31794 |
| MRM2 | 122687 | 440306 | 12988 | 392343 | 31795 |
| MRPL18 | 112110 | 476826 | 12989 | N/A | |
| MRPL18 | 112110 | 479638 | 12990 | N/A | |
| MRPL18 | 112110 | 367034 | 12991 | 356001 | 31796 |
| MRPL18 | 112110 | 480842 | 12992 | N/A | |
| MSI1 | 135097 | 257552 | 12993 | 257552 | 31797 |
| MSI1 | 135097 | 546985 | 12994 | 446710 | 31798 |
| MSI1 | 135097 | 546622 | 12995 | N/A | |
| MSMO1 | 052802 | 261507 | 12996 | 261507 | 31799 |
| MSMO1 | 052802 | 507013 | 12997 | 425241 | 31800 |
| MSMO1 | 052802 | 393766 | 12998 | 377361 | 31801 |
| MSMO1 | 052802 | 504317 | 12999 | 423633 | 31802 |
| MSMO1 | 052802 | 505270 | 13000 | 425112 | 31803 |
| MSRA | 175806 | 317173 | 13001 | 313921 | 31804 |
| MSRA | 175806 | 441698 | 13002 | 410912 | 31805 |
| MSRA | 175806 | 518255 | 13003 | 429461 | 31806 |
| MSRA | 175806 | 521209 | 13004 | 435644 | 31807 |
| MSRA | 175806 | 522907 | 13005 | 428214 | 31808 |
| MSRA | 175806 | 528246 | 13006 | 436839 | 31809 |
| MSRA | 175806 | 523637 | 13007 | N/A | |
| MSRA | 175806 | 382490 | 13008 | 371930 | 31810 |
| MSRA | 175806 | 521686 | 13009 | 427725 | 31811 |
| MSRA | 175806 | 517594 | 13010 | N/A | |
| MSX2 | 120149 | 239243 | 13011 | 239243 | 31812 |
| MSX2 | 120149 | 507785 | 13012 | 427425 | 31813 |
| MT-CO1 | 198804 | 361624 | 13013 | 354499 | 31814 |
| MT-ND4 | 198886 | 361381 | 13014 | 354961 | 31815 |
| MT2A | 125148 | 561491 | 13015 | 456804 | 31816 |
| MT2A | 125148 | 567300 | 13016 | N/A | |
| MT2A | 125148 | 562017 | 13017 | N/A | |
| MT2A | 125148 | 245185 | 13018 | 245185 | 31817 |
| MT2A | 125148 | 563985 | 13019 | N/A | |
| MT3 | 087250 | 561640 | 13020 | 455353 | 31818 |
| MT3 | 087250 | 565838 | 13021 | 455980 | 31819 |
| MT3 | 087250 | 200691 | 13022 | 200691 | 31820 |
| MT3 | 087250 | 566451 | 13023 | N/A | |
| MT3 | 087250 | 570176 | 13024 | 457164 | 31821 |
| MT3 | 087250 | 566576 | 13025 | N/A | |
| MTCH1 | 137409 | 373616 | 13026 | 362718 | 31822 |
| MTCH1 | 137409 | 373627 | 13027 | 362730 | 31823 |
| MTCH1 | 137409 | 471737 | 13028 | N/A | |
| MTCH1 | 137409 | 418541 | 13029 | 399187 | 31824 |
| MTCH1 | 137409 | 460219 | 13030 | 419739 | 31825 |
| MTCH1 | 137409 | 492754 | 13031 | N/A | |
| MTCH2 | 109919 | 539759 | 13032 | N/A | |
| MTCH2 | 109919 | 302503 | 13033 | 303222 | 31826 |
| MTCH2 | 109919 | 534074 | 13034 | N/A | |
| MTCH2 | 109919 | 525649 | 13035 | N/A | |
| MTCH2 | 109919 | 530428 | 13036 | 432043 | 31827 |
| MTCH2 | 109919 | 533571 | 13037 | N/A | |
| MTFP1 | 242114 | 266263 | 13038 | 266263 | 31828 |
| MTFP1 | 242114 | 614920 | 13039 | N/A | |
| MTFP1 | 242114 | 355143 | 13010 | 347267 | 31829 |
| MTFP1 | 242114 | 412752 | 13041 | 393954 | 31830 |
| MTFP1 | 242114 | 407550 | 13042 | 383926 | 31831 |
| MTFP1 | 242114 | 629597 | 13043 | 487369 | 31832 |
| MTHFD1L | 120254 | 367321 | 13044 | 356290 | 31833 |
| MTHFD1L | 120254 | 367307 | 13045 | 356276 | 31834 |
| MTHFD1L | 120254 | 367308 | 13016 | 356277 | 31835 |
| MTHFD1L | 120254 | 441122 | 13017 | 407070 | 31836 |
| MTHFD1L | 120254 | 423867 | 13018 | 400776 | 31837 |
| MTHFD1L | 120254 | 421497 | 13019 | N/A | |
| MTHFD1L | 120254 | 478643 | 13050 | N/A | |
| MTHFD1L | 120254 | 420192 | 13051 | 395158 | 31838 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| MTHFD1L | 120254 | 453602 | 13052 | 391022 | 31839 | 5 | MTTP | 138823 | 505094 | 13128 | 422782 | 31892 |
| MTHFD1L | 120254 | 450635 | 13053 | 399804 | 31840 | | MTTP | 138823 | 511045 | 13129 | 427679 | 31893 |
| MTHFD1L | 120254 | 618312 | 13054 | 479539 | 31841 | | MTTP | 138823 | 265517 | 13130 | 265517 | 31894 |
| MTHFD1L | 120254 | 611279 | 13055 | 478253 | 31842 | | MTTP | 138823 | 422897 | 13131 | 407350 | 31895 |
| MTHFD2L | 163738 | 429519 | 13056 | 391327 | 31843 | | MTTP | 138823 | 457717 | 13132 | 400821 | 31896 |
| MTHFD2L | 163738 | 490698 | 13057 | N/A | | | MVP | 013364 | 563915 | 13133 | 455819 | 31897 |
| MTHFD2L | 163738 | 475291 | 13058 | N/A | | 10 | MVP | 013364 | 357402 | 13134 | 349977 | 31898 |
| MTHFD2L | 163738 | 429335 | 13059 | 409391 | 31844 | | MVP | 013364 | 566859 | 13135 | 455741 | 31899 |
| MTHFD2L | 163738 | 423607 | 13060 | 387614 | 31845 | | MVP | 013364 | 563096 | 13136 | N/A | |
| MTHFD2L | 163738 | 461101 | 13061 | N/A | | | MVP | 013364 | 566066 | 13137 | 455186 | 31900 |
| MTHFD2L | 163738 | 359107 | 13062 | 352012 | 31846 | | MVP | 013364 | 562463 | 13138 | 457734 | 31901 |
| MTHFD2L | 163738 | 325278 | 13063 | 321984 | 31847 | | MVP | 013364 | 563558 | 13139 | 454825 | 31902 |
| MTHFD2L | 163738 | 484725 | 13064 | N/A | | 15 | MVP | 013364 | 565830 | 13140 | N/A | |
| MTHFD2L | 163738 | 492183 | 13065 | N/A | | | MVP | 013364 | 569887 | 13141 | 455532 | 31903 |
| MTHFD2L | 163738 | 461856 | 13066 | N/A | | | MVP | 013364 | 565164 | 13142 | 454819 | 31904 |
| MTHFD2L | 163738 | 465255 | 13067 | N/A | | | MVP | 013364 | 570234 | 13143 | 456291 | 31905 |
| MTHFD2L | 163738 | 490128 | 13068 | N/A | | | MVP | 013364 | 566252 | 13144 | 457685 | 31906 |
| MTHFD2L | 163738 | 395759 | 13069 | 379108 | 31848 | | MVP | 013364 | 566554 | 13145 | N/A | |
| MTHFD2L | 163738 | 433372 | 13070 | 405692 | 31849 | 20 | MVP | 013364 | 569612 | 13146 | N/A | |
| MTHFSD | 103248 | 360900 | 13071 | 354152 | 31850 | | MVP | 013364 | 563123 | 13147 | 458583 | 31907 |
| MTHFSD | 103248 | 625049 | 13072 | N/A | | | MVP | 013364 | 570061 | 13148 | N/A | |
| MTHFSD | 103248 | 546093 | 13073 | 438761 | 31851 | | MVP | 013364 | 568068 | 13149 | N/A | |
| MTHFSD | 103248 | 634347 | 13074 | 489295 | 31852 | | MVP | 013364 | 395353 | 13150 | 378760 | 31908 |
| MTHFSD | 103248 | 543303 | 13075 | 444003 | 31853 | | MVP | 013364 | 629059 | 13151 | 486166 | 31909 |
| MTHFSD | 103248 | 381214 | 13076 | 370612 | 31854 | | MXD1 | 059728 | 435990 | 13152 | 410672 | 31910 |
| MTHFSD | 103248 | 566050 | 13077 | 456910 | 31855 | 25 | MXD1 | 059728 | 264444 | 13153 | 264444 | 31911 |
| MTHFSD | 103248 | 567539 | 13078 | 454593 | 31856 | | MXD1 | 059728 | 409442 | 13154 | 386523 | 31912 |
| MTHFSD | 103248 | 562096 | 13079 | N/A | | | MXD1 | 059728 | 410000 | 13155 | N/A | |
| MTHFSD | 103248 | 562940 | 13080 | 456652 | 31857 | | MXD1 | 059728 | 465446 | 13156 | N/A | |
| MTHFSD | 103248 | 566469 | 13081 | 455940 | 31858 | | MXD1 | 059728 | 540449 | 13157 | 443935 | 31913 |
| MTHFSD | 103248 | 569000 | 13082 | 454807 | 31859 | | MXD4 | 123933 | 337190 | 13158 | 337889 | 31914 |
| MTHFSD | 103248 | 568798 | 13083 | 455262 | 31860 | 30 | MXD4 | 123933 | 513372 | 13159 | N/A | |
| MTHFSD | 103248 | 562994 | 13084 | 456628 | 31861 | | MXD4 | 123933 | 513380 | 13160 | 422660 | 31915 |
| MTHFSD | 103248 | 561522 | 13085 | 454429 | 31862 | | MXD4 | 123933 | 515378 | 13161 | N/A | |
| MTHFSD | 103248 | 564364 | 13086 | 458104 | 31863 | | MXD4 | 123933 | 510822 | 13162 | 421209 | 31916 |
| MTHFSD | 103248 | 568037 | 13087 | 480673 | 31864 | | MXRA8 | 162576 | 474033 | 13163 | N/A | |
| MTHFSD | 103248 | 561989 | 13088 | 455208 | 31865 | | MXRA8 | 162576 | 309212 | 13164 | 307887 | 31917 |
| MTHFSD | 103248 | 565482 | 13089 | 457794 | 31866 | 35 | MXRA8 | 162576 | 445648 | 13165 | 399229 | 31918 |
| MTHFSD | 103248 | 561848 | 13090 | N/A | | | MXRA8 | 162576 | 477278 | 13166 | 436135 | 31919 |
| MTRF1 | 120662 | 379480 | 13091 | 368793 | 31867 | | MXRA8 | 162576 | 473097 | 13167 | N/A | |
| MTRF1 | 120662 | 473492 | 13092 | N/A | | | MXRA8 | 162576 | 478517 | 13168 | N/A | |
| MTRF1 | 120662 | 379477 | 13093 | 368790 | 31868 | | MXRA8 | 162576 | 476718 | 13169 | N/A | |
| MTRF1 | 120662 | 239852 | 13094 | 481161 | 31869 | | MXRA8 | 162576 | 464351 | 13170 | N/A | |
| MTRF1 | 120662 | 480434 | 13095 | 482339 | 31870 | 40 | MXRA8 | 162576 | 460473 | 13171 | N/A | |
| MTRF1 | 120662 | 452359 | 13096 | 399279 | 31871 | | MXRA8 | 162576 | 342753 | 13172 | 344998 | 31920 |
| MTRF1 | 120662 | 497679 | 13097 | 484414 | 31872 | | MYBPC1 | 196091 | 547405 | 13173 | 448175 | 31921 |
| MTRF1 | 120662 | 492827 | 13098 | N/A | | | MYBPC1 | 196091 | 452455 | 13174 | 400908 | 31922 |
| MTRF1 | 120662 | 498245 | 13099 | N/A | | | MYBPC1 | 196091 | 547627 | 13175 | N/A | |
| MTRF1 | 120662 | 430347 | 13100 | 400031 | 31873 | | MYBPC1 | 196091 | 392934 | 13176 | 376665 | 31923 |
| MTRNR2L6 | 282017 | 633925 | 13101 | 488809 | 31874 | | MYBPC1 | 196091 | 547509 | 13177 | 447362 | 31924 |
| MTRNR2L6 | 270672 | 604952 | 13102 | 473686 | 31875 | 45 | MYBPC1 | 196091 | 361685 | 13178 | 354845 | 31925 |
| MTRNR2L8 | 255823 | 536684 | 13103 | 490876 | 31876 | | MYBPC1 | 196091 | 550501 | 13179 | N/A | |
| MTSS1 | 170873 | 378017 | 13104 | 367256 | 31877 | | MYBPC1 | 196091 | 549145 | 13180 | 447660 | 31926 |
| MTSS1 | 170873 | 518547 | 13105 | 429064 | 31878 | | MYBPC1 | 196091 | 553190 | 13181 | 447900 | 31927 |
| MTSS1 | 170873 | 520771 | 13106 | N/A | | | MYBPC1 | 196091 | 545503 | 13182 | 440034 | 31928 |
| MTSS1 | 170873 | 519168 | 13107 | 428685 | 31879 | | MYBPC1 | 196091 | 536007 | 13183 | 446128 | 31929 |
| MTSS1 | 170873 | 325064 | 13108 | 322804 | 31880 | 50 | MYBPC1 | 196091 | 541119 | 13184 | 442847 | 31930 |
| MTSS1 | 170873 | 431961 | 13109 | 393606 | 31881 | | MYBPC1 | 196091 | 361466 | 13185 | 354849 | 31931 |
| MTSS1 | 170873 | 523587 | 13110 | N/A | | | MYBPC1 | 196091 | 551300 | 13186 | 447116 | 31932 |
| MTSS1 | 170873 | 524090 | 13111 | 428319 | 31882 | | MYBPC1 | 196091 | 550270 | 13187 | 449702 | 31933 |
| MTSS1 | 170873 | 523179 | 13112 | 428348 | 31883 | | MYBPC1 | 196091 | 552198 | 13188 | N/A | |
| MTSS1 | 170873 | 520094 | 13113 | N/A | | | MYBPC1 | 196091 | 550312 | 13189 | N/A | |
| MTSS1 | 170873 | 522722 | 13114 | N/A | | 55 | MYBPC1 | 196091 | 548834 | 13190 | N/A | |
| MTSS1 | 170873 | 522118 | 13115 | 428145 | 31884 | | MYBPC1 | 196091 | 550812 | 13191 | N/A | |
| MTSS1 | 170873 | 519226 | 13116 | N/A | | | MYBPC1 | 196091 | 548298 | 13192 | N7A | |
| MTSS1 | 170873 | 522162 | 13117 | 429752 | 31885 | | MYBPC1 | 196091 | 548532 | 13193 | N/A | |
| MTSS1 | 170873 | 529463 | 13118 | N/A | | | MYBPC1 | 196091 | 549608 | 13194 | N/A | |
| MTSS1 | 170873 | 519671 | 13119 | N/A | | | MYBPC1 | 196091 | 550514 | 13195 | 447404 | 31934 |
| MTSS1 | 170873 | 524243 | 13120 | N/A | | 60 | MYCL | 116990 | 397332 | 13196 | 380494 | 31935 |
| MTSS1 | 170873 | 472084 | 13121 | N/A | | | MYCL | 116990 | 372816 | 13197 | 361903 | 31936 |
| MTTP | 138823 | 513404 | 13122 | 424972 | 31886 | | MYCL | 116990 | 372815 | 13198 | 361902 | 31937 |
| MTTP | 138823 | 505142 | 13123 | 425987 | 31887 | | MYCL | 116990 | 450953 | 13199 | 434375 | 31938 |
| MTTP | 138823 | 506883 | 13124 | 426755 | 31888 | | MYH11 | 276480 | 612165 | 13200 | 478092 | 31939 |
| MTTP | 138823 | 515141 | 13125 | 425642 | 31889 | | MYH11 | 276480 | 621545 | 13201 | 478109 | 31940 |
| MTTP | 138823 | 504724 | 13126 | 422667 | 31890 | 65 | MYH11 | 276480 | 632764 | 13202 | N/A | |
| MTTP | 138823 | 511610 | 13127 | 422178 | 31891 | | MYH11 | 276480 | 616422 | 13203 | 478816 | 31941 |

| Symbol | ENSG | ENST | SEQ ID | ENSP | SEQ ID |
|---|---|---|---|---|---|
| MYH11 | 276480 | 634050 | 13204 | 488461 | 31942 |
| MYH11 | 276480 | 631693 | 13205 | N/A | |
| MYH11 | 276480 | 633845 | 13206 | N/A | |
| MYH11 | 276480 | 632352 | 13207 | N/A | |
| MYH11 | 276480 | 632632 | 13208 | N/A | |
| MYH11 | 276480 | 631759 | 13209 | N/A | |
| MYH11 | 276480 | 633799 | 13210 | N/A | |
| MYH11 | 133392 | 396324 | 13211 | 379616 | 31943 |
| MYH11 | 133392 | 452625 | 13212 | 407821 | 31944 |
| MYH11 | 133392 | 573908 | 13213 | N/A | |
| MYH11 | 133392 | 576790 | 13214 | 458731 | 31945 |
| MYH11 | 133392 | 300036 | 13215 | 300036 | 31946 |
| MYH11 | 133392 | 576164 | 13216 | N/A | |
| MYH11 | 133392 | 571275 | 13217 | N/A | |
| MYH11 | 133392 | 574119 | 13218 | N/A | |
| MYH11 | 133392 | 570785 | 13219 | N/A | |
| MYH11 | 133392 | 571910 | 13220 | N/A | |
| MYH11 | 133392 | 571505 | 13221 | N/A | |
| MYH14 | 105357 | 598205 | 13222 | 472543 | 31947 |
| MYH14 | 105357 | 599920 | 13223 | 469573 | 31948 |
| MYH14 | 105357 | 601313 | 13224 | 470298 | 31949 |
| MYH14 | 105357 | 596571 | 13225 | 472819 | 31950 |
| MYH14 | 105357 | 595016 | 13226 | N/A | |
| MYH14 | 105357 | 597072 | 13227 | N/A | |
| MYH14 | 105357 | 425460 | 13228 | 407879 | 31951 |
| MYH14 | 105357 | 376970 | 13229 | 366169 | 31952 |
| MYH14 | 105357 | 262269 | 13230 | 262269 | 31953 |
| MYH14 | 105357 | 440075 | 13231 | 406273 | 31954 |
| MYH6 | 197616 | 356287 | 13232 | 348634 | 31955 |
| MYH6 | 197616 | 557461 | 13233 | N/A | |
| MYH6 | 197616 | 405093 | 13234 | 386041 | 31956 |
| MYLIP | 007944 | 356840 | 13235 | 349298 | 31957 |
| MYLIP | 007944 | 349606 | 13236 | 008686 | 31958 |
| MYO10 | 145555 | 513610 | 13237 | 421280 | 31959 |
| MYO10 | 145555 | 515803 | 13238 | 425051 | 31960 |
| MYO10 | 145555 | 505695 | 13239 | 421170 | 31961 |
| MYO10 | 145555 | 513882 | 13240 | 421309 | 31962 |
| MYO10 | 145555 | 506343 | 13241 | N/A | |
| MYO10 | 145555 | 512061 | 13242 | N/A | |
| MYO10 | 145555 | 510401 | 13243 | N/A | |
| MYO10 | 145555 | 508318 | 13244 | N/A | |
| MYO10 | 145555 | 511972 | 13245 | N/A | |
| MYO10 | 145555 | 502436 | 13246 | 426783 | 31963 |
| MYO10 | 145555 | 507288 | 13247 | 426664 | 31964 |
| MYO10 | 145555 | 274203 | 13248 | 274203 | 31965 |
| MYO16 | 041515 | 251041 | 13249 | 251041 | 31966 |
| MYO16 | 041515 | 357550 | 13250 | 350160 | 31967 |
| MYO16 | 041515 | 467639 | 13251 | N/A | |
| MYO16 | 041515 | 375857 | 13252 | N/A | |
| MYO16 | 041515 | 482793 | 13253 | N/A | |
| MYO16 | 041515 | 356711 | 13254 | 349145 | 31968 |
| MYO16 | 011515 | 457511 | 13255 | 401633 | 31969 |
| MYO16 | 282848 | 634397 | 13256 | 489329 | 31970 |
| MYO16 | 282848 | 634615 | 13257 | 488923 | 31971 |
| MYO16 | 282848 | 634825 | 13258 | 489279 | 31972 |
| MYO16 | 282848 | 635050 | 13259 | 488918 | 31973 |
| MYO16 | 282848 | 634250 | 13260 | N/A | |
| MYO16 | 282848 | 635544 | 13261 | N/A | |
| MYO16 | 282848 | 634599 | 13262 | N/A | |
| MYO1D | 176658 | 318217 | 13263 | 324527 | 31974 |
| MYO1D | 176658 | 394649 | 13264 | 464741 | 31975 |
| MYO1D | 176658 | 577576 | 13265 | N/A | |
| MYO1D | 176658 | 577352 | 13266 | N/A | |
| MYO1D | 176658 | 579584 | 13267 | 464305 | 31976 |
| MYO1D | 176658 | 580547 | 13268 | N/A | |
| MYO1D | 176658 | 581059 | 13269 | N/A | |
| MYO1D | 176658 | 582217 | 13270 | N/A | |
| MYO1D | 176658 | 623444 | 13271 | N/A | |
| MYO1D | 176658 | 585094 | 13272 | N/A | |
| MYO1D | 176658 | 577252 | 13273 | 464346 | 31977 |
| MYO1D | 176658 | 580538 | 13274 | N/A | |
| MYO1D | 176658 | 584232 | 13275 | N/A | |
| MYO1D | 176658 | 583611 | 13276 | N/A | |
| MYO1D | 176658 | 582751 | 13277 | N/A | |
| MYO1D | 176658 | 583621 | 13278 | 462055 | 31978 |
| MYO7A | 137474 | 409709 | 13279 | 386331 | 31979 |

| Symbol | ENSG | ENST | SEQ ID | ENSP | SEQ ID |
|---|---|---|---|---|---|
| MYO7A | 137474 | 409893 | 13280 | 386689 | 31980 |
| MYO7A | 137474 | 458637 | 13281 | 392185 | 31981 |
| MYO7A | 137474 | 409619 | 13282 | 386635 | 31982 |
| MYO7A | 137474 | 481328 | 13283 | N/A | |
| MYO7A | 137474 | 458169 | 13284 | 417017 | 31983 |
| MYO7A | 137474 | 467137 | 13285 | N/A | |
| MYO7A | 137474 | 605744 | 13286 | N/A | |
| MYO7A | 137474 | 526863 | 13287 | N/A | |
| MYO7A | 137474 | 481532 | 13288 | N/A | |
| MYO7A | 137474 | 620575 | 13289 | 477640 | 31984 |
| MYOT | 120729 | 239926 | 13290 | 239926 | 31985 |
| MYOT | 120729 | 421631 | 13291 | 391185 | 31986 |
| MYOT | 120729 | 511625 | 13292 | N/A | |
| MYOT | 120729 | 509812 | 13293 | N/A | |
| MYOT | 120729 | 515645 | 13294 | 426281 | 31987 |
| MYOT | 120729 | 511254 | 13295 | N/A | |
| MYOT | 120729 | 503748 | 13296 | N/A | |
| MYOT | 120729 | 508938 | 13297 | N/A | |
| MYRF | 124920 | 537766 | 13298 | N/A | |
| MYRF | 124920 | 278836 | 13299 | 278836 | 31988 |
| MYRF | 124920 | 265460 | 13300 | 265460 | 31989 |
| MYRF | 124920 | 389602 | 13301 | 374253 | 31990 |
| MYRF | 124920 | 536352 | 13302 | N/A | |
| MYRF | 124920 | 537318 | 13303 | N/A | |
| MYRF | 124920 | 546247 | 13304 | N/A | |
| MYRF | 124920 | 539361 | 13305 | N/A | |
| MYRIP | 170011 | 444716 | 13306 | 398665 | 31991 |
| MYRIP | 170011 | 302541 | 13307 | 301972 | 31992 |
| MYRIP | 170011 | 425621 | 13308 | 389323 | 31993 |
| MYRIP | 170011 | 458441 | 13309 | 400916 | 31994 |
| MYRIP | 170011 | 458292 | 13310 | 413392 | 31995 |
| MYRIP | 170011 | 475082 | 13311 | N/A | |
| MYRIP | 170011 | 459828 | 13312 | N/A | |
| MYRIP | 170011 | 482033 | 13313 | N/A | |
| MYRIP | 170011 | 396217 | 13314 | 379519 | 31996 |
| MYRIP | 170011 | 539167 | 13315 | 438297 | 31997 |
| MYT1 | 196132 | 360149 | 13316 | 353269 | 31998 |
| MYT1 | 196132 | 328439 | 13317 | 327465 | 31999 |
| MYT1 | 196132 | 610671 | 13318 | N/A | |
| MYT1 | 196132 | 622439 | 13319 | 480510 | 32000 |
| MYT1 | 196132 | 536311 | 13320 | 442412 | 32001 |
| MYT1 | 276876 | 616597 | 13321 | 481863 | 32002 |
| MYT1 | 276876 | 613234 | 13322 | 477771 | 32003 |
| MYT1 | 276876 | 630159 | 13323 | N/A | |
| MYT1 | 276876 | 621996 | 13324 | 478819 | 32004 |
| MYT1 | 276876 | 616648 | 13325 | 483021 | 32005 |
| MYT1L | 186487 | 399161 | 13326 | 382114 | 32006 |
| MYT1L | 186487 | 407844 | 13327 | 384219 | 32007 |
| MYT1L | 186487 | 399157 | 13328 | 382111 | 32008 |
| MYT1L | 186487 | 428368 | 13329 | 396103 | 32009 |
| MYT1L | 186487 | 471668 | 13330 | N/A | |
| MYT1L | 186487 | 602387 | 13331 | 473409 | 32010 |
| MYT1L | 186487 | 470954 | 13332 | N/A | |
| MYT1L | 186487 | 490585 | 13333 | N/A | |
| MYT1L | 186487 | 485547 | 13334 | N/A | |
| MYT1L | 186487 | 485348 | 13335 | N/A | |
| MYT1L | 186487 | 479156 | 13336 | N/A | |
| MYT1L | 186487 | 476547 | 13337 | N/A | |
| MYT1L | 186487 | 460585 | 13338 | N/A | |
| NAA20 | 173418 | 334982 | 13339 | 335636 | 32011 |
| NAA20 | 173418 | 484480 | 13340 | N/A | |
| NAA20 | 173418 | 310450 | 13341 | 311027 | 32012 |
| NAA20 | 173418 | 463154 | 13342 | N/A | |
| NAA20 | 173418 | 480550 | 13343 | N/A | |
| NAA20 | 173418 | 398602 | 13344 | 381603 | 32013 |
| NAA20 | 173418 | 481837 | 13345 | N/A | |
| NAB2 | 166886 | 300131 | 13346 | 300131 | 32014 |
| NAB2 | 166886 | 555857 | 13347 | N/A | |
| NAB2 | 166886 | 342556 | 13348 | 341491 | 32015 |
| NAB2 | 166886 | 554718 | 13349 | N/A | |
| NAB2 | 166886 | 554839 | 13350 | N/A | |
| NAF1 | 145414 | 509434 | 13351 | 427518 | 32016 |
| NAF1 | 145414 | 422287 | 13352 | 408963 | 32017 |
| NAF1 | 145414 | 274054 | 13353 | 274054 | 32018 |
| NAF1 | 145414 | 509884 | 13354 | N/A | |
| NAF1 | 145414 | 509232 | 13355 | N/A | |

| Symbol | ENSG | ENST | SEQ ID | ENSP | SEQ ID | Symbol | ENSG | ENST | SEQ ID | ENSP | SEQ ID |
|---|---|---|---|---|---|---|---|---|---|---|---|
| NAF1 | 145414 | 502973 | 13356 | N/A | | NCALD | 104490 | 522252 | 13432 | 428598 | 32057 |
| NAMA | 271086 | 603491 | 13357 | N/A | | NCALD | 104490 | 517822 | 13433 | 428312 | 32058 |
| NAMA | 271086 | 605377 | 13358 | N/A | | NCALD | 104490 | 524209 | 13434 | 429493 | 32059 |
| NAMA | 271086 | 604237 | 13359 | N/A | | NCALD | 104490 | 517531 | 13435 | 429245 | 32060 |
| NAMA | 271086 | 604258 | 13360 | N/A | | NCALD | 104490 | 521964 | 13436 | 430064 | 32061 |
| NAMA | 271086 | 605707 | 13361 | N/A | | NCALD | 104490 | 519098 | 13437 | 430534 | 32062 |
| NAMA | 271086 | 604009 | 13362 | N/A | | NCALD | 104490 | 523923 | 13438 | 428193 | 32063 |
| NAMA | 271086 | 605043 | 13363 | N/A | | NCALD | 104490 | 520346 | 13439 | 430365 | 32064 |
| NAMPT | 105835 | 222553 | 13364 | 222553 | 32019 | NCALD | 104490 | 518661 | 13440 | 428093 | 32065 |
| NAMPT | 105835 | 463871 | 13365 | N/A | | NCALD | 104490 | 522206 | 13441 | 429296 | 32066 |
| NAMPT | 105835 | 354289 | 13366 | 346242 | 32020 | NCALD | 104490 | 524137 | 13442 | 430578 | 32067 |
| NAMPT | 105835 | 491027 | 13367 | N/A | | NCALD | 104490 | 522078 | 13443 | 429162 | 32068 |
| NAMPT | 105835 | 467730 | 13368 | N/A | | NCALD | 104490 | 523645 | 13444 | 429347 | 32069 |
| NAMPT | 105835 | 484527 | 13369 | N/A | | NCALD | 104490 | 518952 | 13445 | N/A | |
| NAMPT | 105835 | 393618 | 13370 | N/A | | NCALD | 104490 | 521957 | 13446 | N/A | |
| NAMPT | 105835 | 441045 | 13371 | N/A | | NCALD | 104490 | 521371 | 13447 | N/A | |
| NAMPT | 105835 | 486949 | 13372 | N/A | | NCALD | 104490 | 524101 | 13448 | N/A | |
| NAMPT | 105835 | 489358 | 13373 | N/A | | NCALD | 104490 | 517639 | 13449 | N/A | |
| NAMPT | 105835 | 424768 | 13374 | 390591 | 32021 | NCALD | 104490 | 395923 | 13450 | 379256 | 32070 |
| NAMPT | 105835 | 489732 | 13375 | N/A | | NCALD | 104490 | 311028 | 13451 | 310587 | 32071 |
| NAMPT | 105835 | 417537 | 13376 | 390896 | 32022 | NCAM2 | 154654 | 400546 | 13452 | 383392 | 32072 |
| NAPA | 105402 | 263354 | 13377 | 263354 | 32023 | NCAM2 | 154654 | 486367 | 13453 | N/A | |
| NAPA | 105402 | 597778 | 13378 | N/A | | NCAM2 | 154654 | 461281 | 13454 | N/A | |
| NAPA | 105402 | 594217 | 13379 | 472235 | 32024 | NCAM2 | 154654 | 484983 | 13455 | N/A | |
| NAPA | 105402 | 597271 | 13380 | N/A | | NCAM2 | 154654 | 284894 | 13456 | 284894 | 32073 |
| NAPA | 105402 | 595227 | 13381 | 471520 | 32025 | NCAN | 130287 | 252575 | 13457 | 252575 | 32074 |
| NAPA | 105402 | 594001 | 13382 | 470654 | 32026 | NCAN | 130287 | 590187 | 13458 | N/A | |
| NAPA | 105402 | 593761 | 13383 | 472667 | 32027 | NCAN | 130287 | 588231 | 13459 | 465599 | 32075 |
| NAPA | 105402 | 593905 | 13384 | N/A | | NCAN | 130287 | 585410 | 13460 | N/A | |
| NAPA | 105402 | 594155 | 13385 | 471261 | 32028 | NCEH1 | 144959 | 475381 | 13461 | 418571 | 32076 |
| NAPA | 105402 | 601208 | 13386 | 470665 | 32029 | NCEH1 | 144959 | 470419 | 13462 | N/A | |
| NAPA | 105402 | 598615 | 13387 | 470946 | 32030 | NCEH1 | 144959 | 424772 | 13463 | 392934 | 32077 |
| NAPA | 105402 | 602082 | 13388 | N/A | | NCEH1 | 144959 | 421723 | 13464 | 402196 | 32078 |
| NAPA | 105402 | 602174 | 13389 | N/A | | NCEH1 | 144959 | 538775 | 13465 | 442464 | 32079 |
| NAPA | 105402 | 595826 | 13390 | N/A | | NCEH1 | 144959 | 543711 | 13466 | 443227 | 32080 |
| NAPA | 105402 | 597118 | 13391 | 471018 | 32031 | NCKAP5 | 176771 | 640590 | 13467 | 490966 | 32081 |
| NAPA | 105402 | 596892 | 13392 | N/A | | NCKAP5 | 176771 | 409261 | 13468 | 387128 | 32082 |
| NAPA | 105402 | 594288 | 13393 | N/A | | NCKAP5 | 176771 | 639875 | 13469 | 492746 | 32083 |
| NAPA | 105402 | 594740 | 13394 | N/A | | NCKAP5 | 176771 | 409213 | 13470 | 386952 | 32084 |
| NAPA | 105402 | 597274 | 13395 | 470954 | 32032 | NCKAP5 | 176771 | 473859 | 13471 | N/A | |
| NAPA | 105402 | 601927 | 13396 | N/A | | NCKAP5 | 176771 | 427594 | 13472 | 399070 | 32085 |
| NAPA | 105402 | 593785 | 13397 | N/A | | NCKAP5 | 176771 | 358991 | 13473 | 351882 | 32086 |
| NAPA | 105402 | 597160 | 13398 | N/A | | NCKAP5 | 176771 | 317721 | 13474 | 380603 | 32087 |
| NARS2 | 137513 | 281038 | 13399 | 281038 | 32033 | NCKAP5 | 176771 | 405974 | 13475 | 385692 | 32088 |
| NARS2 | 137513 | 529771 | 13400 | 435298 | 32034 | NDEL1 | 166579 | 582812 | 13476 | 462052 | 32089 |
| NARS2 | 137513 | 528850 | 13401 | 432635 | 32035 | NDEL1 | 166579 | 579150 | 13477 | N/A | |
| NARS2 | 137513 | 525345 | 13402 | 436114 | 32036 | NDEL1 | 166579 | 580237 | 13478 | 464154 | 32090 |
| NARS2 | 137513 | 529880 | 13403 | 432240 | 32037 | NDEL1 | 166579 | 582665 | 13479 | 463430 | 32091 |
| NARS2 | 137513 | 529571 | 13404 | 433478 | 32038 | NDEL1 | 166579 | 579880 | 13480 | N/A | |
| NARS2 | 137513 | 526709 | 13405 | N/A | | NDEL1 | 166579 | 334527 | 13481 | 333982 | 32092 |
| NAV2 | 166833 | 360655 | 13406 | 353871 | 32039 | NDEL1 | 166579 | 585098 | 13482 | 463492 | 32093 |
| NAV2 | 166833 | 396085 | 13407 | 379394 | 32010 | NDEL1 | 166579 | 380025 | 13483 | 369364 | 32094 |
| NAV2 | 166833 | 349880 | 13408 | 309577 | 32041 | NDEL1 | 166579 | 402554 | 13484 | 384963 | 32095 |
| NAV2 | 166833 | 396087 | 13409 | 379396 | 32042 | NDEL1 | 166579 | 584866 | 13485 | 462458 | 32096 |
| NAV2 | 166833 | 534229 | 13410 | N/A | | NDEL1 | 166579 | 582490 | 13486 | 462759 | 32097 |
| NAV2 | 166833 | 528008 | 13411 | N/A | | NDEL1 | 166579 | 580738 | 13487 | N/A | |
| NAV2 | 166833 | 533917 | 13412 | 437316 | 32043 | NDEL1 | 166579 | 583066 | 13488 | N/A | |
| NAV2 | 166833 | 525322 | 13413 | 437136 | 32044 | NDEL1 | 166579 | 580012 | 13489 | 463351 | 32098 |
| NAV2 | 166833 | 530408 | 13414 | 431276 | 32045 | NDEL1 | 166579 | 581189 | 13490 | N/A | |
| NAV2 | 166833 | 534299 | 13415 | N/A | | NDEL1 | 166579 | 582277 | 13491 | 464441 | 32099 |
| NAV2 | 166833 | 526675 | 13416 | N/A | | NDEL1 | 166579 | 581679 | 13492 | 464634 | 32100 |
| NAV2 | 166833 | 533746 | 13417 | N/A | | NDEL1 | 166579 | 583683 | 13493 | N/A | |
| NAV2 | 166833 | 525025 | 13418 | N/A | | NDEL1 | 166579 | 578172 | 13494 | N/A | |
| NAV2 | 166833 | 528923 | 13419 | N/A | | NDNF | 173376 | 379692 | 13495 | 369014 | 32101 |
| NAV2 | 166833 | 540292 | 13420 | 443489 | 32046 | NDNF | 173376 | 506900 | 13496 | N/A | |
| NAV2 | 166833 | 527559 | 13421 | 435395 | 32047 | NDNF | 173376 | 515757 | 13497 | 423352 | 32102 |
| NCALD | 104490 | 220931 | 13422 | 220931 | 32048 | NDNF | 173376 | 511408 | 13498 | 426723 | 32103 |
| NCALD | 104490 | 521599 | 13423 | 428105 | 32049 | NDRG1 | 104419 | 323851 | 13499 | 319977 | 32104 |
| NCALD | 104490 | 519508 | 13424 | 430476 | 32050 | NDRG1 | 104419 | 521438 | 13500 | N/A | |
| NCALD | 104490 | 522951 | 13425 | 428781 | 32051 | NDRG1 | 104419 | 521026 | 13501 | N/A | |
| NCALD | 104490 | 522754 | 13426 | N/A | | NDRG1 | 104419 | 521414 | 13502 | N/A | |
| NCALD | 104490 | 522448 | 13427 | 429466 | 32052 | NDRG1 | 104419 | 519278 | 13503 | N/A | |
| NCALD | 104490 | 520690 | 13428 | 429255 | 32053 | NDRG1 | 104419 | 517599 | 13504 | 429172 | 32105 |
| NCALD | 104490 | 518727 | 13429 | 430731 | 32054 | NDRG1 | 104419 | 414097 | 13505 | 404854 | 32106 |
| NCALD | 104490 | 520425 | 13430 | 430925 | 32055 | NDRG1 | 104419 | 518176 | 13506 | 429007 | 32107 |
| NCALD | 104490 | 518166 | 13431 | 429522 | 32056 | NDRG1 | 104419 | 522476 | 13507 | 427894 | 32108 |

-continued

| Symbol | ENSG | ENST | SEQ ID | ENSP | SEQ ID |
|---|---|---|---|---|---|
| NDRG1 | 104419 | 518066 | 13508 | 431057 | 32109 |
| NDRG1 | 104419 | 523642 | 13509 | N/A | |
| NDRG1 | 104419 | 522665 | 13510 | N/A | |
| NDRG1 | 104419 | 517331 | 13511 | N/A | |
| NDRG1 | 104419 | 522377 | 13512 | 429380 | 32110 |
| NDRG1 | 104419 | 521664 | 13513 | N/A | |
| NDRG1 | 104419 | 520230 | 13514 | 428345 | 32111 |
| NDRG1 | 104419 | 518010 | 13515 | N/A | |
| NDRG1 | 104419 | 518480 | 13516 | 428802 | 32112 |
| NDRG1 | 104419 | 519228 | 13517 | 429994 | 32113 |
| NDRG1 | 104419 | 519580 | 13518 | 429272 | 32114 |
| NDRG1 | 104419 | 522890 | 13519 | 428384 | 32115 |
| NDRG1 | 104419 | 520943 | 13520 | 429840 | 32116 |
| NDRG1 | 104419 | 521544 | 13521 | 429524 | 32117 |
| NDRG1 | 104419 | 517745 | 13522 | N/A | |
| NDRG1 | 104419 | 518094 | 13523 | N/A | |
| NDRG1 | 104419 | 522738 | 13524 | 428991 | 32118 |
| NDRG1 | 104419 | 523892 | 13525 | 430171 | 32119 |
| NDRG1 | 104419 | 523931 | 13526 | N/A | |
| NDRG1 | 104419 | 537882 | 13527 | 437443 | 32120 |
| NDRG2 | 165795 | 298687 | 13528 | 298687 | 32121 |
| NDRG2 | 165795 | 350792 | 13529 | 344620 | 32122 |
| NDRG2 | 165795 | 556716 | 13530 | N/A | |
| NDRG2 | 165795 | 557633 | 13531 | 450835 | 32123 |
| NDRG2 | 165795 | 554104 | 13532 | 452216 | 32124 |
| NDRG2 | 165795 | 555158 | 13533 | 452038 | 32125 |
| NDRG2 | 165795 | 553503 | 13534 | 452306 | 32126 |
| NDRG2 | 165795 | 397853 | 13535 | 380951 | 32127 |
| NDRG2 | 165795 | 360463 | 13536 | 353649 | 32128 |
| NDRG2 | 165795 | 556147 | 13537 | 451712 | 32129 |
| NDRG2 | 165795 | 557353 | 13538 | 450446 | 32130 |
| NDRG2 | 165795 | 554143 | 13539 | 452006 | 32131 |
| NDRG2 | 165795 | 397851 | 13540 | 380949 | 32132 |
| NDRG2 | 165795 | 397847 | 13541 | 380945 | 32133 |
| NDRG2 | 165795 | 298684 | 13542 | 298684 | 32134 |
| NDRG2 | 165795 | 555650 | 13543 | N/A | |
| NDRG2 | 165795 | 397844 | 13544 | 380943 | 32135 |
| NDRG2 | 165795 | 403829 | 13545 | 385889 | 32136 |
| NDRG2 | 165795 | 553593 | 13546 | 452117 | 32137 |
| NDRG2 | 165795 | 553793 | 13547 | N/A | |
| NDRG2 | 165795 | 556008 | 13548 | 451966 | 32138 |
| NDRG2 | 165795 | 557416 | 13549 | N/A | |
| NDRG2 | 165795 | 635386 | 13550 | 489341 | 32139 |
| NDRG2 | 165795 | 556366 | 13551 | 452413 | 32140 |
| NDRG2 | 165795 | 556974 | 13552 | 452362 | 32141 |
| NDRG2 | 165795 | 555026 | 13553 | 451274 | 32142 |
| NDRG2 | 165795 | 554277 | 13554 | N/A | |
| NDRG2 | 165795 | 553867 | 13555 | 450691 | 32143 |
| NDRG2 | 165795 | 449431 | 13556 | 397250 | 32144 |
| NDRG2 | 165795 | 557169 | 13557 | 452334 | 32145 |
| NDRG2 | 165795 | 555695 | 13558 | 451353 | 32146 |
| NDRG2 | 165795 | 555869 | 13559 | 451105 | 32147 |
| NDRG2 | 165795 | 557182 | 13560 | 450545 | 32148 |
| NDRG2 | 165795 | 555733 | 13561 | 452482 | 32149 |
| NDRG2 | 165795 | 555384 | 13562 | 451094 | 32150 |
| NDRG2 | 165795 | 554094 | 13563 | 452278 | 32151 |
| NDRG2 | 165795 | 366204 | 13564 | N/A | |
| NDRG2 | 165795 | 553741 | 13565 | N/A | |
| NDRG2 | 165795 | 557728 | 13566 | N/A | |
| NDRG2 | 165795 | 553567 | 13567 | N/A | |
| NDRG2 | 165795 | 557305 | 13568 | N/A | |
| NDRG2 | 165795 | 557198 | 13569 | N/A | |
| NDRG2 | 165795 | 553442 | 13570 | 450493 | 32152 |
| NDRG2 | 165795 | 556420 | 13571 | 451951 | 32153 |
| NDRG2 | 165795 | 553784 | 13572 | 451059 | 32154 |
| NDRG2 | 165795 | 557149 | 13573 | 452592 | 32155 |
| NDRG2 | 165795 | 555142 | 13574 | 450513 | 32156 |
| NDRG2 | 165795 | 555767 | 13575 | 452053 | 32157 |
| NDRG2 | 165795 | 554531 | 13576 | 451302 | 32158 |
| NDRG2 | 165795 | 557264 | 13577 | 451471 | 32159 |
| NDRG2 | 165795 | 557676 | 13578 | 452548 | 32160 |
| NDRG2 | 165795 | 556924 | 13579 | 450504 | 32161 |
| NDRG2 | 165795 | 556329 | 13580 | 452262 | 32162 |
| NDRG2 | 165795 | 554379 | 13581 | 450929 | 32163 |
| NDRG2 | 165795 | 554398 | 13582 | 451185 | 32164 |
| NDRG2 | 165795 | 554472 | 13583 | 451348 | 32165 |

-continued

| Symbol | ENSG | ENST | SEQ ID | ENSP | SEQ ID |
|---|---|---|---|---|---|
| NDRG2 | 165795 | 554483 | 13584 | 451472 | 32166 |
| NDRG2 | 165795 | 555657 | 13585 | 452247 | 32167 |
| NDRG2 | 165795 | 557616 | 13586 | 451414 | 32168 |
| NDRG2 | 165795 | 557274 | 13587 | 452344 | 32169 |
| NDRG2 | 165795 | 556457 | 13588 | 450852 | 32170 |
| NDRG2 | 165795 | 556688 | 13589 | 451981 | 32171 |
| NDRG2 | 165795 | 553862 | 13590 | N/A | |
| NDRG2 | 165795 | 557669 | 13591 | N/A | |
| NDRG2 | 165795 | 557113 | 13592 | N/A | |
| NDRG2 | 165795 | 553900 | 13593 | N/A | |
| NDRG2 | 165795 | 557318 | 13594 | N/A | |
| NDRG2 | 165795 | 554561 | 13595 | 451163 | 32172 |
| NDRG2 | 165795 | 554419 | 13596 | 452179 | 32173 |
| NDRG2 | 165795 | 553563 | 13597 | 451541 | 32174 |
| NDRG2 | 165795 | 554489 | 13598 | 452302 | 32175 |
| NDRG2 | 165795 | 556561 | 13599 | 450825 | 32176 |
| NDRG2 | 165795 | 554893 | 13600 | 450450 | 32177 |
| NDRG2 | 165795 | 554833 | 13601 | 452458 | 32178 |
| NDRG2 | 165795 | 554415 | 13602 | 452274 | 32179 |
| NDRG2 | 165795 | 557167 | 13603 | N/A | |
| NDRG2 | 165795 | 397858 | 13604 | 380956 | 32180 |
| NDRG2 | 165795 | 397856 | 13605 | 380954 | 32181 |
| NDST3 | 164100 | 394488 | 13606 | N/A | |
| NDST3 | 164100 | 296499 | 13607 | 296499 | 32182 |
| NDST4 | 138653 | 264363 | 13608 | 264363 | 32183 |
| NDST4 | 138653 | 504854 | 13609 | 423218 | 32184 |
| NDST4 | 138653 | 514570 | 13610 | N/A | |
| NDST4 | 138653 | 613194 | 13611 | 483949 | 32185 |
| NEAT1 | 245532 | 499732 | 13612 | N/A | |
| NEAT1 | 245532 | 501122 | 13613 | N/A | |
| NEAT1 | 245532 | 601801 | 13614 | N/A | |
| NEAT1 | 245532 | 612303 | 13615 | N/A | |
| NEAT1 | 245532 | 616315 | 13616 | N/A | |
| NECAB1 | 123119 | 417640 | 13617 | 387380 | 32186 |
| NECAB1 | 123119 | 522729 | 13618 | N/A | |
| NECAB1 | 123119 | 523962 | 13619 | N/A | |
| NECAB1 | 123119 | 521954 | 13620 | N/A | |
| NECAB1 | 123119 | 522820 | 13621 | 428953 | 32187 |
| NECAB1 | 123119 | 521366 | 13622 | 428632 | 32188 |
| NECTIN3 | 177707 | 491525 | 13623 | 418691 | 32189 |
| NECTIN3 | 177707 | 461477 | 13624 | 418327 | 32190 |
| NECTIN3 | 177707 | 485303 | 13625 | 418070 | 32191 |
| NECTIN3 | 177707 | 319792 | 13626 | 321514 | 32192 |
| NECTIN3 | 177707 | 486596 | 13627 | 417572 | 32193 |
| NECTIN3 | 177707 | 493615 | 13628 | 420579 | 32194 |
| NECTIN3 | 177707 | 488016 | 13629 | N/A | |
| NECTIN3 | 177707 | 470618 | 13630 | N/A | |
| NECTIN3 | 177707 | 481766 | 13631 | 420479 | 32195 |
| NECTIN3 | 177707 | 478327 | 13632 | N/A | |
| NECTIN3 | 177707 | 485506 | 13633 | 419829 | 32196 |
| NEDD4 | 069869 | 508871 | 13634 | 422455 | 32197 |
| NEDD4 | 069869 | 503468 | 13635 | 426051 | 32198 |
| NEDD4 | 069869 | 338963 | 13636 | 345530 | 32199 |
| NEDD4 | 069869 | 508342 | 13637 | 424827 | 32200 |
| NEDD4 | 069869 | 435532 | 13638 | 410613 | 32201 |
| NEDD4 | 069869 | 506154 | 13639 | 422705 | 32202 |
| NEDD4 | 069869 | 502612 | 13640 | 424471 | 32203 |
| NEDD4 | 069869 | 514893 | 13641 | N/A | |
| NEDD4 | 069869 | 507063 | 13642 | 421017 | 32204 |
| NEDD4 | 069869 | 513957 | 13643 | N/A | |
| NEDD4 | 069869 | 508075 | 13644 | N/A | |
| NEDD4 | 069869 | 557845 | 13645 | N/A | |
| NEDD4L | 049759 | 356462 | 13646 | 348847 | 32205 |
| NEDD4L | 049759 | 400345 | 13647 | 383199 | 32206 |
| NEDD4L | 049759 | 589054 | 13648 | 465669 | 32207 |
| NEDD4L | 049759 | 617539 | 13649 | 479462 | 32208 |
| NEDD4L | 049759 | 382850 | 13650 | 372301 | 32209 |
| NEDD4L | 049759 | 256830 | 13651 | 256830 | 32210 |
| NEDD4L | 049759 | 590694 | 13652 | N/A | |
| NEDD4L | 049759 | 591989 | 13653 | N/A | |
| NEDD4L | 049759 | 591579 | 13654 | N/A | |
| NEDD4L | 049759 | 592846 | 13655 | 466776 | 32211 |
| NEDD4L | 049759 | 585363 | 13656 | N/A | |
| NEDD4L | 049759 | 588516 | 13657 | N/A | |
| NEDD4L | 049759 | 585594 | 13658 | N/A | |
| NEDD4L | 049759 | 587547 | 13659 | N/A | |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| NEDD4L | 049759 | 435432 | 13660 | 393395 | 32212 | 5 | NETO1 | 166342 | 583169 | 13736 | 464312 | 32252 |
| NEDD4L | 049759 | 357895 | 13661 | 350569 | 32213 | | NETO1 | 166342 | 582281 | 13737 | 462993 | 32253 |
| NEDD4L | 049759 | 586263 | 13662 | 468546 | 32214 | | NETO1 | 166342 | 327305 | 13738 | 313088 | 32254 |
| NEDD4L | 049759 | 456173 | 13663 | 405440 | 32215 | | NETO1 | 166342 | 579730 | 13739 | N/A | |
| NEDD4L | 049759 | 588494 | 13664 | 466789 | 32216 | | NETO1 | 166342 | 397929 | 13740 | 381024 | 32255 |
| NEDD4L | 049759 | 588066 | 13665 | N/A | | | NETO1 | 166342 | 579169 | 13741 | 464188 | 32256 |
| NEDD4L | 049759 | 431212 | 13666 | 389406 | 32217 | 10 | NETO1 | 166342 | 577184 | 13742 | N/A | |
| NEDD4L | 049759 | 586268 | 13667 | 467072 | 32218 | | NEU4 | 204099 | 407683 | 13743 | 385402 | 32257 |
| NEDD4L | 049759 | 587190 | 13668 | 467768 | 32219 | | NEU4 | 204099 | 415936 | 13744 | 397167 | 32258 |
| NEDD4L | 049759 | 585323 | 13669 | N/A | | | NEU4 | 204099 | 405370 | 13745 | 384804 | 32259 |
| NEDD4L | 049759 | 587634 | 13670 | N/A | | | NEU4 | 204099 | 476542 | 13746 | N/A | |
| NEDD4L | 049759 | 635997 | 13671 | 490696 | 32220 | | NEU4 | 204099 | 435855 | 13747 | 394769 | 32260 |
| NEDD4L | 049759 | 592601 | 13672 | N/A | | 15 | NEU4 | 204099 | 618597 | 13748 | N/A | |
| NEDD4L | 049759 | 590020 | 13673 | N/A | | | NEU4 | 204099 | 423583 | 13749 | 397860 | 32261 |
| NEDD4L | 049759 | 587881 | 13674 | 468332 | 32221 | | NEU4 | 204099 | 404257 | 13750 | 385149 | 32262 |
| NEDD4L | 049759 | 589167 | 13675 | N/A | | | NEU4 | 204099 | 391969 | 13751 | 375830 | 32263 |
| NEDD4L | 049759 | 590638 | 13676 | N/A | | | NEU4 | 204099 | 325935 | 13752 | 320318 | 32264 |
| NEDD4L | 049759 | 585970 | 13677 | N/A | | | NEU4 | 204099 | 435934 | 13753 | 412688 | 32265 |
| NEDD4L | 049759 | 587246 | 13678 | N/A | | 20 | NEU4 | 204099 | 435894 | 13754 | 398571 | 32266 |
| NEDD4L | 049759 | 592097 | 13679 | N/A | | | NEU4 | 204099 | 426032 | 13755 | 406678 | 32267 |
| NEDD4L | 049759 | 590248 | 13680 | N/A | | | NEU4 | 204099 | 420288 | 13756 | 388707 | 32268 |
| NEDD4L | 049759 | 588712 | 13681 | N/A | | | NEU4 | 204099 | 494678 | 13757 | N/A | |
| NEDD4L | 049759 | 590506 | 13682 | N/A | | | NEU4 | 204099 | 488997 | 13758 | N/A | |
| NEDD4L | 049759 | 456986 | 13683 | 411947 | 32222 | | NEU4 | 204099 | 428592 | 13759 | 396197 | 32269 |
| NEFH | 100285 | 310624 | 13684 | 311997 | 32223 | | NEU4 | 277926 | 630923 | 13760 | 486602 | 32270 |
| NEFL | 277586 | 610854 | 13685 | 482169 | 32224 | 25 | NEU4 | 277926 | 626222 | 13761 | 486591 | 32271 |
| NEFL | 277586 | 615973 | 13686 | N/A | | | NEU4 | 277926 | 621851 | 13762 | 478409 | 32272 |
| NEFL | 277586 | 639464 | 13687 | 491612 | 32225 | | NEU4 | 277926 | 626675 | 13763 | N/A | |
| NEFL | 277586 | 619417 | 13688 | 483690 | 32226 | | NEU4 | 277926 | 629521 | 13764 | 487192 | 32273 |
| NEFM | 104722 | 221166 | 13689 | 221166 | 32227 | | NEU4 | 277926 | 629786 | 13765 | N/A | |
| NEFM | 104722 | 523467 | 13690 | N/A | | | NEU4 | 277926 | 625452 | 13766 | 485788 | 32274 |
| NEFM | 104722 | 518131 | 13691 | 427872 | 32228 | 30 | NEU4 | 277926 | 616490 | 13767 | 482722 | 32275 |
| NEFM | 104722 | 521540 | 13692 | N/A | | | NEU4 | 277926 | 618866 | 13768 | 483726 | 32276 |
| NEFM | 104722 | 433454 | 13693 | 412295 | 32229 | | NEU4 | 277926 | 626600 | 13769 | 485701 | 32277 |
| NEFM | 104722 | 437366 | 13694 | 410137 | 32230 | | NEU4 | 277926 | 627618 | 13770 | 486118 | 32278 |
| NEGR1 | 172260 | 357731 | 13695 | 350364 | 32231 | | NEU4 | 277926 | 629646 | 13771 | 487199 | 32279 |
| NEGR1 | 172260 | 306821 | 13696 | 305938 | 32232 | | NEU4 | 277926 | 627724 | 13772 | 485934 | 32280 |
| NEGR1 | 172260 | 474357 | 13697 | N/A | | 35 | NEU4 | 277926 | 626195 | 13773 | 487103 | 32281 |
| NEGR1 | 172260 | 478526 | 13698 | N/A | | | NEU4 | 277926 | 631177 | 13774 | N/A | |
| NEGR1 | 172260 | 467479 | 13699 | N/A | | | NEU4 | 277926 | 626326 | 13775 | N/A | |
| NEK2 | 117650 | 366999 | 13700 | 355966 | 32233 | | NEU4 | 277926 | 625706 | 13776 | 485992 | 32282 |
| NEK2 | 117650 | 462283 | 13701 | N/A | | | RBFOX3 | 167281 | 583458 | 13777 | 464186 | 32283 |
| NEK2 | 117650 | 489633 | 13702 | N/A | | | RBFOX3 | 167281 | 582043 | 13778 | 463964 | 32284 |
| NEK2 | 117650 | 366998 | 13703 | 355965 | 32234 | 40 | RBFOX3 | 167281 | 581393 | 13779 | N/A | |
| NEK2 | 117650 | 540251 | 13704 | 440237 | 32235 | | RBFOX3 | 167281 | 580155 | 13780 | 463653 | 32285 |
| NEK4 | 114904 | 233027 | 13705 | 233027 | 32236 | | RBFOX3 | 167281 | 578998 | 13781 | N/A | |
| NEK4 | 114904 | 383721 | 13706 | 373227 | 32237 | | RBFOX3 | 167281 | 582880 | 13782 | 465367 | 32286 |
| NEK4 | 114904 | 461689 | 13707 | 419666 | 32238 | | RBFOX3 | 167281 | 582894 | 13783 | 468693 | 32287 |
| NEK4 | 114904 | 493199 | 13708 | N/A | | | RBFOX3 | 167281 | 584778 | 13784 | 462007 | 32288 |
| NEK4 | 114904 | 487068 | 13709 | 420231 | 32239 | | RBFOX3 | 167281 | 580508 | 13785 | 467872 | 32289 |
| NEK4 | 114904 | 496822 | 13710 | 417119 | 32240 | 45 | RBFOX3 | 167281 | 582139 | 13786 | 464946 | 32290 |
| NEK4 | 114904 | 535191 | 13711 | 437703 | 32241 | | RBFOX3 | 167281 | 578887 | 13787 | N/A | |
| NELL1 | 165973 | 298925 | 13712 | 298925 | 32242 | | RBFOX3 | 167281 | 582344 | 13788 | N/A | |
| NELL1 | 165973 | 357134 | 13713 | 349654 | 32243 | | RBFOX3 | 167281 | 583458 | 13789 | 464186 | 32291 |
| NELL1 | 165973 | 532434 | 13714 | 437170 | 32244 | | RBFOX3 | 167281 | 582043 | 13790 | 463964 | 32292 |
| NELL1 | 165973 | 528046 | 13715 | N/A | | | RBFOX3 | 167281 | 581393 | 13791 | N/A | |
| NELL1 | 165973 | 527873 | 13716 | N/A | | 50 | RBFOX3 | 167281 | 580155 | 13792 | 463653 | 32293 |
| NELL1 | 165973 | 529595 | 13717 | N/A | | | RBFOX3 | 167281 | 578998 | 13793 | N/A | |
| NELL1 | 165973 | 524738 | 13718 | N/A | | | RBFOX3 | 167281 | 582880 | 13794 | 465367 | 32294 |
| NELL1 | 165973 | 528495 | 13719 | N/A | | | RBFOX3 | 167281 | 582894 | 13795 | 468693 | 32295 |
| NELL1 | 165973 | 530672 | 13720 | N/A | | | RBFOX3 | 167281 | 584778 | 13796 | 462007 | 32296 |
| NELL1 | 165973 | 529218 | 13721 | N/A | | | RBFOX3 | 167281 | 580508 | 13797 | 467872 | 32297 |
| NELL1 | 165973 | 534263 | 13722 | N/A | | 55 | RBFOX3 | 167281 | 582139 | 13798 | 464946 | 32298 |
| NELL1 | 165973 | 325319 | 13723 | 317837 | 32245 | | RBFOX3 | 167281 | 578887 | 13799 | N/A | |
| NEO1 | 067141 | 339362 | 13724 | 341198 | 32246 | | RBFOX3 | 167281 | 582344 | 13800 | N/A | |
| NEO1 | 067141 | 560262 | 13725 | 453317 | 32247 | | NEURL1 | 107954 | 369780 | 13801 | 358795 | 32299 |
| NEO1 | 067141 | 558964 | 13726 | 453200 | 32248 | | NEURL1 | 107954 | 437579 | 13802 | 416709 | 32300 |
| NEO1 | 067141 | 558485 | 13727 | N/A | | | NEURL1 | 107954 | 455386 | 13803 | 387714 | 32301 |
| NEO1 | 067141 | 560328 | 13728 | 454024 | 32249 | 60 | NEURL1 | 107954 | 465048 | 13804 | N/A | |
| NEO1 | 067141 | 560352 | 13729 | N/A | | | NEUROD1 | 162992 | 496876 | 13805 | N/A | |
| NEO1 | 067141 | 560407 | 13730 | N/A | | | NEUROD1 | 162992 | 295108 | 13806 | 295108 | 32302 |
| NEO1 | 067141 | 558807 | 13731 | N/A | | | NEUROD6 | 164600 | 297142 | 13807 | 297142 | 32303 |
| NEO1 | 067141 | 560808 | 13732 | N/A | | | NEXN | 162614 | 401035 | 13808 | 383814 | 32304 |
| NEO1 | 067141 | 558886 | 13733 | N/A | | | NEXN | 162614 | 334785 | 13809 | 333938 | 32305 |
| NEO1 | 067141 | 261908 | 13734 | 261908 | 32250 | 65 | NEXN | 162614 | 440324 | 13810 | 411902 | 32306 |
| NES | 132688 | 368223 | 13735 | 357206 | 32251 | | NEXN | 162614 | 342754 | 13811 | 343928 | 32307 |

-continued

-continued

| Symbol | ENSG | ENST | SEQ ID | ENSP | SEQ ID |
|---|---|---|---|---|---|
| NEXN | 162614 | 464998 | 13812 | N/A | |
| NEXN | 162614 | 480732 | 13813 | N/A | |
| NEXN | 162614 | 470735 | 13814 | N/A | |
| NEXN | 162614 | 330010 | 13815 | 327363 | 32308 |
| NFAM1 | 235568 | 329021 | 13816 | 333680 | 32309 |
| NFAM1 | 235568 | 355469 | 13817 | 347650 | 32310 |
| NFATC2 | 101096 | 371564 | 13818 | 360619 | 32311 |
| NFATC2 | 101096 | 396009 | 13819 | 379330 | 32312 |
| NFATC2 | 101096 | 609943 | 13820 | 477370 | 32313 |
| NFATC2 | 101096 | 610033 | 13821 | 477142 | 32314 |
| NFATC2 | 101096 | 414705 | 13822 | 396471 | 32315 |
| NFATC2 | 101096 | 609507 | 13823 | 477342 | 32316 |
| NFATC2 | 101096 | 496054 | 13824 | N/A | |
| NFATC4 | 100968 | 440487 | 13825 | N/A | |
| NFATC4 | 100968 | 413692 | 13826 | 388910 | 32317 |
| NFATC4 | 100968 | 554591 | 13827 | 452039 | 32318 |
| NFATC4 | 100968 | 556957 | 13828 | N/A | |
| NFATC4 | 100968 | 555590 | 13829 | 451224 | 32319 |
| NFATC4 | 100968 | 554966 | 13830 | 450644 | 32320 |
| NFATC4 | 100968 | 424781 | 13831 | 388668 | 32321 |
| NFATC4 | 100968 | 539237 | 13832 | 439350 | 32322 |
| NFATC4 | 100968 | 556279 | 13833 | 452270 | 32323 |
| NFATC4 | 100968 | 553469 | 13834 | 451502 | 32324 |
| NFATC4 | 100968 | 554050 | 13835 | 451151 | 32325 |
| NFATC4 | 100968 | 554655 | 13836 | N/A | |
| NFATC4 | 100968 | 554903 | 13837 | 451853 | 32326 |
| NFATC4 | 100968 | 554779 | 13838 | 451992 | 32327 |
| NFATC4 | 100968 | 557028 | 13839 | N/A | |
| NFATC4 | 100968 | 250373 | 13840 | 250373 | 32328 |
| NFATC4 | 100968 | 553708 | 13841 | 450590 | 32329 |
| NFATC4 | 100968 | 557674 | 13842 | 452352 | 32330 |
| NFATC4 | 100968 | 553879 | 13843 | 452349 | 32331 |
| NFATC4 | 100968 | 554344 | 13844 | 450469 | 32332 |
| NFATC4 | 100968 | 554661 | 13845 | 450733 | 32333 |
| NFATC4 | 100968 | 556169 | 13846 | 451454 | 32334 |
| NFATC4 | 100968 | 557451 | 13847 | 451284 | 32335 |
| NFATC4 | 100968 | 422617 | 13848 | 396788 | 32336 |
| NFATC4 | 100968 | 555453 | 13849 | 450686 | 32337 |
| NFATC4 | 100968 | 556302 | 13850 | N/A | |
| NFATC4 | 100968 | 554473 | 13851 | 450810 | 32338 |
| NFATC4 | 100968 | 556759 | 13852 | 451183 | 32339 |
| NFATC4 | 100968 | 555167 | 13853 | 451395 | 32340 |
| NFATC4 | 100968 | 557767 | 13854 | 451496 | 32341 |
| NFATC4 | 100968 | 555393 | 13855 | 451801 | 32342 |
| NFATC4 | 100968 | 555802 | 13856 | 451590 | 32343 |
| NFATC4 | 100968 | 555821 | 13857 | N/A | |
| NFIL3 | 165030 | 297689 | 13858 | 297689 | 32344 |
| NFKBID | 167604 | 590828 | 13859 | 467127 | 32345 |
| NFKBID | 167604 | 641389 | 13860 | 493265 | 32346 |
| NFKBID | 167604 | 606253 | 13861 | 475712 | 32347 |
| NFKBID | 167604 | 586361 | 13862 | N/A | |
| NFKBID | 167604 | 588497 | 13863 | N/A | |
| NFKBID | 167604 | 590094 | 13864 | N/A | |
| NFKBID | 167604 | 591730 | 13865 | N/A | |
| NFKBID | 167604 | 585925 | 13866 | 465684 | 32348 |
| NFKBID | 167604 | 588039 | 13867 | N/A | |
| NFKBID | 167604 | 585544 | 13868 | N/A | |
| NFKBID | 167604 | 396901 | 13869 | 380109 | 32349 |
| NHS | 188158 | 380060 | 13870 | 369400 | 32350 |
| NHS | 188158 | 398097 | 13871 | 381170 | 32351 |
| NHS | 188158 | 485305 | 13872 | N/A | |
| NHS | 188158 | 615422 | 13873 | 480113 | 32352 |
| NHS | 188158 | 617601 | 13874 | 478433 | 32353 |
| NHSL1 | 135540 | 427025 | 13875 | 394546 | 32354 |
| NHSL1 | 135540 | 343505 | 13876 | 344672 | 32355 |
| NHSL1 | 135540 | 342260 | 13877 | 344582 | 32356 |
| NHSL1 | 135540 | 426841 | 13878 | N/A | |
| NHSL1 | 135540 | 491526 | 13879 | 433523 | 32357 |
| NHSL1 | 135540 | 533765 | 13880 | 434958 | 32358 |
| NHSL1 | 135540 | 479393 | 13881 | N/A | |
| NHSL1 | 135540 | 534376 | 13882 | N/A | |
| NHSL1 | 135540 | 468095 | 13883 | N/A | |
| NHSL2 | 204131 | 373677 | 13884 | N/A | |
| NHSL2 | 204131 | 623354 | 13885 | N/A | |
| NHSL2 | 204131 | 510661 | 13886 | 424079 | 32359 |
| NHSL2 | 204131 | 639939 | 13887 | 492082 | 32360 |

| Symbol | ENSG | ENST | SEQ ID | ENSP | SEQ ID |
|---|---|---|---|---|---|
| NHSL2 | 204131 | 632230 | 13888 | 487835 | 32361 |
| NHSL2 | 204131 | 631375 | 13889 | 488715 | 32362 |
| NHSL2 | 204131 | 631833 | 13890 | N/A | |
| NHSL2 | 204131 | 633930 | 13891 | 488668 | 32363 |
| NID1 | 116962 | 366595 | 13892 | 355554 | 32364 |
| NID1 | 116962 | 264181 | 13893 | 264187 | 32365 |
| NINJ2 | 171840 | 305108 | 13894 | 307552 | 32366 |
| NINJ2 | 171840 | 397265 | 13895 | 380435 | 32367 |
| NINJ2 | 171840 | 542920 | 13896 | 438831 | 32368 |
| NINJ2 | 171840 | 433832 | 13897 | 415158 | 32369 |
| NINJ2 | 171840 | 537416 | 13898 | N/A | |
| NIPAL4 | 172548 | 435489 | 13899 | 406456 | 32370 |
| NIPAL4 | 172548 | 311946 | 13900 | 311687 | 32371 |
| NIPAL4 | 172548 | 521390 | 13901 | N/A | |
| NIPAL4 | 172548 | 519150 | 13902 | 430810 | 32372 |
| NIPAL4 | 172548 | 519946 | 13903 | N/A | |
| NKAIN2 | 188580 | 476571 | 13904 | N/A | |
| NKAIN2 | 188580 | 368416 | 13905 | 357401 | 32373 |
| NKAIN2 | 188580 | 368417 | 13906 | 357402 | 32374 |
| NKAIN2 | 188580 | 640160 | 13907 | 492855 | 32375 |
| NKAIN2 | 188580 | 546092 | 13908 | 440287 | 32376 |
| NKAIN2 | 188580 | 545433 | 13909 | 437798 | 32377 |
| NKAIN3 | 185942 | 519049 | 13910 | N/A | |
| NKAIN3 | 185942 | 523367 | 13911 | N/A | |
| NKAIN3 | 185942 | 523211 | 13912 | 429073 | 32378 |
| NKAIN3 | 185942 | 524201 | 13913 | 429393 | 32379 |
| NKAIN4 | 101198 | 370313 | 13914 | 359336 | 32380 |
| NKAIN4 | 101198 | 370316 | 13915 | 359340 | 32381 |
| NKAIN4 | 101198 | 466885 | 13916 | N/A | |
| NKAIN4 | 101198 | 470246 | 13917 | N/A | |
| NKAIN4 | 101198 | 370307 | 13918 | 359330 | 32382 |
| NKAIN4 | 101198 | 370317 | 13919 | 359341 | 32383 |
| NKAIN4 | 101198 | 486495 | 13920 | N/A | |
| NKAIN4 | 101198 | 461738 | 13921 | N/A | |
| NKAIN4 | 101198 | 472670 | 13922 | N/A | |
| NKD1 | 140807 | 268459 | 13923 | 268459 | 32384 |
| NKD1 | 140807 | 564336 | 13924 | N/A | |
| NKD1 | 140807 | 566396 | 13925 | N/A | |
| NKIRAS2 | 168256 | 585955 | 13926 | 468081 | 32385 |
| NKIRAS2 | 168256 | 307641 | 13927 | 303580 | 32386 |
| NKIRAS2 | 168256 | 393885 | 13928 | 377463 | 32387 |
| NKIRAS2 | 168256 | 587337 | 13929 | 468245 | 32388 |
| NKIRAS2 | 168256 | 485789 | 13930 | 466135 | 32389 |
| NKIRAS2 | 168256 | 479407 | 13931 | 465633 | 32390 |
| NKIRAS2 | 168256 | 393880 | 13932 | 377458 | 32391 |
| NKIRAS2 | 168256 | 393881 | 13933 | 377459 | 32392 |
| NKIRAS2 | 168256 | 462043 | 13934 | 419929 | 32393 |
| NKIRAS2 | 168256 | 587028 | 13935 | N/A | |
| NKIRAS2 | 168256 | 491638 | 13936 | 465588 | 32394 |
| NKIRAS2 | 168256 | 449471 | 13937 | 401976 | 32395 |
| NKIRAS2 | 168256 | 316082 | 13938 | 312773 | 32396 |
| NKIRAS2 | 168256 | 393879 | 13939 | N/A | |
| NKRF | 186416 | 371527 | 13940 | 360582 | 32397 |
| NKRF | 186416 | 304449 | 13941 | 304803 | 32398 |
| NKRF | 186416 | 487600 | 13942 | N/A | |
| NKRF | 186416 | 542113 | 13943 | 442308 | 32399 |
| NKX2-2 | 125820 | 377142 | 13944 | 366347 | 32400 |
| NLGN3 | 196338 | 395855 | 13945 | 379196 | 32401 |
| NLGN3 | 196338 | 374051 | 13946 | 363163 | 32402 |
| NLGN3 | 196338 | 358741 | 13947 | 351591 | 32403 |
| NLGN3 | 196338 | 476589 | 13948 | N/A | |
| NLGN3 | 196338 | 536169 | 13949 | 445298 | 32404 |
| NLGN3 | 196338 | 612180 | 13950 | 479877 | 32405 |
| NLGN4Y | 165246 | 471252 | 13951 | N/A | |
| NLGN4Y | 165246 | 382872 | 13952 | 372325 | 32406 |
| NLGN4Y | 165246 | 355905 | 13953 | 348169 | 32407 |
| NLGN4Y | 165246 | 382868 | 13954 | 372320 | 32408 |
| NLGN4Y | 165246 | 476359 | 13955 | N/A | |
| NLGN4Y | 165246 | 481089 | 13956 | N/A | |
| NLGN4Y | 165246 | 339174 | 13957 | 342535 | 32409 |
| NLGN4Y | 165246 | 413217 | 13958 | 412638 | 32410 |
| NLN | 123213 | 380985 | 13959 | 370372 | 32411 |
| NLN | 123213 | 502464 | 13960 | 423214 | 32412 |
| NLN | 123213 | 514991 | 13961 | 422822 | 32413 |
| NLN | 123213 | 506539 | 13962 | N/A | |
| NLN | 123213 | 506799 | 13963 | N/A | |

481

-continued

| Symbol | ENSG | ENST | SEQ ID | ENSP | SEQ ID |
|---|---|---|---|---|---|
| NLN | 123213 | 506677 | 13964 | N/A | |
| NLN | 123213 | 511299 | 13965 | 427417 | 32414 |
| NLN | 123213 | 509935 | 13966 | 426959 | 32415 |
| NLN | 123213 | 507201 | 13967 | N/A | |
| NLN | 123213 | 515595 | 13968 | N/A | |
| NNT | 112992 | 505678 | 13969 | 427670 | 32416 |
| NNT | 112992 | 512422 | 13970 | 421886 | 32417 |
| NNT | 112992 | 264663 | 13971 | 264663 | 32418 |
| NNT | 112992 | 344920 | 13972 | 343873 | 32419 |
| NNT | 112992 | 512996 | 13973 | 426343 | 32420 |
| NNT | 112992 | 515208 | 13974 | 425542 | 32421 |
| NNT | 112992 | 506893 | 13975 | N/A | |
| NNT | 112992 | 503651 | 13976 | 421674 | 32422 |
| NNT | 112992 | 513390 | 13977 | N/A | |
| NNT | 112992 | 503059 | 13978 | 424782 | 32423 |
| NOL3 | 140939 | 565560 | 13979 | 457732 | 32424 |
| NOL3 | 140939 | 563439 | 13980 | 454256 | 32425 |
| NOL3 | 140939 | 568086 | 13981 | N/A | |
| NOL3 | 140939 | 564992 | 13982 | 457720 | 32426 |
| NOL3 | 140939 | 564053 | 13983 | 457243 | 32427 |
| NOL3 | 140939 | 565645 | 13984 | N/A | |
| NOL3 | 140939 | 568199 | 13985 | N/A | |
| NOL3 | 140939 | 566871 | 13986 | 455808 | 32428 |
| NOL3 | 140939 | 568503 | 13987 | N/A | |
| NOL3 | 140939 | 563258 | 13988 | 463698 | 32429 |
| NOL3 | 140939 | 568146 | 13989 | 454598 | 32430 |
| NOL3 | 140939 | 564860 | 13990 | 463685 | 32431 |
| NOL3 | 140939 | 268605 | 13991 | 268605 | 32432 |
| NOS1 | 089250 | 317775 | 13992 | 320758 | 32433 |
| NOS1 | 089250 | 338101 | 13993 | 337459 | 32434 |
| NOS1 | 089250 | 549189 | 13994 | N/A | |
| NOS1 | 089250 | 477584 | 13995 | N/A | |
| NOS1 | 089250 | 618760 | 13996 | 477999 | 32435 |
| NOS1 | 089250 | 344089 | 13997 | 339862 | 32436 |
| NOTCH1 | 148400 | 277541 | 13998 | 277541 | 32437 |
| NOTCH1 | 148400 | 494783 | 13999 | N/A | |
| NOTCH1 | 148400 | 491649 | 14000 | N/A | |
| NOTCH3 | 074181 | 263388 | 14001 | 263388 | 32438 |
| NOTCH3 | 074181 | 595514 | 14002 | 470661 | 32439 |
| NOTCH3 | 074181 | 597756 | 14003 | 468879 | 32440 |
| NOTCH3 | 074181 | 601011 | 14004 | 473138 | 32441 |
| NOTCH3 | 074181 | 600841 | 14005 | N/A | |
| NOTCH3 | 074181 | 595045 | 14006 | N/A | |
| NPAS4 | 174576 | 311034 | 14007 | 311196 | 32442 |
| NPAS4 | 174576 | 525148 | 14008 | 433135 | 32443 |
| NPAS4 | 174576 | 524617 | 14009 | N/A | |
| NPAS4 | 174576 | 639555 | 14010 | 492526 | 32444 |
| NPL | 135838 | 488424 | 14011 | N/A | |
| NPL | 135838 | 460690 | 14012 | N/A | |
| NPL | 135838 | 463899 | 14013 | N/A | |
| NPL | 135838 | 367555 | 14014 | 356526 | 32445 |
| NPL | 135838 | 479721 | 14015 | N/A | |
| NPL | 135838 | 471010 | 14016 | N/A | |
| NPL | 135838 | 367553 | 14017 | 356524 | 32446 |
| NPL | 135838 | 460179 | 14018 | N/A | |
| NPL | 135838 | 367552 | 14019 | 356523 | 32447 |
| NPL | 135838 | 258317 | 14020 | 258317 | 32448 |
| NPL | 135838 | 367554 | 14021 | 356525 | 32449 |
| NPL | 135838 | 614468 | 14022 | 482415 | 32450 |
| NPR1 | 169418 | 368680 | 14023 | 357669 | 32451 |
| NPR1 | 169418 | 413826 | 14024 | N/A | |
| NPR1 | 169418 | 368677 | 14025 | N/A | |
| NPR3 | 113389 | 509104 | 14026 | 425325 | 32452 |
| NPR3 | 113389 | 434067 | 14027 | 388408 | 32453 |
| NPR3 | 113389 | 506712 | 14028 | N/A | |
| NPR3 | 113389 | 265074 | 14029 | 265074 | 32454 |
| NPR3 | 113389 | 415167 | 14030 | 398028 | 32455 |
| NPR3 | 113389 | 507141 | 14031 | 423730 | 32456 |
| NPR3 | 113389 | 326958 | 14032 | 318340 | 32457 |
| NPY1R | 164128 | 296533 | 14033 | 354652 | 32458 |
| NPY1R | 164128 | 509586 | 14034 | 427284 | 32459 |
| NPY1R | 164128 | 504391 | 14035 | 422963 | 32460 |
| NPY1R | 164128 | 512819 | 14036 | 421618 | 32461 |
| NPY1R | 164128 | 504790 | 14037 | 427564 | 32462 |
| NPY1R | 164128 | 515701 | 14038 | 426099 | 32463 |
| NPY1R | 164128 | 511901 | 14039 | 423878 | 32464 |

482

-continued

| Symbol | ENSG | ENST | SEQ ID | ENSP | SEQ ID |
|---|---|---|---|---|---|
| NPY6R | 226306 | 510937 | 14040 | N/A | |
| NPY6R | 226306 | 503807 | 14041 | N/A | |
| NR3C2 | 151623 | 344721 | 14042 | 341390 | 32465 |
| NR3C2 | 151623 | 358102 | 14043 | 350815 | 32466 |
| NR3C2 | 151623 | 512865 | 14044 | 423510 | 32467 |
| NR3C2 | 151623 | 342437 | 14045 | 343907 | 32468 |
| NR3C2 | 151623 | 511528 | 14046 | 421481 | 32469 |
| NR3C2 | 151623 | 503313 | 14047 | N/A | |
| NR3C2 | 151623 | 503174 | 14048 | N/A | |
| NR3C2 | 151623 | 504753 | 14049 | N/A | |
| NR3C2 | 151623 | 625323 | 14050 | 486719 | 32470 |
| NR4A1 | 123358 | 548977 | 14051 | 456633 | 32471 |
| NR4A1 | 123358 | 546842 | 14052 | 457070 | 32472 |
| NR4A1 | 123358 | 553200 | 14053 | 456776 | 32473 |
| NR4A1 | 123358 | 545748 | 14054 | 440864 | 32474 |
| NR4A1 | 123358 | 550082 | 14055 | 449539 | 32475 |
| NR4A1 | 123358 | 549102 | 14056 | N/A | |
| NR4A1 | 123358 | 478250 | 14057 | N/A | |
| NR4A1 | 123358 | 547206 | 14058 | N/A | |
| NR4A1 | 123358 | 550763 | 14059 | 449858 | 32476 |
| NR4A1 | 123358 | 394824 | 14060 | 378301 | 32477 |
| NR4A1 | 123358 | 548232 | 14061 | 449587 | 32478 |
| NR4A1 | 123358 | 562373 | 14062 | 455399 | 32479 |
| NR4A1 | 123358 | 548733 | 14063 | N/A | |
| NR4A1 | 123358 | 550557 | 14064 | N/A | |
| NR4A1 | 123358 | 564201 | 14065 | N/A | |
| NR4A1 | 123358 | 550339 | 14066 | N/A | |
| NR4A1 | 123358 | 567890 | 14067 | N/A | |
| NR4A1 | 123358 | 550582 | 14068 | 455767 | 32480 |
| NR4A1 | 123358 | 565848 | 14069 | N/A | |
| NR4A1 | 123358 | 394825 | 14070 | 378302 | 32481 |
| NR4A1 | 123358 | 360284 | 14071 | 353427 | 32482 |
| NR4A1 | 123358 | 243050 | 14072 | 243050 | 32483 |
| NR4A2 | 153234 | 339562 | 14073 | 344479 | 32484 |
| NR4A2 | 153234 | 426264 | 14074 | 389986 | 32485 |
| NR4A2 | 153234 | 409572 | 14075 | 386747 | 32486 |
| NR4A2 | 153234 | 417764 | 14076 | 415632 | 32487 |
| NR4A2 | 153234 | 417972 | 14077 | 394671 | 32488 |
| NR4A2 | 153234 | 409108 | 14078 | 386993 | 32489 |
| NR4A2 | 153234 | 429376 | 14079 | 410952 | 32490 |
| NR4A2 | 153234 | 406048 | 14080 | 385379 | 32491 |
| NR4A2 | 153234 | 424077 | 14081 | 406808 | 32492 |
| NR4A2 | 153234 | 421709 | 14082 | 388120 | 32493 |
| NR4A3 | 119508 | 338488 | 14083 | 340301 | 32494 |
| NR4A3 | 119508 | 395097 | 14084 | 378531 | 32495 |
| NR4A3 | 119508 | 330847 | 14085 | 333122 | 32496 |
| NR4A3 | 119508 | 618101 | 14086 | 482027 | 32497 |
| NRBF2 | 148572 | 277746 | 14087 | 277746 | 32498 |
| NRBF2 | 148572 | 435510 | 14088 | 397502 | 32499 |
| NRCAM | 091129 | 351718 | 14089 | 325269 | 32500 |
| NRCAM | 091129 | 379024 | 14090 | 368310 | 32501 |
| NRCAM | 091129 | 425651 | 14091 | 401244 | 32502 |
| NRCAM | 091129 | 445634 | 14092 | 398174 | 32503 |
| NRCAM | 091129 | 415105 | 14093 | N/A | |
| NRCAM | 091129 | 465585 | 14094 | N/A | |
| NRCAM | 091129 | 417701 | 14095 | 390421 | 32504 |
| NRCAM | 091129 | 489800 | 14096 | N/A | |
| NRCAM | 091129 | 442580 | 14097 | 390868 | 32505 |
| NRCAM | 091129 | 419936 | 14098 | 397544 | 32506 |
| NRCAM | 091129 | 456431 | 14099 | 408203 | 32507 |
| NRCAM | 091129 | 418239 | 14100 | 393663 | 32508 |
| NRCAM | 091129 | 379028 | 14101 | 368314 | 32509 |
| NRCAM | 091129 | 413765 | 14102 | 407858 | 32510 |
| NRCAM | 091129 | 379022 | 14103 | 368308 | 32511 |
| NRCAM | 091129 | 613830 | 14104 | 484840 | 32512 |
| NRCAM | 091129 | 522550 | 14105 | N/A | |
| NREP | 134986 | 514515 | 14106 | 427595 | 32513 |
| NREP | 134986 | 509025 | 14107 | 426834 | 32514 |
| NREP | 134986 | 379671 | 14108 | 368993 | 32515 |
| NREP | 134986 | 257435 | 14109 | 257435 | 32516 |
| NREP | 134986 | 446294 | 14110 | 402965 | 32517 |
| NREP | 134986 | 395634 | 14111 | 378996 | 32518 |
| NREP | 134986 | 515855 | 14112 | 422278 | 32519 |
| NREP | 134986 | 507742 | 14113 | N/A | |
| NREP | 134986 | 509979 | 14114 | 423320 | 32520 |
| NREP | 134986 | 450761 | 14115 | 416617 | 32521 |

-continued

-continued

| Symbol | ENSG | ENST | SEQ ID | ENSP | SEQ ID |
|---|---|---|---|---|---|
| NREP | 134986 | 419114 | 14116 | 399766 | 32522 |
| NREP | 134986 | 509427 | 14117 | 422630 | 32523 |
| NREP | 134986 | 453526 | 14118 | 403383 | 32524 |
| NREP | 134986 | 455559 | 14119 | 392559 | 32525 |
| NREP | 134986 | 508870 | 14120 | 427149 | 32526 |
| NREP | 134986 | 513100 | 14121 | 427476 | 32527 |
| NREP | 134986 | 504018 | 14122 | N/A | |
| NREP | 134986 | 508161 | 14123 | 422046 | 32528 |
| NREP | 134986 | 503429 | 14124 | N/A | |
| NREP | 134986 | 505864 | 14125 | N/A | |
| NREP | 134986 | 507032 | 14126 | 422514 | 32529 |
| NREP | 134986 | 513684 | 14127 | N/A | |
| NREP | 134986 | 447165 | 14128 | 408839 | 32530 |
| NRG1 | 157168 | 518104 | 14129 | 430053 | 32531 |
| NRG1 | 157168 | 519301 | 14130 | 429582 | 32532 |
| NRG1 | 157168 | 520407 | 14131 | 434640 | 32533 |
| NRG1 | 157168 | 523534 | 14132 | 429067 | 32534 |
| NRG1 | 157168 | 517967 | 14133 | N/A | |
| NRG1 | 157168 | 523320 | 14134 | N/A | |
| NRG1 | 157168 | 631040 | 14135 | 486375 | 32535 |
| NRG1 | 157168 | 523079 | 14136 | 430120 | 32536 |
| NRG1 | 157168 | 356819 | 14137 | 349275 | 32537 |
| NRG1 | 157168 | 521670 | 14138 | 428828 | 32538 |
| NRG1 | 157168 | 287842 | 14139 | 287842 | 32539 |
| NRG1 | 157168 | 405005 | 14140 | 384620 | 32540 |
| NRG1 | 157168 | 518206 | 14141 | 432052 | 32541 |
| NRG1 | 157168 | 522569 | 14142 | N/A | |
| NRG1 | 157168 | 520502 | 14143 | 433289 | 32542 |
| NRG1 | 157168 | 523041 | 14144 | 433350 | 32543 |
| NRG1 | 157168 | 518084 | 14145 | 428546 | 32544 |
| NRG1 | 157168 | 522402 | 14146 | 430862 | 32545 |
| NRG1 | 157168 | 519240 | 14147 | 428411 | 32546 |
| NRG1 | 157168 | 523681 | 14148 | N/A | |
| NRG1 | 157168 | 539990 | 14149 | 439276 | 32547 |
| NRG1 | 157168 | 614767 | 14150 | 483727 | 32548 |
| NRG2 | 158458 | 289422 | 14151 | 289422 | 32549 |
| NRG2 | 158458 | 361474 | 14152 | 354910 | 32550 |
| NRG2 | 158458 | 340391 | 14153 | 342660 | 32551 |
| NRG2 | 158458 | 289409 | 14154 | 289409 | 32552 |
| NRG2 | 158458 | 358522 | 14155 | 351323 | 32553 |
| NRG2 | 158458 | 378238 | 14156 | 367483 | 32554 |
| NRG2 | 158458 | 519478 | 14157 | N/A | |
| NRG2 | 158458 | 518130 | 14158 | N/A | |
| NRG2 | 158458 | 541337 | 14159 | 444235 | 32555 |
| NRG3 | 185737 | 372141 | 14160 | 361214 | 32556 |
| NRG3 | 185737 | 404547 | 14161 | 384796 | 32557 |
| NRG3 | 185737 | 372142 | 14162 | 361215 | 32558 |
| NRG3 | 185737 | 602794 | 14163 | 473669 | 32559 |
| NRG3 | 185737 | 555784 | 14164 | 451858 | 32560 |
| NRG3 | 185737 | 404576 | 14165 | 385804 | 32561 |
| NRG3 | 185737 | 556918 | 14166 | 451376 | 32562 |
| NRG3 | 185737 | 537893 | 14167 | 440377 | 32563 |
| NRG3 | 185737 | 545131 | 14168 | 441201 | 32564 |
| NRGN | 154146 | 284292 | 14169 | 284292 | 32565 |
| NRGN | 154146 | 412681 | 14170 | 399591 | 32566 |
| NRIP3 | 175352 | 309166 | 14171 | 310205 | 32567 |
| NRIP3 | 175352 | 534759 | 14172 | 435785 | 32568 |
| NRIP3 | 175352 | 531142 | 14173 | 432002 | 32569 |
| NRIP3 | 175352 | 531090 | 14174 | 432451 | 32570 |
| NRIP3 | 175352 | 525100 | 14175 | 433845 | 32571 |
| NRK | 123572 | 243300 | 14176 | 434830 | 32572 |
| NRK | 123572 | 536164 | 14177 | 438785 | 32573 |
| NRK | 123572 | 428173 | 14178 | 438378 | 32574 |
| NRK | 123572 | 540278 | 14179 | 438148 | 32575 |
| NRXN1 | 179915 | 625672 | 14180 | 485887 | 32576 |
| NRXN1 | 179915 | 406316 | 14181 | 384311 | 32577 |
| NRXN1 | 179915 | 636345 | 14182 | 489745 | 32578 |
| NRXN1 | 179915 | 634764 | 14183 | N/A | |
| NRXN1 | 179915 | 634431 | 14184 | N/A | |
| NRXN1 | 179915 | 635519 | 14185 | 489258 | 32579 |
| NRXN1 | 179915 | 635164 | 14186 | N/A | |
| NRXN1 | 179915 | 412315 | 14187 | 396738 | 32580 |
| NRXN1 | 179915 | 404971 | 14188 | 385142 | 32581 |
| NRXN1 | 179915 | 634412 | 14189 | N/A | |
| NRXN1 | 179915 | 342183 | 14190 | 341184 | 32582 |
| NRXN1 | 179915 | 378262 | 14191 | 367510 | 32583 |

| Symbol | ENSG | ENST | SEQ ID | ENSP | SEQ ID |
|---|---|---|---|---|---|
| NRXN1 | 179915 | 401710 | 14192 | 385580 | 32584 |
| NRXN1 | 179915 | 637906 | 14193 | 490198 | 32585 |
| NRXN1 | 179915 | 484192 | 14194 | N/A | |
| NRXN1 | 179915 | 401669 | 14195 | 385017 | 32586 |
| NRXN1 | 179915 | 630656 | 14196 | 486993 | 32587 |
| NRXN1 | 179915 | 629717 | 14197 | N/A | |
| NRXN1 | 179915 | 628364 | 14198 | 485815 | 32588 |
| NRXN1 | 179915 | 405472 | 14199 | 434015 | 32589 |
| NRXN1 | 179915 | 630543 | 14200 | 486879 | 32590 |
| NRXN1 | 179915 | 635264 | 14201 | N/A | |
| NRXN1 | 179915 | 637889 | 14202 | N/A | |
| NRXN1 | 179915 | 636736 | 14203 | N/A | |
| NRXN1 | 179915 | 636298 | 14204 | N/A | |
| NRXN1 | 179915 | 331040 | 14205 | 489573 | 32591 |
| NRXN1 | 179915 | 625320 | 14206 | 486253 | 32592 |
| NRXN1 | 179915 | 636818 | 14207 | N/A | |
| NRXN1 | 179915 | 635834 | 14208 | N/A | |
| NRXN1 | 179915 | 637151 | 14209 | N/A | |
| NRXN1 | 179915 | 626192 | 14210 | N/A | |
| NRXN1 | 179915 | 474354 | 14211 | N/A | |
| NRXN1 | 179915 | 462791 | 14212 | N/A | |
| NRXN1 | 179915 | 495871 | 14213 | 486185 | 32593 |
| NRXN1 | 179915 | 636342 | 14214 | N/A | |
| NRXN1 | 179915 | 637207 | 14215 | N/A | |
| NRXN1 | 179915 | 637653 | 14216 | N/A | |
| NRXN1 | 179915 | 638037 | 14217 | 490210 | 32594 |
| NRXN1 | 179915 | 637459 | 14218 | N/A | |
| NRXN1 | 179915 | 637021 | 14219 | N/A | |
| NRXN1 | 179915 | 637605 | 14220 | N/A | |
| NRXN1 | 179915 | 626249 | 14221 | 485723 | 32595 |
| NRXN1 | 179915 | 628515 | 14222 | 486544 | 32596 |
| NRXN1 | 179915 | 625891 | 14223 | 489108 | 32597 |
| NRXN1 | 179915 | 628761 | 14224 | N/A | |
| NRXN1 | 179915 | 630431 | 14225 | N/A | |
| NRXN1 | 179915 | 627198 | 14226 | 487268 | 32598 |
| NRXN1 | 179915 | 637472 | 14227 | N/A | |
| NRXN1 | 179915 | 405581 | 14228 | 385310 | 32599 |
| NRXN1 | 179915 | 636066 | 14229 | 490017 | 32600 |
| NRXN1 | 179915 | 637511 | 14230 | 490494 | 32601 |
| NRXN1 | 179915 | 626899 | 14231 | 485912 | 32602 |
| NRXN1 | 179915 | 496792 | 14232 | 487165 | 32603 |
| NRXN1 | 179915 | 637679 | 14233 | N/A | |
| NRXN1 | 179915 | 635310 | 14234 | N/A | |
| NRXN1 | 179915 | 637006 | 14235 | N/A | |
| NRXN1 | 179915 | 638060 | 14236 | N/A | |
| NRXN1 | 179915 | 636599 | 14237 | N/A | |
| NRXN1 | 179915 | 635126 | 14238 | N/A | |
| NRXN1 | 179915 | 636104 | 14239 | N/A | |
| NRXN1 | 179915 | 447773 | 14240 | N/A | |
| NRXN1 | 179915 | 637975 | 14241 | N/A | |
| NRXN1 | 179915 | 416262 | 14242 | N/A | |
| NRXN1 | 179915 | 637368 | 14243 | N/A | |
| NRXN1 | 179915 | 611589 | 14244 | 483634 | 32604 |
| NRXN1 | 179915 | 406859 | 14245 | 385681 | 32605 |
| NRXN1 | 179915 | 402717 | 14246 | 385434 | 32606 |
| NRXN2 | 110076 | 464307 | 14247 | N/A | |
| NRXN2 | 110076 | 301894 | 14248 | 301894 | 32607 |
| NRXN2 | 110076 | 377551 | 14249 | 366774 | 32608 |
| NRXN2 | 110076 | 377559 | 14250 | 366782 | 32609 |
| NRXN2 | 110076 | 409571 | 14251 | 386416 | 32610 |
| NRXN2 | 110076 | 475737 | 14252 | N/A | |
| NRXN2 | 110076 | 423049 | 14253 | 407374 | 32611 |
| NRXN2 | 110076 | 467055 | 14254 | N/A | |
| NRXN2 | 110076 | 487484 | 14255 | N/A | |
| NRXN2 | 110076 | 486057 | 14256 | N/A | |
| NRXN2 | 110076 | 496291 | 14257 | N/A | |
| NRXN2 | 110076 | 442300 | 14258 | 388971 | 32612 |
| NRXN2 | 110076 | 417749 | 14259 | 411271 | 32613 |
| NRXN2 | 110076 | 437746 | 14260 | 412211 | 32614 |
| NRXN2 | 110076 | 466324 | 14261 | N/A | |
| NRXN2 | 110076 | 265459 | 14262 | 265459 | 32615 |
| NRXN3 | 021645 | 634499 | 14263 | 488920 | 32616 |
| NRXN3 | 021645 | 554738 | 14264 | 450683 | 32617 |
| NRXN3 | 021645 | 635466 | 14265 | 489551 | 32618 |
| NRXN3 | 021645 | 556088 | 14266 | N/A | |
| NRXN3 | 021645 | 553363 | 14267 | 451754 | 32619 |

| Symbol | ENSG | ENST | SEQ ID | ENSP | SEQ ID |
|---|---|---|---|---|---|
| NRXN3 | 021645 | 553631 | 14268 | 451947 | 32620 |
| NRXN3 | 021645 | 554719 | 14269 | 451648 | 32621 |
| NRXN3 | 021645 | 556496 | 14270 | N/A | |
| NRXN3 | 021645 | 634266 | 14271 | N/A | |
| NRXN3 | 021645 | 557081 | 14272 | 450462 | 32622 |
| NRXN3 | 021645 | 557594 | 14273 | 451672 | 32623 |
| NRXN3 | 021645 | 281127 | 14274 | 281127 | 32624 |
| NRXN3 | 021645 | 428277 | 14275 | 394426 | 32625 |
| NRXN3 | 021645 | 555387 | 14276 | 451393 | 32626 |
| NRXN3 | 021645 | 555073 | 14277 | N/A | |
| NRXN3 | 021645 | 553803 | 14278 | N/A | |
| NRXN3 | 021645 | 556003 | 14279 | N/A | |
| NRXN3 | 021645 | 335750 | 14280 | 338349 | 32627 |
| NT5DC2 | 168268 | 463947 | 14281 | 418780 | 32628 |
| NT5DC2 | 168268 | 479024 | 14282 | N/A | |
| NT5DC2 | 168268 | 307076 | 14283 | 302468 | 32629 |
| NT5DC2 | 168268 | 422318 | 14284 | 406933 | 32630 |
| NT5DC2 | 168268 | 462261 | 14285 | N/A | |
| NT5DC2 | 168268 | 459839 | 14286 | 419547 | 32631 |
| NT5DC2 | 168268 | 492555 | 14287 | 419774 | 32632 |
| NT5DC2 | 168268 | 469616 | 14288 | N/A | |
| NT5DC2 | 168268 | 466112 | 14289 | N/A | |
| NT5DC2 | 168268 | 478091 | 14290 | N/A | |
| NT5DC2 | 168268 | 489316 | 14291 | 417269 | 32633 |
| NT5DC2 | 168268 | 486792 | 14292 | N/A | |
| NT5DC2 | 168268 | 471522 | 14293 | 418583 | 32634 |
| NT5DC2 | 168268 | 487779 | 14294 | N/A | |
| NT5DC2 | 168268 | 490681 | 14295 | N/A | |
| NT5E | 135318 | 369646 | 14296 | 358660 | 32635 |
| NT5E | 135318 | 257770 | 14297 | 257770 | 32636 |
| NT5E | 135318 | 416334 | 14298 | 414674 | 32637 |
| NT5E | 135318 | 437581 | 14299 | 387630 | 32638 |
| NT5E | 135318 | 369651 | 14300 | 358665 | 32639 |
| NTF3 | 185652 | 535299 | 14301 | N/A | |
| NTF3 | 185652 | 423158 | 14302 | 397297 | 32640 |
| NTF3 | 185652 | 543548 | 14303 | N/A | |
| NTF3 | 185652 | 331010 | 14304 | 328738 | 32641 |
| NTF3 | 185652 | 544836 | 14305 | N/A | |
| NTF3 | 185652 | 541234 | 14306 | N/A | |
| NTM | 182667 | 436745 | 14307 | 409221 | 32642 |
| NTM | 182667 | 477098 | 14308 | N/A | |
| NTM | 182667 | 550167 | 14309 | 448104 | 32643 |
| NTM | 182667 | 416661 | 14310 | 400205 | 32644 |
| NTM | 182667 | 463395 | 14311 | N/A | |
| NTM | 182667 | 498764 | 14312 | N/A | |
| NTM | 182667 | 470371 | 14313 | N/A | |
| NTM | 182667 | 374786 | 14314 | 363918 | 32645 |
| NTM | 182667 | 479431 | 14315 | N/A | |
| NTM | 182667 | 425719 | 14316 | 396722 | 32646 |
| NTM | 182667 | 374784 | 14317 | 363916 | 32647 |
| NTM | 182667 | 467255 | 14318 | N/A | |
| NTM | 182667 | 496094 | 14319 | N/A | |
| NTM | 182667 | 474900 | 14320 | N/A | |
| NTM | 182667 | 482316 | 14321 | N/A | |
| NTM | 182667 | 490356 | 14322 | N/A | |
| NTM | 182667 | 457381 | 14323 | 387984 | 32648 |
| NTM | 182667 | 483174 | 14324 | N/A | |
| NTM | 182667 | 496198 | 14325 | N/A | |
| NTM | 182667 | 539799 | 14326 | 437668 | 32649 |
| NTM | 182667 | 427481 | 14327 | 416320 | 32650 |
| NTM | 182667 | 374791 | 14328 | 363923 | 32651 |
| NTN1 | 065320 | 173229 | 14329 | 173229 | 32652 |
| NTN1 | 065320 | 436734 | 14330 | 389375 | 32653 |
| NTN4 | 074527 | 343702 | 14331 | 340998 | 32654 |
| NTN4 | 074527 | 344911 | 14332 | 339436 | 32655 |
| NTN4 | 074527 | 538383 | 14333 | 444432 | 32656 |
| NTN4 | 074527 | 553059 | 14334 | 447292 | 32657 |
| NTN4 | 074527 | 550074 | 14335 | N/A | |
| NTN4 | 074527 | 552603 | 14336 | N/A | |
| NTN4 | 074527 | 547980 | 14337 | 447594 | 32658 |
| NTNG1 | 162631 | 370074 | 14338 | 359091 | 32659 |
| NTNG1 | 162631 | 370068 | 14339 | 359085 | 32660 |
| NTNG1 | 162631 | 294649 | 14340 | N/A | |
| NTNG1 | 162631 | 370067 | 14341 | 359084 | 32661 |
| NTNG1 | 162631 | 462149 | 14342 | N/A | |
| NTNG1 | 162631 | 370076 | 14343 | N/A | |

| Symbol | ENSG | ENST | SEQ ID | ENSP | SEQ ID |
|---|---|---|---|---|---|
| NTNG1 | 162631 | 370066 | 14344 | 359083 | 32662 |
| NTNG1 | 162631 | 370065 | 14345 | 359082 | 32663 |
| NTNG1 | 162631 | 477948 | 14346 | N/A | |
| NTNG1 | 162631 | 370071 | 14347 | 359088 | 32664 |
| NTNG1 | 162631 | 370073 | 14348 | 359090 | 32665 |
| NTNG2 | 196358 | 393229 | 14349 | 376921 | 32666 |
| NTNG2 | 196358 | 490694 | 14350 | N/A | |
| NTNG2 | 196358 | 483055 | 14351 | N/A | |
| NTNG2 | 196358 | 372179 | 14352 | 361252 | 32667 |
| NTSR1 | 101188 | 370501 | 14353 | 359532 | 32668 |
| NTSR1 | 101188 | 482259 | 14354 | N/A | |
| NTSR2 | 169006 | 306928 | 14355 | 303686 | 32669 |
| NUDC | 090273 | 435827 | 14356 | 404020 | 32670 |
| NUDC | 090273 | 321265 | 14357 | 319664 | 32671 |
| NUDC | 090273 | 452707 | 14358 | 400981 | 32672 |
| NUDC | 090273 | 484772 | 14359 | N/A | |
| NUDCD3 | 015676 | 355451 | 14360 | 347626 | 32673 |
| NUDCD3 | 015676 | 487118 | 14361 | N/A | |
| NUDCD3 | 015676 | 460110 | 14362 | N/A | |
| NUDCD3 | 015676 | 475952 | 14363 | N/A | |
| NUDCD3 | 015676 | 338427 | 14364 | N/A | |
| NUDCD3 | 015676 | 493613 | 14365 | N/A | |
| NUDCD3 | 015676 | 472246 | 14366 | N/A | |
| NUDCD3 | 015676 | 464812 | 14367 | N/A | |
| NUDCD3 | 015676 | 478769 | 14368 | N/A | |
| NUDCD3 | 015676 | 480209 | 14369 | N/A | |
| NUDCD3 | 015676 | 497978 | 14370 | N/A | |
| NUDT4 | 173598 | 337179 | 14371 | 338352 | 32674 |
| NUDT4 | 173598 | 415493 | 14372 | 406612 | 32675 |
| NUDT4 | 173598 | 550056 | 14373 | 448504 | 32676 |
| NUDT4 | 173598 | 549992 | 14374 | 449552 | 32677 |
| NUDT4 | 173598 | 548662 | 14375 | 449724 | 32678 |
| NUDT4 | 173598 | 547014 | 14376 | 448032 | 32679 |
| NUDT4 | 173598 | 546925 | 14377 | 448620 | 32680 |
| NUMBL | 105245 | 252891 | 14378 | 252891 | 32681 |
| NUMBL | 105245 | 598779 | 14379 | 472400 | 32682 |
| NUMBL | 105245 | 540131 | 14380 | 442759 | 32683 |
| NUMBL | 105245 | 600967 | 14381 | 469310 | 32684 |
| NUMBL | 105245 | 593367 | 14382 | N/A | |
| NUMBL | 105245 | 598773 | 14383 | 469736 | 32685 |
| NUMBL | 105245 | 595741 | 14384 | 470794 | 32686 |
| NUMBL | 105245 | 599786 | 14385 | N/A | |
| NUMBL | 105245 | 600636 | 14386 | 471376 | 32687 |
| NUMBL | 105245 | 599594 | 14387 | N/A | |
| NUMBL | 105245 | 598759 | 14388 | N/A | |
| NUP58 | 139496 | 381736 | 14389 | 371155 | 32688 |
| NUP58 | 139496 | 481980 | 14390 | 418341 | 32689 |
| NUP58 | 139496 | 480187 | 14391 | N/A | |
| NUP58 | 139496 | 460326 | 14392 | N/A | |
| NUP58 | 139496 | 465068 | 14393 | 418904 | 32690 |
| NUP58 | 139496 | 490231 | 14394 | 418244 | 32691 |
| NUP58 | 139496 | 463407 | 14395 | 418555 | 32692 |
| NUP58 | 139496 | 466694 | 14396 | N/A | |
| NUP58 | 139496 | 381718 | 14397 | 371137 | 32693 |
| NUP58 | 139496 | 495460 | 14398 | N/A | |
| NUP58 | 139496 | 381747 | 14399 | 371166 | 32694 |
| NUP58 | 139496 | 394327 | 14400 | 408147 | 32695 |
| NUP58 | 139496 | 476553 | 14401 | N/A | |
| NUP58 | 139496 | 477876 | 14402 | N/A | |
| NUP62CL | 198088 | 372466 | 14403 | 361544 | 32696 |
| NUP62CL | 198088 | 484614 | 14404 | 433269 | 32697 |
| NUP62CL | 198088 | 432145 | 14405 | 408612 | 32698 |
| NUP62CL | 198088 | 421752 | 14406 | 405906 | 32699 |
| NUP93 | 102900 | 308159 | 14407 | 310668 | 32700 |
| NUP93 | 102900 | 563858 | 14408 | 455230 | 32701 |
| NUP93 | 102900 | 566315 | 14409 | 456261 | 32702 |
| NUP93 | 102900 | 569842 | 14410 | 458101 | 32703 |
| NUP93 | 102900 | 569863 | 14411 | 454587 | 32704 |
| NUP93 | 102900 | 562496 | 14412 | 457902 | 32705 |
| NUP93 | 102900 | 568656 | 14413 | 454285 | 32706 |
| NUP93 | 102900 | 566678 | 14414 | 454935 | 32707 |
| NUP93 | 102900 | 564887 | 14415 | 458039 | 32708 |
| NUP93 | 102900 | 569595 | 14416 | N/A | |
| NUP93 | 102900 | 566727 | 14417 | N/A | |
| NUP93 | 102900 | 567641 | 14418 | 455210 | 32709 |
| NUP93 | 102900 | 568283 | 14419 | 454844 | 32710 |

-continued

-continued

| Symbol | ENSG | ENST | SEQ ID | ENSP | SEQ ID |
|---|---|---|---|---|---|
| NUP93 | 102900 | 567081 | 14420 | 455181 | 32711 |
| NUP93 | 102900 | 542526 | 14421 | 440235 | 32712 |
| NUP93 | 102900 | 563437 | 14422 | N/A | |
| NUP93 | 102900 | 563405 | 14423 | 458078 | 32713 |
| NUP93 | 102900 | 563486 | 14424 | 456196 | 32714 |
| NUP93 | 102900 | 569322 | 14425 | 457907 | 32715 |
| NUP93 | 102900 | 564278 | 14426 | N/A | |
| NUP93 | 102900 | 563465 | 14427 | N/A | |
| NWD1 | 188039 | 518676 | 14428 | 428224 | 32716 |
| NWD1 | 188039 | 524140 | 14429 | 428579 | 32717 |
| NWD1 | 188039 | 549814 | 14430 | 447548 | 32718 |
| NWD1 | 188039 | 438489 | 14431 | 400248 | 32719 |
| NWD1 | 188039 | 552788 | 14432 | 447224 | 32720 |
| NWD1 | 188039 | 379808 | 14433 | 369136 | 32721 |
| NXN | 280563 | 627023 | 14434 | N/A | |
| NXN | 280563 | 626807 | 14435 | N/A | |
| NXN | 280563 | 628478 | 14436 | 486232 | 32722 |
| NXN | 167693 | 575801 | 14437 | 461038 | 32723 |
| NXN | 167693 | 336868 | 14438 | 337443 | 32724 |
| NXN | 167693 | 571281 | 14439 | N/A | |
| NXN | 167693 | 571684 | 14440 | 461562 | 32725 |
| NXN | 167693 | 537628 | 14441 | 446446 | 32726 |
| NXN | 167693 | 574018 | 14442 | N/A | |
| NXN | 167693 | 575455 | 14443 | N/A | |
| NXN | 167693 | 577098 | 14444 | N/A | |
| NXN | 167693 | 571338 | 14445 | N/A | |
| NXN | 167693 | 575171 | 14446 | N/A | |
| NXN | 167693 | 576991 | 14447 | N/A | |
| NXN | 167693 | 571080 | 14448 | N/A | |
| NXN | 281300 | 628640 | 14449 | N/A | |
| NXN | 281300 | 629250 | 14450 | N/A | |
| NXN | 281300 | 627182 | 14451 | 485936 | 32727 |
| NXNL2 | 130045 | 487646 | 14452 | N/A | |
| NXNL2 | 130045 | 375855 | 14453 | 365015 | 32728 |
| NXNL2 | 130045 | 478686 | 14454 | N/A | |
| NXNL2 | 130045 | 375854 | 14455 | 365014 | 32729 |
| NXNL2 | 130045 | 618633 | 14456 | 480855 | 32730 |
| NXPE3 | 144815 | 495842 | 14457 | 418381 | 32731 |
| NXPE3 | 144815 | 273347 | 14458 | 273347 | 32732 |
| NXPE3 | 144815 | 474165 | 14459 | 419667 | 32733 |
| NXPE3 | 144815 | 491511 | 14460 | 417485 | 32734 |
| NXPE3 | 144815 | 487830 | 14461 | N/A | |
| NXPE3 | 144815 | 477909 | 14462 | 418369 | 32735 |
| NXPE3 | 144815 | 616286 | 14463 | 478069 | 32736 |
| NYAP2 | 144460 | 636099 | 14464 | 490942 | 32737 |
| NYXP2 | 144460 | 272907 | 14465 | 272907 | 32738 |
| NYX | 188937 | 342595 | 14466 | 340328 | 32739 |
| NYX | 188937 | 378220 | 14467 | 367465 | 32740 |
| NYX | 188937 | 486842 | 14468 | N/A | |
| OAT | 065154 | 368845 | 14469 | 357838 | 32741 |
| OAT | 065154 | 471127 | 14470 | N/A | |
| OAT | 065154 | 467675 | 14471 | N/A | |
| OAT | 065154 | 483711 | 14472 | N/A | |
| OAT | 065154 | 476917 | 14473 | N/A | |
| OAT | 065154 | 490096 | 14474 | N/A | |
| OAT | 065154 | 492376 | 14475 | N/A | |
| OAT | 065154 | 539214 | 14476 | 439042 | 32742 |
| OGDHL | 197444 | 374103 | 14477 | 363216 | 32743 |
| OGDHL | 197444 | 490844 | 14478 | NA | |
| OGDHL | 197444 | 496884 | 14479 | N/A | |
| OGDHL | 197444 | 471460 | 14480 | N/A | |
| OGDHL | 197444 | 419399 | 14481 | 401356 | 32744 |
| OGDHL | 197444 | 432695 | 14482 | 390240 | 32745 |
| OLFM1 | 130558 | 371799 | 14483 | 360864 | 32746 |
| OLFM1 | 130558 | 277415 | 14484 | 277415 | 32747 |
| OLFM1 | 130558 | 252854 | 14485 | 252854 | 32748 |
| OLFM1 | 130558 | 371801 | 14486 | 360866 | 32749 |
| OLFM1 | 130558 | 339720 | 14487 | 340318 | 32750 |
| OLFM1 | 130558 | 371796 | 14488 | 360861 | 32751 |
| OLFM1 | 130558 | 539529 | 14489 | 444296 | 32752 |
| OLFM1 | 130558 | 392991 | 14490 | 376717 | 32753 |
| OLFM1 | 130558 | 371793 | 14491 | 360858 | 32754 |
| OLFM1 | 130558 | 539877 | 14492 | 443806 | 32755 |
| OLFM1 | 130558 | 545657 | 14493 | 437906 | 32756 |
| OLFM1 | 130558 | 483042 | 14494 | NA | |
| OLFM2 | 105088 | 264833 | 14495 | 264833 | 32757 |

| Symbol | ENSG | ENST | SEQ ID | ENSP | SEQ ID |
|---|---|---|---|---|---|
| OLFM2 | 105088 | 590841 | 14496 | 464877 | 32758 |
| OLFM2 | 105088 | 592448 | 14497 | 466018 | 32759 |
| OLFM2 | 105088 | 593091 | 14498 | 465809 | 32760 |
| OLFM2 | 105088 | 590410 | 14499 | N/A | |
| OLFM3 | 118733 | 338858 | 14500 | 345192 | 32761 |
| OLFM3 | 118733 | 465523 | 14501 | N/A | |
| OLFM3 | 118733 | 370103 | 14502 | 359121 | 32762 |
| OLFM3 | 118733 | 462354 | 14503 | N/A | |
| OLFM3 | 118733 | 468901 | 14504 | N/A | |
| OLFM3 | 118733 | 536598 | 14505 | 443471 | 32763 |
| OLIG1 | 184221 | 382348 | 14506 | 371785 | 32764 |
| OLIG1 | 184221 | 426947 | 14507 | 414840 | 32765 |
| OLIG1 | 184221 | 498799 | 14508 | N/A | |
| OLIG2 | 205927 | 382357 | 14509 | 371794 | 32766 |
| OLIG2 | 205927 | 430860 | 14510 | 391183 | 32767 |
| OLIG2 | 205927 | 333337 | 14511 | 331040 | 32768 |
| OLIG2 | 205927 | 382357 | 14512 | 371794 | 32769 |
| OLIG2 | 205927 | 430860 | 14513 | 391183 | 32770 |
| OLIG2 | 205927 | 333337 | 14514 | 331040 | 32771 |
| ONECUT1 | 169856 | 305901 | 14515 | 302630 | 32772 |
| ONECUT1 | 169856 | 561401 | 14516 | N/A | |
| ONECUT1 | 169856 | 560699 | 14517 | 453718 | 32773 |
| ONECUT1 | 169856 | 570208 | 14518 | 476168 | 32774 |
| ONECUT2 | 119547 | 491143 | 14519 | 419185 | 32775 |
| ONECUT2 | 119547 | 481727 | 14520 | N/A | |
| OPALIN | 197430 | 371172 | 14521 | 360214 | 32776 |
| OPALIN | 197430 | 611913 | 14522 | 484599 | 32777 |
| OPALIN | 197430 | 393871 | 14523 | 377449 | 32778 |
| OPALIN | 197430 | 536387 | 14524 | 445125 | 32779 |
| OPALIN | 197430 | 419479 | 14525 | 398025 | 32780 |
| OPALIN | 197430 | 393870 | 14526 | 377448 | 32781 |
| OPHN1 | 079482 | 355520 | 14527 | 347710 | 32782 |
| OPHN1 | 079482 | 484842 | 14528 | N/A | |
| OPHN1 | 079482 | 467444 | 14529 | N/A | |
| OPHN1 | 079482 | 486068 | 14530 | N/A | |
| OPHN1 | 079482 | 491714 | 14531 | N/A | |
| OPLAH | 178814 | 618853 | 14532 | 480476 | 32783 |
| OPLAH | 178814 | 527993 | 14533 | N/A | |
| OPLAH | 178814 | 531027 | 14534 | N/A | |
| OPLAH | 178814 | 567871 | 14535 | 481640 | 32784 |
| OPRD1 | 116329 | 234961 | 14536 | 234961 | 32785 |
| OPRD1 | 116329 | 621425 | 14537 | 477970 | 32786 |
| OPTC | 188770 | 367222 | 14538 | 356191 | 32787 |
| OPTC | 188770 | 448911 | 14539 | 399491 | 32788 |
| OSBP | 110048 | 263847 | 14540 | 263847 | 32789 |
| OSBP | 110048 | 525357 | 14541 | 432399 | 32790 |
| OSBP | 110048 | 528903 | 14542 | N/A | |
| OSBPL10 | 144645 | 396556 | 14543 | 379804 | 32791 |
| OSBPL10 | 144645 | 429492 | 14544 | 416078 | 32792 |
| OSBPL10 | 144645 | 438237 | 14545 | 406124 | 32793 |
| OSBPL10 | 144645 | 469557 | 14546 | N/A | |
| OSBPL10 | 144645 | 467598 | 14547 | N/A | |
| OSBPL10 | 144645 | 472175 | 14548 | N/A | |
| OSBPL10 | 144645 | 479396 | 14549 | N/A | |
| OSBPL10 | 144645 | 490009 | 14550 | N/A | |
| OSBPL10 | 144645 | 467647 | 14551 | N/A | |
| OSBPL10 | 144645 | 428241 | 14552 | 399200 | 32794 |
| OSBPL10 | 144645 | 480671 | 14553 | N/A | |
| OSBPL10 | 144645 | 485205 | 14554 | N/A | |
| OSBPL10 | 144645 | 467955 | 14555 | N/A | |
| OSBPL10 | 144645 | 466604 | 14556 | N/A | |
| OSBPL10 | 144645 | 463504 | 14557 | N/A | |
| OSBPL10 | 144645 | 479173 | 14558 | N/A | |
| OSBPL10 | 144645 | 452791 | 14559 | N/A | |
| OSBPL10 | 144645 | 465626 | 14560 | N/A | |
| OSBPL3 | 070882 | 313367 | 14561 | 315410 | 32795 |
| OSBPL3 | 070882 | 409863 | 14562 | 386429 | 32796 |
| OSBPL3 | 070882 | 396431 | 14563 | 379708 | 32797 |
| OSBPL3 | 070882 | 409452 | 14564 | 386801 | 32798 |
| OSBPL3 | 070882 | 409759 | 14565 | 386325 | 32799 |
| OSBPL3 | 070882 | 487020 | 14566 | N/A | |
| OSBPL3 | 070882 | 409555 | 14567 | 386990 | 32800 |
| OSBPL3 | 070882 | 396429 | 14568 | 379706 | 32801 |
| OSBPL3 | 070882 | 409069 | 14569 | 386953 | 32802 |
| OSBPL3 | 070882 | 459987 | 14570 | N/A | |
| OSBPL3 | 070882 | 461835 | 14571 | N/A | |

| Symbol | ENSG | ENST | SEQ ID | ENSP | SEQ ID |
|---|---|---|---|---|---|
| OSBPL3 | 070882 | 415162 | 14572 | 407829 | 32803 |
| OSBPL3 | 070882 | 441059 | 14573 | 403374 | 32804 |
| OSBPL3 | 070882 | 415952 | 14574 | 411249 | 32805 |
| OTUD6B | 155100 | 285420 | 14575 | 285420 | 32806 |
| OTUD6B | 155100 | 522894 | 14576 | 428528 | 32807 |
| OTUD6B | 155100 | 524027 | 14577 | N/A | |
| OTUD6B | 155100 | 404789 | 14578 | 384190 | 32808 |
| OTUD6B | 155100 | 617869 | 14579 | 483706 | 32809 |
| OTUD6B | 155100 | 615618 | 14580 | 481196 | 32810 |
| OTUD6B-AS1 | 253738 | 522817 | 14581 | N/A | |
| OTUD6B-AS1 | 253738 | 524003 | 14582 | N/A | |
| OXSR1 | 172939 | 492714 | 14583 | N/A | |
| OXSR1 | 172939 | 446845 | 14584 | 415851 | 32811 |
| OXSR1 | 172939 | 311806 | 14585 | 311713 | 32812 |
| OXSR1 | 172939 | 426620 | 14586 | 398356 | 32813 |
| OXSR1 | 172939 | 483695 | 14587 | N/A | |
| OXSR1 | 172939 | 467900 | 14588 | N/A | |
| P2RY1 | 169860 | 305097 | 14589 | 304767 | 32814 |
| P2RY12 | 169313 | 302632 | 14590 | 307259 | 32815 |
| P2RY12 | 169313 | 468596 | 14591 | N/A | |
| P4HA1 | 122884 | 307116 | 14592 | 307318 | 32816 |
| P4HA1 | 122884 | 373008 | 14593 | 362099 | 32817 |
| P4HA1 | 122884 | 464310 | 14594 | N/A | |
| P4HA1 | 122884 | 440381 | 14595 | 414464 | 32818 |
| P4HA1 | 122884 | 394890 | 14596 | 378353 | 32819 |
| P4HA1 | 122884 | 263556 | 14597 | 263556 | 32820 |
| P4HA2 | 072682 | 401867 | 14598 | 384999 | 32821 |
| P4HA2 | 072682 | 379086 | 14599 | 368379 | 32822 |
| P4HA2 | 072682 | 166534 | 14600 | 166534 | 32823 |
| P4HA2 | 072682 | 360568 | 14601 | 353772 | 32824 |
| P4HA2 | 072682 | 474628 | 14602 | N/A | |
| P4HA2 | 072682 | 506807 | 14603 | N/A | |
| P4HA2 | 072682 | 467587 | 14604 | N/A | |
| P4HA2 | 072682 | 417528 | 14605 | 389523 | 32825 |
| P4HA2 | 072682 | 431054 | 14606 | 391257 | 32826 |
| P4HA2 | 072682 | 439698 | 14607 | 405406 | 32827 |
| P4HA2 | 072682 | 395164 | 14608 | 378593 | 32828 |
| P4HA2 | 072682 | 453286 | 14609 | 413542 | 32829 |
| P4HA2 | 072682 | 428369 | 14610 | 396495 | 32830 |
| P4HA2 | 072682 | 418055 | 14611 | 403883 | 32831 |
| P4HA2 | 072682 | 478055 | 14612 | N/A | |
| P4HA2 | 072682 | 416053 | 14613 | 394953 | 32832 |
| P4HA2 | 072682 | 428841 | 14614 | 395956 | 32833 |
| P4HA2 | 072682 | 471826 | 14615 | N/A | |
| P4HA2 | 072682 | 481636 | 14616 | N/A | |
| P4HA2 | 072682 | 379100 | 14617 | 368394 | 32834 |
| P4HA2 | 072682 | 379104 | 14618 | 368398 | 32835 |
| P4HA2-AS1 | 237714 | 417667 | 14619 | N/A | |
| PACS2 | 179364 | 430725 | 14620 | 393524 | 32836 |
| PACS2 | 179364 | 325438 | 14621 | 321834 | 32837 |
| PACS2 | 179364 | 447393 | 14622 | 393559 | 32838 |
| PACS2 | 179364 | 547217 | 14623 | 449525 | 32839 |
| PACS2 | 179364 | 548265 | 14624 | N/A | |
| PACS2 | 179364 | 546915 | 14625 | 447229 | 32840 |
| PACS2 | 179364 | 552138 | 14626 | N/A | |
| PACS2 | 179364 | 551692 | 14627 | N/A | |
| PACS2 | 179364 | 547903 | 14628 | N/A | |
| PACS2 | 179364 | 551743 | 14629 | N/A | |
| PACS2 | 179364 | 549030 | 14630 | N/A | |
| PACS2 | 179364 | 548796 | 14631 | N/A | |
| PACS2 | 179364 | 551801 | 14632 | N/A | |
| PACS2 | 179364 | 550790 | 14633 | N/A | |
| PAFAH1B1 | 007168 | 576586 | 14634 | 461087 | 32841 |
| PAFAH1B1 | 007168 | 397195 | 14635 | 380378 | 32842 |
| PAFAH1B1 | 007168 | 575477 | 14636 | N/A | |
| PAFAH1B1 | 007168 | 572915 | 14637 | N/A | |
| PAFAH1B1 | 007168 | 570400 | 14638 | 460258 | 32843 |
| PAFAH1B1 | 007168 | 571289 | 14639 | N/A | |
| PAFAH1B1 | 007168 | 574816 | 14640 | N/A | |
| PAFAH1B1 | 007168 | 609078 | 14641 | N/A | |
| PAFAH1B1 | 007168 | 397193 | 14642 | N/A | |
| PAFAH1B1 | 007168 | 574468 | 14643 | 460591 | 32844 |
| PAFAH1B1 | 007168 | 571495 | 14644 | N/A | |
| PAFAH1B1 | 007168 | 610190 | 14645 | N/A | |
| PAFAH1B1 | 007168 | 574213 | 14646 | N/A | |
| PAGR1 | 280789 | 320330 | 14647 | 326519 | 32845 |

| Symbol | ENSG | ENST | SEQ ID | ENSP | SEQ ID |
|---|---|---|---|---|---|
| PAK5 | 101349 | 378423 | 14648 | 367679 | 32846 |
| PAK5 | 101349 | 353224 | 14649 | 322957 | 32847 |
| PAK5 | 101349 | 378429 | 14650 | 367686 | 32848 |
| PALM2 | 243444 | 374531 | 14651 | 363656 | 32849 |
| PALM2 | 243444 | 483909 | 14652 | 417525 | 32850 |
| PALM2 | 243444 | 314527 | 14653 | 323805 | 32851 |
| PALM2 | 243444 | 497711 | 14654 | 419747 | 32852 |
| PALM2 | 243444 | 465091 | 14655 | N/A | |
| PAM | 145730 | 505654 | 14656 | 421569 | 32853 |
| PAM | 145730 | 508060 | 14657 | N/A | |
| PAM | 145730 | 510208 | 14658 | N/A | |
| PAM | 145730 | 506127 | 14659 | N/A | |
| PAM | 145730 | 512073 | 14660 | 420851 | 32854 |
| PAM | 145730 | 502472 | 14661 | N/A | |
| PAM | 145730 | 509523 | 14662 | N/A | |
| PAM | 145730 | 511839 | 14663 | 426448 | 32855 |
| PAM | 145730 | 511477 | 14664 | 421823 | 32856 |
| PAM | 145730 | 506006 | 14665 | 423611 | 32857 |
| PAM | 145730 | 509832 | 14666 | 423763 | 32858 |
| PAM | 145730 | 438793 | 14667 | 396493 | 32859 |
| PAM | 145730 | 346918 | 14668 | 282992 | 32860 |
| PAM | 145730 | 513648 | 14669 | N/A | |
| PAM | 145730 | 345721 | 14670 | 302544 | 32861 |
| PAM | 145730 | 348126 | 14671 | 314638 | 32862 |
| PAM | 145730 | 304400 | 14672 | 306100 | 32863 |
| PAM | 145730 | 455264 | 14673 | 403461 | 32864 |
| PAM | 145730 | 509636 | 14674 | N/A | |
| PAM | 145730 | 506260 | 14675 | N/A | |
| PAM | 145730 | 379799 | 14676 | 369125 | 32865 |
| PAM | 145730 | 505372 | 14677 | N/A | |
| PAM | 145730 | 511429 | 14678 | N/A | |
| PAM | 145730 | 510006 | 14679 | N/A | |
| PAM | 145730 | 515456 | 14680 | N/A | |
| PAM | 145730 | 501691 | 14681 | 424203 | 32866 |
| PAM | 145730 | 504456 | 14682 | N/A | |
| PANX2 | 073150 | 159647 | 14683 | 159647 | 32867 |
| PANX2 | 073150 | 395842 | 14684 | 379183 | 32868 |
| PANX2 | 073150 | 402472 | 14685 | 384148 | 32869 |
| PAQR4 | 162073 | 318782 | 14686 | 321804 | 32870 |
| PAQR4 | 162073 | 293978 | 14687 | 293978 | 32871 |
| PAQR4 | 162073 | 576565 | 14688 | 460326 | 32872 |
| PAQR4 | 162073 | 572687 | 14689 | 459418 | 32873 |
| PAQR4 | 162073 | 574988 | 14690 | 458683 | 32874 |
| PAQR6 | 160781 | 492619 | 14691 | N/A | |
| PAQR6 | 160781 | 292291 | 14692 | 292291 | 32875 |
| PAQR6 | 160781 | 335852 | 14693 | 338330 | 32876 |
| PAQR6 | 160781 | 340183 | 14694 | 341926 | 32877 |
| PAQR6 | 160781 | 491107 | 14695 | N/A | |
| PAQR6 | 160781 | 368270 | 14696 | 357253 | 32878 |
| PAQR6 | 160781 | 468632 | 14697 | N/A | |
| PAQR6 | 160781 | 480773 | 14698 | N/A | |
| PAQR6 | 160781 | 470198 | 14699 | N/A | |
| PAQR6 | 160781 | 475507 | 14700 | N/A | |
| PAQR6 | 160781 | 623241 | 14701 | 485607 | 32879 |
| PAQR6 | 160781 | 613336 | 14702 | 479864 | 32880 |
| PAQR6 | 160781 | 356983 | 14703 | 349474 | 32881 |
| PAQR6 | 160781 | 540423 | 14704 | 443167 | 32882 |
| PAQR6 | 160781 | 612424 | 14705 | 482685 | 32883 |
| PARD3 | 148498 | 374789 | 14706 | 363921 | 32884 |
| PARD3 | 148498 | 374788 | 14707 | 363920 | 32885 |
| PARD3 | 148498 | 346874 | 14708 | 340591 | 32886 |
| PARD3 | 148498 | 374794 | 14709 | 363926 | 32887 |
| PARD3 | 148498 | 350537 | 14710 | 311986 | 32888 |
| PARD3 | 148498 | 374790 | 14711 | 363922 | 32889 |
| PARD3 | 148498 | 466092 | 14712 | N/A | |
| PARD3 | 148498 | 374776 | 14713 | 363908 | 32890 |
| PARD3 | 148498 | 374773 | 14714 | 363905 | 32891 |
| PARD3 | 148498 | 374768 | 14715 | 363900 | 32892 |
| PARD3 | 148498 | 340077 | 14716 | 341844 | 32893 |
| PARD3 | 148498 | 545260 | 14717 | 440857 | 32894 |
| PARD3 | 148498 | 545693 | 14718 | 443147 | 32895 |
| PARD3 | 148498 | 544292 | 14719 | 444429 | 32896 |
| PARD3B | 116117 | 415947 | 14720 | 407718 | 32897 |
| PARD3B | 116117 | 406610 | 14721 | 385848 | 32898 |
| PARD3B | 116117 | 462231 | 14722 | 473503 | 32899 |
| PARD3B | 116117 | 471958 | 14723 | N/A | |

| Symbol | ENSG | ENST | SEQ ID | ENSP | SEQ ID |
|---|---|---|---|---|---|
| PARD3B | 116117 | 358768 | 14724 | 351618 | 32900 |
| PARD3B | 116117 | 351153 | 14725 | 317261 | 32901 |
| PARD3B | 116117 | 349953 | 14726 | 340280 | 32902 |
| PARD3B | 116117 | 489565 | 14727 | N/A | |
| PARD3B | 116117 | 465890 | 14728 | N/A | |
| PARD3B | 116117 | 494482 | 14729 | N/A | |
| PARD3B | 116117 | 488622 | 14730 | N/A | |
| PARD3B | 116117 | 613457 | 14731 | 484434 | 32903 |
| PARD3B | 116117 | 614500 | 14732 | 481918 | 32904 |
| PARD3B | 116117 | 622699 | 14733 | 482649 | 32905 |
| PARD6G | 178184 | 353265 | 14734 | 343144 | 32906 |
| PARD6G | 178184 | 470488 | 14735 | 468735 | 32907 |
| PARD6G | 178184 | 463384 | 14736 | 466076 | 32908 |
| PARD6G-AS1 | 267270 | 587254 | 14737 | N/A | |
| PARD6G-AS1 | 267270 | 586421 | 14738 | N/A | |
| PARD6G-AS1 | 267270 | 589574 | 14739 | N/A | |
| PARD6G-AS1 | 267270 | 588226 | 14740 | N/A | |
| PARD6G-AS1 | 267270 | 585422 | 14741 | N/A | |
| PARM1 | 169116 | 513238 | 14742 | 424276 | 32909 |
| PARM1 | 169116 | 307428 | 14743 | 370224 | 32910 |
| PATJ | 132849 | 635214 | 14744 | N/A | |
| PATJ | 132849 | 459752 | 14745 | N/A | |
| PATJ | 132849 | 484562 | 14746 | N/A | |
| PATJ | 132849 | 371158 | 14747 | 360200 | 32911 |
| PATJ | 132849 | 635023 | 14748 | 489335 | 32912 |
| PATJ | 132849 | 484937 | 14749 | 433669 | 32913 |
| PATJ | 132849 | 488913 | 14750 | N/A | |
| PATJ | 132849 | 493967 | 14751 | N/A | |
| PATJ | 132849 | 494842 | 14752 | 489200 | 32914 |
| PATJ | 132849 | 490547 | 14753 | 489475 | 32915 |
| PATJ | 132849 | 635137 | 14754 | 489159 | 32916 |
| PATJ | 132849 | 307297 | 14755 | 307496 | 32917 |
| PATJ | 132849 | 465798 | 14756 | 489130 | 32918 |
| PATJ | 132849 | 472512 | 14757 | N/A | |
| PATJ | 132849 | 316485 | 14758 | 326199 | 32919 |
| PATJ | 132849 | 613764 | 14759 | 479041 | 32920 |
| PAX2 | 075891 | 553492 | 14760 | N/A | |
| PAX2 | 075891 | 355243 | 14761 | 347385 | 32921 |
| PAX2 | 075891 | 370296 | 14762 | 359319 | 32922 |
| PAX2 | 075891 | 554363 | 14763 | N/A | |
| PAX2 | 075891 | 361791 | 14764 | 355069 | 32923 |
| PAX2 | 075891 | 427256 | 14765 | 398652 | 32924 |
| PAX2 | 075891 | 483202 | 14766 | N/A | |
| PAX2 | 075891 | 554172 | 14767 | 452489 | 32925 |
| PAX2 | 075891 | 428433 | 14768 | 396259 | 32926 |
| PAX3 | 135903 | 392069 | 14769 | 375921 | 32927 |
| PAX3 | 135903 | 344493 | 14770 | 342092 | 32928 |
| PAX3 | 135903 | 350526 | 14771 | 343052 | 32929 |
| PAX3 | 135903 | 336840 | 14772 | 338767 | 32930 |
| PAX3 | 135903 | 392070 | 14773 | 375922 | 32931 |
| PAX3 | 135903 | 409551 | 14774 | 386750 | 32932 |
| PAX3 | 135903 | 464706 | 14775 | N/A | |
| PAX3 | 135903 | 555548 | 14776 | N/A | |
| PAX3 | 135903 | 409828 | 14777 | 386817 | 32933 |
| PAX3 | 135903 | 258387 | 14778 | 258387 | 32934 |
| PAX6 | 007372 | 606377 | 14779 | 480025 | 32935 |
| PAX6 | 007372 | 640368 | 14780 | 492024 | 32936 |
| PAX6 | 007372 | 638914 | 14781 | 492315 | 32937 |
| PAX6 | 007372 | 419022 | 14782 | 404100 | 32938 |
| PAX6 | 007372 | 640610 | 14783 | 491295 | 32939 |
| PAX6 | 007372 | 379132 | 14784 | 368427 | 32940 |
| PAX6 | 007372 | 379109 | 14785 | 368403 | 32941 |
| PAX6 | 007372 | 379129 | 14786 | 368424 | 32942 |
| PAX6 | 007372 | 639916 | 14787 | 490963 | 32943 |
| PAX6 | 007372 | 638685 | 14788 | 492316 | 32944 |
| PAX6 | 007372 | 379107 | 14789 | 368401 | 32945 |
| PAX6 | 007372 | 638903 | 14790 | 492296 | 32946 |
| PAX6 | 007372 | 639409 | 14791 | 492476 | 32947 |
| PAX6 | 007372 | 640975 | 14792 | 491872 | 32948 |
| PAX6 | 007372 | 638963 | 14793 | 491948 | 32949 |
| PAX6 | 007372 | 638965 | 14794 | 492769 | 32950 |
| PAX6 | 007372 | 241001 | 14795 | 241001 | 32951 |
| PAX6 | 007372 | 474783 | 14796 | N/A | |
| PAX6 | 007372 | 638629 | 14797 | 490971 | 32952 |
| PAX6 | 007372 | 639548 | 14798 | 491944 | 32953 |
| PAX6 | 007372 | 640125 | 14799 | 492166 | 32954 |

| Symbol | ENSG | ENST | SEQ ID | ENSP | SEQ ID |
|---|---|---|---|---|---|
| PAX6 | 007372 | 481563 | 14800 | 492205 | 32955 |
| PAX6 | 007372 | 639386 | 14801 | 492658 | 32956 |
| PAX6 | 007372 | 638696 | 14802 | 492756 | 32957 |
| PAX6 | 007372 | 638755 | 14803 | 492181 | 32958 |
| PAX6 | 007372 | 470027 | 14804 | N/A | |
| PAX6 | 007372 | 640287 | 14805 | 492822 | 32959 |
| PAX6 | 007372 | 533333 | 14806 | N/A | |
| PAX6 | 007372 | 640613 | 14807 | 492587 | 32960 |
| PAX6 | 007372 | 423822 | 14808 | 388132 | 32961 |
| PAX6 | 007372 | 639061 | 14809 | 491324 | 32962 |
| PAX6 | 007372 | 640766 | 14810 | 491214 | 32963 |
| PAX6 | 007372 | 640963 | 14811 | 492397 | 32964 |
| PAX6 | 007372 | 471303 | 14812 | N/A | |
| PAX6 | 007372 | 379111 | 14813 | 368406 | 32965 |
| PAX6 | 007372 | 639950 | 14814 | 491862 | 32966 |
| PAX6 | 007372 | 464174 | 14815 | N/A | |
| PAX6 | 007372 | 494377 | 14816 | N/A | |
| PAX6 | 007372 | 638250 | 14817 | 491365 | 32967 |
| PAX6 | 007372 | 379123 | 14818 | 368418 | 32968 |
| PAX6 | 007372 | 640038 | 14819 | N/A | |
| PAX6 | 007372 | 524853 | 14820 | 431585 | 32969 |
| PAX6 | 007372 | 640872 | 14821 | 491065 | 32970 |
| PAX6 | 007372 | 639394 | 14822 | 492177 | 32971 |
| PAX6 | 007372 | 640735 | 14823 | N/A | |
| PAX6 | 007372 | 639109 | 14824 | 491904 | 32972 |
| PAX6 | 007372 | 638853 | 14825 | 491280 | 32973 |
| PAX6 | 007372 | 640460 | 14826 | 492802 | 32974 |
| PAX6 | 007372 | 638913 | 14827 | N/A | |
| PAX6 | 007372 | 638802 | 14828 | 492437 | 32975 |
| PAX6 | 007372 | 638346 | 14829 | 491267 | 32976 |
| PAX6 | 007372 | 530373 | 14830 | N/A | |
| PAX6 | 007372 | 379115 | 14831 | 368410 | 32977 |
| PAX6 | 007372 | 639006 | 14832 | 491210 | 32978 |
| PAX6 | 007372 | 639054 | 14833 | N/A | |
| PAX6 | 007372 | 640335 | 14834 | 492808 | 32979 |
| PAX6 | 007372 | 638762 | 14835 | 491517 | 32980 |
| PAX6 | 007372 | 438681 | 14836 | 404356 | 32981 |
| PAX6 | 007372 | 638878 | 14837 | 492081 | 32982 |
| PAX6 | 007372 | 639943 | 14838 | 491229 | 32983 |
| PAX6 | 007372 | 640431 | 14839 | 491779 | 32984 |
| PAX6 | 007372 | 532916 | 14840 | N/A | |
| PAX6 | 007372 | 531910 | 14841 | N/A | |
| PAX6 | 007372 | 639034 | 14842 | 491679 | 32985 |
| PAX6 | 007372 | 640172 | 14843 | N/A | |
| PAX6 | 007372 | 640684 | 14844 | 491492 | 32986 |
| PAX6 | 007372 | 639079 | 14845 | 492129 | 32987 |
| PAX6 | 007372 | 640242 | 14846 | 492409 | 32988 |
| PAX6 | 007372 | 455099 | 14847 | 397384 | 32989 |
| PAX6 | 007372 | 530714 | 14848 | N/A | |
| PAX6 | 007372 | 534353 | 14849 | N/A | |
| PAX6 | 007372 | 533156 | 14850 | N/A | |
| PAX6 | 007372 | 639920 | 14851 | 492111 | 32990 |
| PAX6 | 007372 | 534390 | 14852 | N/A | |
| PAX6 | 007372 | 527769 | 14853 | N/A | |
| PAX6 | 007372 | 532175 | 14854 | N/A | |
| PAX6 | 007372 | 525535 | 14855 | 436365 | 32991 |
| PAX6 | 007372 | 640251 | 14856 | N/A | |
| PAX6 | 007372 | 638278 | 14857 | N/A | |
| PAX6 | 007372 | 640617 | 14858 | N/A | |
| PAX6 | 007372 | 639203 | 14859 | N/A | |
| PAX6 | 007372 | 640819 | 14860 | N/A | |
| PAXBP1 | 159086 | 331923 | 14861 | 328992 | 32992 |
| PAXBP1 | 159086 | 466846 | 14862 | N/A | |
| PAXBP1 | 159086 | 443785 | 14863 | 393038 | 32993 |
| PAXBP1 | 159086 | 497873 | 14864 | N/A | |
| PAXBP1 | 159086 | 290178 | 14865 | 290178 | 32994 |
| PAXBP1 | 159086 | 445049 | 14866 | 408048 | 32995 |
| PAXBP1 | 159086 | 421049 | 14867 | 388973 | 32996 |
| PAXBP1 | 159086 | 472588 | 14868 | N/A | |
| PAXBP1 | 159086 | 464256 | 14869 | N/A | |
| PAXBP1 | 263141 | 573680 | 14870 | 458892 | 32997 |
| PAXBP1 | 263141 | 575821 | 14871 | N/A | |
| PAXBP1 | 263141 | 611190 | 14872 | N/A | |
| PAXBP1 | 263141 | 575419 | 14873 | N/A | |
| PAXBP1 | 263141 | 574159 | 14874 | 458262 | 32998 |
| PBX3 | 167081 | 428092 | 14875 | 397903 | 32999 |

-continued

| Symbol | ENSG | ENST | SEQ ID | ENSP | SEQ ID |
|---|---|---|---|---|---|
| PBX3 | 167081 | 491160 | 14876 | N/A | |
| PBX3 | 167081 | 538998 | 14877 | N/A | |
| PBX3 | 167081 | 492314 | 14878 | N/A | |
| PBX3 | 167081 | 447726 | 14879 | 387456 | 33000 |
| PBX3 | 167081 | 491787 | 14880 | 475679 | 33001 |
| PBX3 | 167081 | 373482 | 14881 | 362581 | 33002 |
| PBX3 | 167081 | 373492 | 14882 | 362591 | 33003 |
| PBX3 | 167081 | 373489 | 14883 | 362588 | 33004 |
| PBX3 | 167081 | 373487 | 14884 | 362586 | 33005 |
| PBX3 | 167081 | 497091 | 14885 | N/A | |
| PBX3 | 167081 | 342287 | 14886 | 341990 | 33006 |
| PBXIP1 | 163346 | 368465 | 14887 | 357450 | 33007 |
| PBXIP1 | 163346 | 368463 | 14888 | 357448 | 33008 |
| PBXIP1 | 163346 | 368460 | 14889 | 357445 | 33009 |
| PBXIP1 | 163346 | 498553 | 14890 | N/A | |
| PBXIP1 | 163346 | 490230 | 14891 | 432543 | 33010 |
| PBXIP1 | 163346 | 493133 | 14892 | N/A | |
| PC | 173599 | 529047 | 14893 | 435905 | 33011 |
| PC | 173599 | 393955 | 14894 | 377527 | 33012 |
| PC | 173599 | 393958 | 14895 | 377530 | 33013 |
| PC | 173599 | 528224 | 14896 | N/A | |
| PC | 173599 | 529352 | 14897 | N/A | |
| PC | 173599 | 530259 | 14898 | N/A | |
| PC | 173599 | 530187 | 14899 | N/A | |
| PC | 173599 | 524491 | 14900 | 434192 | 33014 |
| PC | 173599 | 531614 | 14901 | N/A | |
| PC | 173599 | 528403 | 14902 | N/A | |
| PC | 173599 | 534194 | 14903 | N/A | |
| PC | 173599 | 525476 | 14904 | N/A | |
| PC | 173599 | 393960 | 14905 | 377532 | 33015 |
| PC | 173599 | 628663 | 14906 | 486373 | 33016 |
| PC | 173599 | 529047 | 14907 | 435905 | 33017 |
| PC | 173599 | 393955 | 14908 | 377527 | 33018 |
| PC | 173599 | 393958 | 14909 | 377530 | 33019 |
| PC | 173599 | 528224 | 14910 | N/A | |
| PC | 173599 | 529352 | 14911 | N/A | |
| PC | 173599 | 530259 | 14912 | N/A | |
| PC | 173599 | 530187 | 14913 | N/A | |
| PC | 173599 | 524491 | 14914 | 434192 | 33020 |
| PC | 173599 | 531614 | 14915 | N/A | |
| PC | 173599 | 528403 | 14916 | N/A | |
| PC | 173599 | 534194 | 14917 | N/A | |
| PC | 173599 | 525476 | 14918 | N/A | |
| PC | 173599 | 393960 | 14919 | 377532 | 33021 |
| PC | 173599 | 628663 | 14920 | 486373 | 33022 |
| PKD1 | 008710 | 262304 | 14921 | 262304 | 33023 |
| PKD1 | 008710 | 423118 | 14922 | 399501 | 33024 |
| PKD1 | 008710 | 472577 | 14923 | N/A | |
| PKD1 | 008710 | 564313 | 14924 | N/A | |
| PKD1 | 008710 | 561668 | 14925 | 461391 | 33025 |
| PKD1 | 008710 | 487932 | 14926 | 457132 | 33026 |
| PKD1 | 008710 | 485120 | 14927 | N/A | |
| PKD1 | 008710 | 562425 | 14928 | 455753 | 33027 |
| PKD1 | 008710 | 567355 | 14929 | N/A | |
| PKD1 | 008710 | 472659 | 14930 | N/A | |
| PKD1 | 008710 | 568796 | 14931 | N/A | |
| PKD1 | 008710 | 570253 | 14932 | N/A | |
| PKD1 | 008710 | 562297 | 14933 | N/A | |
| PKD1 | 008710 | 567946 | 14934 | 457984 | 33028 |
| PKD1 | 008710 | 486339 | 14935 | N/A | |
| PKD1 | 008710 | 415938 | 14936 | N/A | |
| PKD1 | 008710 | 483731 | 14937 | N/A | |
| PKD1 | 008710 | 566905 | 14938 | N/A | |
| PKD1 | 008710 | 496574 | 14939 | N/A | |
| PKD1 | 008710 | 566784 | 14940 | N/A | |
| PKD1 | 008710 | 471603 | 14941 | N/A | |
| PKD1 | 008710 | 480227 | 14942 | N/A | |
| PKD1 | 008710 | 570193 | 14943 | N/A | |
| PKD1 | 008710 | 469851 | 14944 | N/A | |
| PKD1 | 008710 | 483814 | 14945 | N/A | |
| PKD1 | 008710 | 474088 | 14946 | N/A | |
| PKD1 | 008710 | 475889 | 14947 | N/A | |
| PKD1 | 008710 | 561991 | 14948 | N/A | |
| PKD1 | 008710 | 565639 | 14949 | N/A | |
| PKD1 | 008710 | 564865 | 14950 | N/A | |
| PKD1 | 008710 | 564890 | 14951 | N/A | |

-continued

| Symbol | ENSG | ENST | SEQ ID | ENSP | SEQ ID |
|---|---|---|---|---|---|
| PKD1 | 008710 | 483558 | 14952 | N/A | |
| PKD1 | 008710 | 568591 | 14953 | 457162 | 33029 |
| PKD1 | 008710 | 569983 | 14954 | N/A | |
| PKD1 | 008710 | 483024 | 14955 | 456670 | 33030 |
| PKD1 | 008710 | 488185 | 14956 | 456672 | 33031 |
| PKD1 | 008710 | 473780 | 14957 | N/A | |
| PKD1 | 008710 | 468674 | 14958 | N/A | |
| PKD1 | 008710 | 469241 | 14959 | N/A | |
| PKD1 | 008710 | 570150 | 14960 | N/A | |
| PKD2 | 118762 | 237596 | 14961 | 237596 | 33032 |
| PKD2 | 118762 | 506727 | 14962 | N/A | |
| PKD2 | 118762 | 506367 | 14963 | N/A | |
| PKD2 | 118762 | 508588 | 14964 | 427131 | 33033 |
| PKD2 | 118762 | 511337 | 14965 | N/A | |
| PKD2 | 118762 | 512858 | 14966 | N/A | |
| PKD2 | 118762 | 502363 | 14967 | 425289 | 33034 |
| PCSK5 | 099139 | 376767 | 14968 | 365958 | 33035 |
| PCSK5 | 099139 | 376752 | 14969 | 365943 | 33036 |
| PCSK5 | 099139 | 424854 | 14970 | 411654 | 33037 |
| PCSK5 | 099139 | 455778 | 14971 | 407239 | 33038 |
| PCSK5 | 099139 | 545128 | 14972 | 446280 | 33039 |
| PCSK5 | 099139 | 376767 | 14973 | 365958 | 33040 |
| PCSK5 | 099139 | 376752 | 14974 | 365943 | 33041 |
| PCSK5 | 099139 | 424854 | 14975 | 411654 | 33042 |
| PCSK5 | 099139 | 455778 | 14976 | 407239 | 33043 |
| PCSK5 | 099139 | 545128 | 14977 | 446280 | 33044 |
| PCSK7 | 160613 | 320934 | 14978 | 325917 | 33045 |
| PCSK7 | 160613 | 534529 | 14979 | N/A | |
| PCSK7 | 160613 | 529458 | 14980 | N/A | |
| PCSK7 | 160613 | 527037 | 14981 | N/A | |
| PCSK7 | 160613 | 527861 | 14982 | N/A | |
| PCSK7 | 160613 | 532810 | 14983 | N/A | |
| PCSK7 | 160613 | 531573 | 14984 | N/A | |
| PCSK7 | 160613 | 533135 | 14985 | N/A | |
| PCSK7 | 160613 | 528973 | 14986 | N/A | |
| PCSK7 | 160613 | 528217 | 14987 | N/A | |
| PCSK7 | 160613 | 525027 | 14988 | 431181 | 33046 |
| PCSK7 | 160613 | 524507 | 14989 | 433841 | 33047 |
| PCSK7 | 160613 | 532301 | 14990 | 436459 | 33048 |
| PCSK7 | 160613 | 530269 | 14991 | 433252 | 33049 |
| PCSK7 | 160613 | 540028 | 14992 | 441944 | 33050 |
| PCBP1 | 169564 | 303577 | 14993 | 305556 | 33051 |
| PCDH1 | 156453 | 287008 | 14994 | 287008 | 33052 |
| PCDH1 | 156453 | 503492 | 14995 | 424667 | 33053 |
| PCDH1 | 156453 | 394536 | 14996 | 378043 | 33054 |
| PCDH1 | 156453 | 511044 | 14997 | N/A | |
| PCDH1 | 156453 | 515351 | 14998 | 424204 | 33055 |
| PCDH1 | 156453 | 357517 | 14999 | N/A | |
| PCDH1 | 156453 | 505937 | 15000 | 424004 | 33056 |
| PCDH1 | 156453 | 514773 | 15001 | 424163 | 33057 |
| PCDH15 | 150275 | 373965 | 15002 | 363076 | 33058 |
| PCDH15 | 150275 | 616114 | 15003 | 483745 | 33059 |
| PCDH15 | 150275 | 621708 | 15004 | 484454 | 33060 |
| PCDH15 | 150275 | 495484 | 15005 | 480780 | 33061 |
| PCDH15 | 150275 | 618301 | 15006 | 482780 | 33062 |
| PCDH15 | 150275 | 476074 | 15007 | N/A | |
| PCDH15 | 150275 | 395442 | 15008 | 378829 | 33063 |
| PCDH15 | 150275 | 395440 | 15009 | 378827 | 33064 |
| PCDH15 | 150275 | 617271 | 15010 | 478076 | 33065 |
| PCDH15 | 150275 | 395446 | 15011 | 378833 | 33066 |
| PCDH15 | 150275 | 409834 | 15012 | 386693 | 33067 |
| PCDH15 | 150275 | 414367 | 15013 | 412531 | 33068 |
| PCDH15 | 150275 | 613657 | 15014 | 482794 | 33069 |
| PCDH15 | 150275 | 615043 | 15015 | 478551 | 33070 |
| PCDH15 | 150275 | 395445 | 15016 | 378832 | 33071 |
| PCDH15 | 150275 | 361849 | 15017 | 354950 | 33072 |
| PCDH15 | 150275 | 395430 | 15018 | 378818 | 33073 |
| PCDH15 | 150275 | 395433 | 15019 | 378821 | 33074 |
| PCDH15 | 150275 | 373956 | 15020 | 363067 | 33075 |
| PCDH15 | 150275 | 373957 | 15021 | 363068 | 33076 |
| PCDH15 | 150275 | 448885 | 15022 | 412320 | 33077 |
| PCDH15 | 150275 | 437009 | 15023 | 412628 | 33078 |
| PCDH15 | 150275 | 463095 | 15024 | N/A | |
| PCDH15 | 150275 | 320301 | 15025 | 322604 | 33079 |
| PCDH15 | 150275 | 373955 | 15026 | 363066 | 33080 |
| PCDH15 | 150275 | 613346 | 15027 | 481211 | 33081 |

-continued

-continued

| Symbol | ENSG | ENST | SEQ ID | ENSP | SEQ ID |
|---|---|---|---|---|---|
| PCDH15 | 150275 | 458638 | 15028 | 394465 | 33082 |
| PCDH15 | 150275 | 395432 | 15029 | 378820 | 33083 |
| PCDH15 | 150275 | 617051 | 15030 | 484703 | 33084 |
| PCDH15 | 150275 | 614895 | 15031 | 478512 | 33085 |
| PCDH15 | 150275 | 622048 | 15032 | 482329 | 33086 |
| PCDH15 | 150275 | 414778 | 15033 | 410304 | 33087 |
| PCDH15 | 150275 | 395438 | 15034 | 378826 | 33088 |
| PCDH15 | 150275 | 612394 | 15035 | 482921 | 33089 |
| PCDH17 | 118946 | 484979 | 15036 | 432899 | 33090 |
| PCDH17 | 118946 | 377918 | 15037 | 367151 | 33091 |
| PCDH17 | 118946 | 612954 | 15038 | 481329 | 33092 |
| PCDH17 | 118946 | 615375 | 15039 | 483215 | 33093 |
| PCDH9 | 184226 | 377865 | 15040 | 367096 | 33094 |
| PCDH9 | 184226 | 544246 | 15041 | 442186 | 33095 |
| PCDH9 | 184226 | 456367 | 15042 | 401699 | 33096 |
| PCDH9 | 184226 | 617020 | 15043 | N/A | |
| PCDH9 | 184226 | 614931 | 15044 | 482917 | 33097 |
| PCDH9 | 184226 | 377861 | 15045 | 367092 | 33098 |
| PCDHA1 | 204970 | 378133 | 15046 | 367373 | 33099 |
| PCDHA1 | 204970 | 394633 | 15047 | 378129 | 33100 |
| PCDHA1 | 204970 | 504120 | 15048 | 420840 | 33101 |
| PCDHA3 | 255408 | 522353 | 15049 | 429808 | 33102 |
| PCDHA3 | 255408 | 532566 | 15050 | 434086 | 33103 |
| PCGF5 | 180628 | 496708 | 15051 | N/A | |
| PCGF5 | 180628 | 490164 | 15052 | N/A | |
| PCGF5 | 180628 | 336126 | 15053 | 337500 | 33104 |
| PCGF5 | 180628 | 543648 | 15054 | 445704 | 33105 |
| PCGF5 | 180628 | 614189 | 15055 | 479492 | 33106 |
| PCK1 | 124253 | 467047 | 15056 | N/A | |
| PCK1 | 124253 | 319441 | 15057 | 319814 | 33107 |
| PCK1 | 124253 | 475833 | 15058 | N/A | |
| PCK1 | 124253 | 498194 | 15059 | N/A | |
| PCK1 | 124253 | 470051 | 15060 | N/A | |
| PCK1 | 124253 | 485958 | 15061 | N/A | |
| PCP2 | 174788 | 598935 | 15062 | 472761 | 33108 |
| PCP2 | 174788 | 311069 | 15063 | 310585 | 33109 |
| PCP4 | 183036 | 328619 | 15064 | 329403 | 33110 |
| PCP4 | 183036 | 462224 | 15065 | 433172 | 33111 |
| PCP4 | 183036 | 468717 | 15066 | N/A | |
| PCP4 | 183036 | 467565 | 15067 | N/A | |
| PCSK6 | 140479 | 558864 | 15068 | 452839 | 33112 |
| PCSK6 | 140479 | 558951 | 15069 | 453771 | 33113 |
| PCSK6 | 140479 | 611716 | 15070 | 482760 | 33114 |
| PCSK6 | 140479 | 398185 | 15071 | 381246 | 33115 |
| PCSK6 | 140479 | 559499 | 15072 | N/A | |
| PCSK6 | 140479 | 618548 | 15073 | 479496 | 33116 |
| PCSK6 | 140479 | 557794 | 15074 | N/A | |
| PCSK6 | 140479 | 632686 | 15075 | 487813 | 33117 |
| PCSK6 | 140479 | 558433 | 15076 | N/A | |
| PCSK6 | 140479 | 559430 | 15077 | N/A | |
| PCSK6 | 140479 | 560785 | 15078 | N/A | |
| PCSK6 | 140479 | 622483 | 15079 | 481556 | 33118 |
| PCSK6 | 140479 | 619160 | 15080 | 482831 | 33119 |
| PCSK6 | 140479 | 559605 | 15081 | 453155 | 33120 |
| PCSK6 | 140479 | 560902 | 15082 | N/A | |
| PCSK6 | 140479 | 611967 | 15083 | 477768 | 33121 |
| PCSK6 | 140479 | 615296 | 15084 | 478081 | 33122 |
| PCSK6 | 140479 | 621185 | 15085 | 483048 | 33123 |
| PCSK6 | 140479 | 558154 | 15086 | N/A | |
| PCSK6 | 140479 | 559417 | 15087 | 452997 | 33124 |
| PCSK6 | 140479 | 331826 | 15088 | 332052 | 33125 |
| PCYT1B | 102230 | 379145 | 15089 | 368440 | 33126 |
| PCYT1B | 102230 | 356768 | 15090 | 349211 | 33127 |
| PCYT1B | 102230 | 379144 | 15091 | 368439 | 33128 |
| PCYT1B | 102230 | 496020 | 15092 | 436562 | 33129 |
| PDC | 116703 | 391997 | 15093 | 375855 | 33130 |
| PDC | 116703 | 497198 | 15094 | 422775 | 33131 |
| PDE1A | 115252 | 435564 | 15095 | 410309 | 33132 |
| PDE1A | 115252 | 409365 | 15096 | 386767 | 33133 |
| PDE1A | 115252 | 410103 | 15097 | 387037 | 33134 |
| PDE1A | 115252 | 482538 | 15098 | N/A | |
| PDE1A | 115252 | 462938 | 15099 | N/A | |
| PDE1A | 115252 | 482782 | 15100 | N/A | |
| PDE1A | 115252 | 495511 | 15101 | N/A | |
| PDE1A | 115252 | 351439 | 15102 | 309269 | 33135 |
| PDE1A | 115252 | 358139 | 15103 | 350858 | 33136 |

| Symbol | ENSG | ENST | SEQ ID | ENSP | SEQ ID |
|---|---|---|---|---|---|
| PDE1A | 115252 | 435564 | 15104 | 410309 | 33137 |
| PDE1A | 115252 | 409365 | 15105 | 386767 | 33138 |
| PDE1A | 115252 | 410103 | 15106 | 387037 | 33139 |
| PDE1A | 115252 | 482538 | 15107 | N/A | |
| PDE1A | 115252 | 462938 | 15108 | N/A | |
| PDE1A | 115252 | 482782 | 15109 | N/A | |
| PDE1A | 115252 | 495511 | 15110 | N/A | |
| PDE1A | 115252 | 351439 | 15111 | 309269 | 33140 |
| PDE1A | 115252 | 358139 | 15112 | 350858 | 33141 |
| PDE1B | 123360 | 243052 | 15113 | 243052 | 33142 |
| PDE1B | 123360 | 611899 | 15114 | 478185 | 33143 |
| PDE1B | 123360 | 548855 | 15115 | N/A | |
| PDE1B | 123360 | 550285 | 15116 | 447354 | 33144 |
| PDE1B | 123360 | 538346 | 15117 | 442559 | 33145 |
| PDE1B | 123360 | 394277 | 15118 | N/A | |
| PDE1B | 123360 | 550620 | 15119 | 448519 | 33146 |
| PDE1B | 123360 | 542335 | 15120 | N/A | |
| PDE1B | 123360 | 552774 | 15121 | N/A | |
| PDE1C | 154678 | 396193 | 15122 | 379496 | 33147 |
| PDE1C | 154678 | 396191 | 15123 | 379494 | 33148 |
| PDE1C | 154678 | 321453 | 15124 | 318105 | 33149 |
| PDE1C | 154678 | 396184 | 15125 | 379487 | 33150 |
| PDE1C | 154678 | 479980 | 15126 | N/A | |
| PDE1C | 154678 | 396182 | 15127 | 379485 | 33151 |
| PDE1C | 154678 | 478736 | 15128 | N/A | |
| PDE1C | 154678 | 482681 | 15129 | N/A | |
| PDE1C | 154678 | 464881 | 15130 | N/A | |
| PDE1C | 154678 | 396189 | 15131 | 379492 | 33152 |
| PDE1C | 154678 | 495221 | 15132 | N/A | |
| PDE3A | 172572 | 359062 | 15133 | 351957 | 33153 |
| PDE3A | 172572 | 542675 | 15134 | N/A | |
| PDE3A | 172572 | 544307 | 15135 | N/A | |
| PDE3B | 152270 | 282096 | 15136 | 282096 | 33154 |
| PDE3B | 152270 | 455098 | 15137 | 388644 | 33155 |
| PDE3B | 152270 | 534317 | 15138 | N/A | |
| PDE3B | 152270 | 532740 | 15139 | N/A | |
| PDE3B | 152270 | 525439 | 15140 | N/A | |
| PDE4D | 113448 | 340635 | 15141 | 345502 | 33156 |
| PDE4D | 113448 | 636120 | 15142 | 490821 | 33157 |
| PDE4D | 113448 | 360047 | 15143 | 353152 | 33158 |
| PDE4D | 113448 | 507116 | 15144 | 424852 | 33159 |
| PDE4D | 113448 | 358923 | 15145 | 351800 | 33160 |
| PDE4D | 113448 | 317118 | 15146 | 321739 | 33161 |
| PDE4D | 113448 | 503258 | 15147 | 425605 | 33162 |
| PDE4D | 113448 | 405755 | 15148 | 384806 | 33163 |
| PDE4D | 113448 | 515011 | 15149 | N/A | |
| PDE4D | 113448 | 502484 | 15150 | 423094 | 33164 |
| PDE4D | 113448 | 505453 | 15151 | 421013 | 33165 |
| PDE4D | 113448 | 309641 | 15152 | 308485 | 33166 |
| PDE4D | 113448 | 405053 | 15153 | N/A | |
| PDE4D | 113448 | 502575 | 15154 | 425917 | 33167 |
| PDE4D | 113448 | 621323 | 15155 | N/A | |
| PDE4D | 113448 | 515324 | 15156 | N/A | |
| PDE4D | 113448 | 514231 | 15157 | N/A | |
| PDE4D | 113448 | 512069 | 15158 | N/A | |
| PDE4D | 113448 | 509368 | 15159 | 423555 | 33168 |
| PDE4D | 113448 | 509355 | 15160 | N/A | |
| PDE4D | 113448 | 501624 | 15161 | N/A | |
| PDE4D | 113448 | 506024 | 15162 | N/A | |
| PDE4D | 113448 | 506510 | 15163 | N/A | |
| PDE4D | 113448 | 511382 | 15164 | N/A | |
| PDE4D | 113448 | 505507 | 15165 | 425910 | 33169 |
| PDE4D | 113448 | 514552 | 15166 | 421829 | 33170 |
| PDE4D | 113448 | 515835 | 15167 | 424281 | 33171 |
| PDE4D | 113448 | 546160 | 15168 | 442734 | 33172 |
| PDE4D | 113448 | 638939 | 15169 | 492052 | 33173 |
| PDE5A | 138735 | 354960 | 15170 | 347046 | 33174 |
| PDE5A | 138735 | 264805 | 15171 | 264805 | 33175 |
| PDE5A | 138735 | 503412 | 15172 | 425810 | 33176 |
| PDE5A | 138735 | 512494 | 15173 | N/A | |
| PDE5A | 138735 | 509612 | 15174 | N/A | |
| PDE5A | 138735 | 513594 | 15175 | N/A | |
| PDE5A | 138735 | 512450 | 15176 | N/A | |
| PDE5A | 138735 | 512739 | 15177 | N/A | |
| PDE5A | 138735 | 502912 | 15178 | N/A | |
| PDE5A | 138735 | 508914 | 15179 | N/A | |

-continued

| Symbol | ENSG | ENST | SEQ ID | ENSP | SEQ ID |
|---|---|---|---|---|---|
| PDE5A | 138735 | 420633 | 15180 | 416309 | 33177 |
| PDE5A | 138735 | 394439 | 15181 | 377957 | 33178 |
| PDE7A | 205268 | 401827 | 15182 | 385632 | 33179 |
| PDE7A | 205268 | 379419 | 15183 | 368730 | 33180 |
| PDE7A | 205268 | 396642 | 15184 | 379881 | 33181 |
| PDE7A | 205268 | 522220 | 15185 | N/A | |
| PDE7A | 205268 | 518667 | 15186 | N/A | |
| PDE7A | 205268 | 519231 | 15187 | N/A | |
| PDE7A | 205268 | 523253 | 15188 | 430262 | 33182 |
| PDE7A | 205268 | 519626 | 15189 | N/A | |
| PDE7B | 171408 | 308191 | 15190 | 310661 | 33183 |
| PDE7B | 171408 | 446774 | 15191 | 403732 | 33184 |
| PDE7B | 171408 | 615259 | 15192 | 482117 | 33185 |
| PDE8A | 073417 | 310298 | 15193 | 311453 | 33186 |
| PDE8A | 073417 | 557957 | 15194 | 453808 | 33187 |
| PDE8A | 073417 | 339708 | 15195 | 340679 | 33188 |
| PDE8A | 073417 | 478717 | 15196 | 432309 | 33189 |
| PDE8A | 073417 | 485596 | 15197 | 431976 | 33190 |
| PDE8A | 073417 | 559742 | 15198 | 452907 | 33191 |
| PDE8A | 073417 | 559086 | 15199 | 454094 | 33192 |
| PDE8A | 073417 | 560789 | 15200 | N/A | |
| PDE8A | 073417 | 557819 | 15201 | N/A | |
| PDE8A | 073417 | 558543 | 15202 | N/A | |
| PDE8A | 073417 | 557954 | 15203 | N/A | |
| PDE8A | 073417 | 561105 | 15204 | N/A | |
| PDE8A | 073417 | 561374 | 15205 | N/A | |
| PDE8A | 073417 | 560333 | 15206 | N/A | |
| PDE8A | 073417 | 561024 | 15207 | N/A | |
| PDE8A | 073417 | 394553 | 15208 | 378056 | 33193 |
| PDE8B | 113231 | 505926 | 15209 | 425720 | 33194 |
| PDE8B | 113231 | 340978 | 15210 | 345446 | 33195 |
| PDE8B | 113231 | 346042 | 15211 | 330428 | 33196 |
| PDE8B | 113231 | 264917 | 15212 | 264917 | 33197 |
| PDE8B | 113231 | 342343 | 15213 | 345646 | 33198 |
| PDE8B | 113231 | 333194 | 15214 | 331336 | 33199 |
| PDE8B | 113231 | 502945 | 15215 | 426200 | 33200 |
| PDE8B | 113231 | 503963 | 15216 | 422861 | 33201 |
| PDE8B | 113231 | 505283 | 15217 | 423461 | 33202 |
| PDE9A | 160191 | 335512 | 15218 | 335242 | 33203 |
| PDE9A | 160191 | 470987 | 15219 | N/A | |
| PDE9A | 160191 | 291539 | 15220 | 291539 | 33204 |
| PDE9A | 160191 | 490803 | 15221 | N/A | |
| PDE9A | 160191 | 486902 | 15222 | N/A | |
| PDE9A | 160191 | 380328 | 15223 | 369685 | 33205 |
| PDE9A | 160191 | 495521 | 15224 | N/A | |
| PDE9A | 160191 | 398232 | 15225 | 381287 | 33206 |
| PDE9A | 160191 | 462571 | 15226 | N/A | |
| PDE9A | 160191 | 398234 | 15227 | 381289 | 33207 |
| PDE9A | 160191 | 398236 | 15228 | 381291 | 33208 |
| PDE9A | 160191 | 468805 | 15229 | N/A | |
| PDE9A | 160191 | 328862 | 15230 | 328699 | 33209 |
| PDE9A | 160191 | 335440 | 15231 | 335365 | 33210 |
| PDE9A | 160191 | 398225 | 15232 | 381281 | 33211 |
| PDE9A | 160191 | 497805 | 15233 | N/A | |
| PDE9A | 160191 | 398229 | 15234 | 381285 | 33212 |
| PDE9A | 160191 | 398227 | 15235 | 381283 | 33213 |
| PDE9A | 160191 | 460989 | 15236 | N/A | |
| PDE9A | 160191 | 467403 | 15237 | N/A | |
| PDE9A | 160191 | 349112 | 15238 | 344730 | 33214 |
| PDE9A | 160191 | 398224 | 15239 | 381280 | 33215 |
| PDE9A | 160191 | 467162 | 15240 | N/A | |
| PDE9A | 160191 | 495343 | 15241 | N/A | |
| PDE9A | 160191 | 489319 | 15242 | N/A | |
| PDE9A | 160191 | 466472 | 15243 | N/A | |
| PDE9A | 160191 | 460905 | 15244 | N/A | |
| PDE9A | 160191 | 472401 | 15245 | N/A | |
| PDGFC | 145431 | 502773 | 15246 | 422464 | 33216 |
| PDGFC | 145431 | 274071 | 15247 | 274071 | 33217 |
| PDGFC | 145431 | 504672 | 15248 | N/A | |
| PDGFC | 145431 | 506880 | 15249 | 424600 | 33218 |
| PDGFC | 145431 | 422544 | 15250 | 410048 | 33219 |
| PDGFC | 145431 | 510982 | 15251 | N/A | |
| PDGFC | 145431 | 511985 | 15252 | N/A | |
| PDGFC | 145431 | 512711 | 15253 | N/A | |
| PDGFC | 145431 | 513664 | 15254 | N/A | |
| PDGFD | 170962 | 529268 | 15255 | 432909 | 33220 |

-continued

| Symbol | ENSG | ENST | SEQ ID | ENSP | SEQ ID |
|---|---|---|---|---|---|
| PDGFD | 170962 | 302251 | 15256 | 302193 | 33221 |
| PDGFD | 170962 | 393158 | 15257 | 376865 | 33222 |
| PDGFRA | 134853 | 257290 | 15258 | 257290 | 33223 |
| PDGFRA | 134853 | 508170 | 15259 | 425648 | 33224 |
| PDGFRA | 134853 | 509092 | 15260 | N/A | |
| PDGFRA | 134853 | 512143 | 15261 | 425626 | 33225 |
| PDGFRA | 134853 | 509490 | 15262 | 424218 | 33226 |
| PDGFRA | 134853 | 503856 | 15263 | 425902 | 33227 |
| PDGFRA | 134853 | 504461 | 15264 | 426472 | 33228 |
| PDGFRA | 134853 | 512522 | 15265 | 425232 | 33229 |
| PDGFRA | 134853 | 461294 | 15266 | N/A | |
| PDGFRA | 134853 | 507536 | 15267 | N/A | |
| PDGFRA | 134853 | 257290 | 15268 | 257290 | 33230 |
| PDGFRA | 134853 | 508170 | 15269 | 425648 | 33231 |
| PDGFRA | 134853 | 509092 | 15270 | N/A | |
| PDGFRA | 134853 | 512143 | 15271 | 425626 | 33232 |
| PDGFRA | 134853 | 509490 | 15272 | 424218 | 33233 |
| PDGFRA | 134853 | 503856 | 15273 | 425902 | 33234 |
| PDGFRA | 134853 | 504461 | 15274 | 426472 | 33235 |
| PDGFRA | 134853 | 512522 | 15275 | 425232 | 33236 |
| PDGFRA | 134853 | 461294 | 15276 | N/A | |
| PDGFRA | 134853 | 507536 | 15277 | N/A | |
| PDGFRB | 113721 | 261799 | 15278 | 261799 | 33237 |
| PDGFRB | 113721 | 520851 | 15279 | N/A | |
| PDGFRB | 113721 | 520579 | 15280 | 430026 | 33238 |
| PDGFRB | 113721 | 519575 | 15281 | N/A | |
| PDGFRB | 113721 | 521723 | 15282 | N/A | |
| PDGFRB | 113721 | 520229 | 15283 | N/A | |
| PDGFRB | 113721 | 522466 | 15284 | N/A | |
| PDGFRB | 113721 | 517488 | 15285 | 429218 | 33239 |
| PDGFRB | 113721 | 517957 | 15286 | 430715 | 33240 |
| PDGFRB | 113721 | 517660 | 15287 | N/A | |
| PDGFRB | 113721 | 523456 | 15288 | N/A | |
| PDK3 | 067992 | 379162 | 15289 | 368460 | 33241 |
| PDK3 | 067992 | 441463 | 15290 | 387536 | 33242 |
| PDK3 | 067992 | 493226 | 15291 | N/A | |
| PDLIM3 | 154553 | 284770 | 15292 | 284770 | 33243 |
| PDLIM3 | 154553 | 514142 | 15293 | N/A | |
| PDLIM3 | 154553 | 284771 | 15294 | 284771 | 33244 |
| PDLIM3 | 154553 | 514308 | 15295 | N/A | |
| PDLIM3 | 154553 | 505886 | 15296 | 425138 | 33245 |
| PDLIM3 | 154553 | 512293 | 15297 | 421972 | 33246 |
| PDLIM3 | 154553 | 504011 | 15298 | N/A | |
| PDLIM3 | 154553 | 504355 | 15299 | N/A | |
| PDLIM3 | 154553 | 512380 | 15300 | N/A | |
| PDLIM3 | 154553 | 515261 | 15301 | N/A | |
| PDLIM3 | 154553 | 620787 | 15302 | 481771 | 33247 |
| PDLIM3 | 154553 | 284767 | 15303 | 284767 | 33248 |
| PDLIM3 | 154553 | 629667 | 15304 | 486107 | 33249 |
| PDLIM4 | 131435 | 253754 | 15305 | 253754 | 33250 |
| PDLIM4 | 131435 | 463615 | 15306 | N/A | |
| PDLIM4 | 131435 | 474421 | 15307 | N/A | |
| PDLIM4 | 131435 | 379018 | 15308 | 368303 | 33251 |
| PDLIM4 | 131435 | 418373 | 15309 | 411753 | 33252 |
| PDLIM4 | 131435 | 484620 | 15310 | N/A | |
| PDLIM4 | 131435 | 462597 | 15311 | N/A | |
| PDZD3 | 172367 | 527308 | 15312 | N/A | |
| PDZD3 | 172367 | 526279 | 15313 | N/A | |
| PDZD3 | 172367 | 527951 | 15314 | N/A | |
| PDZD3 | 172367 | 525131 | 15315 | 434559 | 33253 |
| PDZD3 | 172367 | 534790 | 15316 | N/A | |
| PDZD3 | 172367 | 529098 | 15317 | N/A | |
| PDZD3 | 172367 | 527028 | 15318 | N/A | |
| PDZD3 | 172367 | 531114 | 15319 | 431164 | 33254 |
| PDZD3 | 172367 | 533688 | 15320 | 434264 | 33255 |
| PDZD3 | 172367 | 355547 | 15321 | 347742 | 33256 |
| PDZD3 | 172367 | 526836 | 15322 | N/A | |
| PDZD3 | 172367 | 528730 | 15323 | N/A | |
| PDZD3 | 172367 | 322712 | 15324 | 327107 | 33257 |
| PDZD3 | 172367 | 529573 | 15325 | N/A | |
| PDZD7 | 186862 | 474125 | 15326 | 474447 | 33258 |
| PDZD7 | 186862 | 433616 | 15327 | 412533 | 33259 |
| PDZD7 | 186862 | 370215 | 15328 | 359234 | 33260 |
| PDZD7 | 186862 | 476306 | 15329 | N/A | |
| PDZD7 | 186862 | 470414 | 15330 | 474831 | 33261 |
| PDZD7 | 186862 | 619208 | 15331 | 480489 | 33262 |

-continued

-continued

| Symbol | ENSG | ENST | SEQ ID | ENSP | SEQ ID |
|---|---|---|---|---|---|
| PDZRN4 | 165966 | 402685 | 15332 | 384197 | 33263 |
| PDZRN4 | 165966 | 539469 | 15333 | 439990 | 33264 |
| PDZRN4 | 165966 | 298919 | 15334 | 298919 | 33265 |
| PDZRN4 | 165966 | 548316 | 15335 | N/A | |
| PEA15 | 162734 | 360472 | 15336 | 353660 | 33266 |
| PEA15 | 162734 | 368077 | 15337 | 357056 | 33267 |
| PEA15 | 162734 | 368076 | 15338 | 357055 | 33268 |
| PEA15 | 162734 | 488858 | 15339 | N/A | |
| PEBP4 | 134020 | 256404 | 15340 | 256404 | 33269 |
| PEBP4 | 134020 | 521284 | 15341 | N/A | |
| PEBP4 | 134020 | 522278 | 15342 | 429414 | 33270 |
| PEG3 | 198300 | 326441 | 15343 | 326581 | 33271 |
| PEG3 | 198300 | 599565 | 15344 | N/A | |
| PEG3 | 198300 | 598410 | 15345 | 473190 | 33272 |
| PEG3 | 198300 | 593695 | 15346 | 472402 | 33273 |
| PEG3 | 198300 | 599534 | 15347 | 472395 | 33274 |
| PEG3 | 198300 | 599577 | 15348 | 469486 | 33275 |
| PEG3 | 198300 | 600833 | 15349 | 470467 | 33276 |
| PEG3 | 198300 | 596261 | 15350 | N/A | |
| PEG3 | 198300 | 594706 | 15351 | N/A | |
| PEG3 | 198300 | 594389 | 15352 | 469144 | 33277 |
| PENK | 181195 | 517415 | 15353 | 430268 | 33278 |
| PENK | 181195 | 520589 | 15354 | N/A | |
| PENK | 181195 | 314922 | 15355 | 324248 | 33279 |
| PENK | 181195 | 451791 | 15356 | 400894 | 33280 |
| PENK | 181195 | 523274 | 15357 | N/A | |
| PENK | 181195 | 518974 | 15358 | 428012 | 33281 |
| PENK | 181195 | 523051 | 15359 | 429326 | 33282 |
| PENK | 181195 | 518770 | 15360 | 430592 | 33283 |
| PENK | 181195 | 521153 | 15361 | N/A | |
| PER1 | 179094 | 317276 | 15362 | 314420 | 33284 |
| PER1 | 179094 | 581082 | 15363 | 462064 | 33285 |
| PER1 | 179094 | 582719 | 15364 | 463054 | 33286 |
| PER1 | 179094 | 583677 | 15365 | N/A | |
| PER1 | 179094 | 585284 | 15366 | N/A | |
| PER1 | 179094 | 579098 | 15367 | N/A | |
| PER1 | 179094 | 578089 | 15368 | N/A | |
| PER1 | 179094 | 578950 | 15369 | N/A | |
| PER1 | 179094 | 354903 | 15370 | 346979 | 33287 |
| PER1 | 179094 | 583559 | 15371 | 463369 | 33288 |
| PER1 | 179094 | 581395 | 15372 | 464696 | 33289 |
| PER1 | 179094 | 585095 | 15373 | N/A | |
| PER1 | 179094 | 577424 | 15374 | N/A | |
| PER1 | 179094 | 579203 | 15375 | N/A | |
| PER1 | 179094 | 578223 | 15376 | N/A | |
| PER1 | 179094 | 579065 | 15377 | N/A | |
| PER1 | 179094 | 581703 | 15378 | 463385 | 33290 |
| PER1 | 179094 | 577253 | 15379 | 462546 | 33291 |
| PER1 | 179094 | 584202 | 15380 | 463661 | 33292 |
| PET100 | 229833 | 594797 | 15381 | 470539 | 33293 |
| PET100 | 229833 | 623154 | 15382 | N/A | |
| PET100 | 229833 | 456958 | 15383 | 392303 | 33294 |
| PET100 | 229833 | 601829 | 15384 | N/A | |
| PET100 | 229833 | 601406 | 15385 | 470935 | 33295 |
| PET100 | 229833 | 598540 | 15386 | 470314 | 33296 |
| PET100 | 229833 | 600836 | 15387 | N/A | |
| PEX5L | 114757 | 467460 | 15388 | 419975 | 33297 |
| PEX5L | 114757 | 263962 | 15389 | 263962 | 33298 |
| PEX5L | 114757 | 485199 | 15390 | 418440 | 33299 |
| PEX5L | 114757 | 468741 | 15391 | 418665 | 33300 |
| PEX5L | 114757 | 476138 | 15392 | 420555 | 33301 |
| PEX5L | 114757 | 467440 | 15393 | N/A | |
| PEX5L | 114757 | 472994 | 15394 | 418054 | 33302 |
| PEX5L | 114757 | 464614 | 15395 | 417270 | 33303 |
| PEX5L | 114757 | 465751 | 15396 | 419348 | 33304 |
| PEX5L | 114757 | 477829 | 15397 | N/A | |
| PEX5L | 114757 | 461537 | 15398 | N/A | |
| PEX5L | 114757 | 496721 | 15399 | 418746 | 33305 |
| PEX5L | 114757 | 491640 | 15400 | 419790 | 33306 |
| PEX5L | 114757 | 469198 | 15401 | 417438 | 33307 |
| PEX5L | 114757 | 463761 | 15402 | 419406 | 33308 |
| PEX5L | 114757 | 487198 | 15403 | N/A | |
| PEX5L | 114757 | 474909 | 15404 | N/A | |
| PEX5L | 114757 | 392649 | 15405 | 376420 | 33309 |
| PFKFB4 | 114268 | 232375 | 15406 | 232375 | 33310 |
| PFKFB4 | 114268 | 416568 | 15407 | 388394 | 33311 |

| Symbol | ENSG | ENST | SEQ ID | ENSP | SEQ ID |
|---|---|---|---|---|---|
| PFKFB4 | 114268 | 417753 | 15408 | 389169 | 33312 |
| PFKFB4 | 114268 | 445633 | 15409 | 400772 | 33313 |
| PFKFB4 | 114268 | 383734 | 15410 | 373240 | 33314 |
| PFKFB4 | 114268 | 490115 | 15411 | N/A | |
| PFKFB4 | 114268 | 478516 | 15412 | N/A | |
| PFKFB4 | 114268 | 452531 | 15413 | 407657 | 33315 |
| PFKFB4 | 114268 | 468162 | 15414 | N/A | |
| PFKFB4 | 114268 | 412035 | 15415 | 393047 | 33316 |
| PFKFB4 | 114268 | 471890 | 15416 | N/A | |
| PFKFB4 | 114268 | 496767 | 15417 | N/A | |
| PFKFB4 | 114268 | 422701 | 15418 | 415764 | 33317 |
| PFKFB4 | 114268 | 490404 | 15419 | N/A | |
| PFKFB4 | 114268 | 467176 | 15420 | N/A | |
| PFKM | 152556 | 550345 | 15421 | 450369 | 33318 |
| PFKM | 152556 | 549003 | 15422 | 449835 | 33319 |
| PFKM | 152556 | 550924 | 15423 | 446945 | 33320 |
| PFKM | 152556 | 549941 | 15424 | 446829 | 33321 |
| PFKM | 152556 | 550257 | 15425 | 447997 | 33322 |
| PFKM | 152556 | 340802 | 15426 | 345771 | 33323 |
| PFKM | 152556 | 547581 | 15427 | 447992 | 33324 |
| PFKM | 152556 | 546755 | 15428 | 450173 | 33325 |
| PFKM | 152556 | 549366 | 15429 | 449622 | 33326 |
| PFKM | 152556 | 552792 | 15430 | 448940 | 33327 |
| PFKM | 152556 | 548288 | 15431 | 448018 | 33328 |
| PFKM | 152556 | 359794 | 15432 | 352842 | 33329 |
| PFKM | 152556 | 547066 | 15433 | 448318 | 33330 |
| PFKM | 152556 | 546964 | 15434 | N/A | |
| PFKM | 152556 | 548720 | 15435 | N/A | |
| PFKM | 152556 | 552989 | 15436 | 447774 | 33331 |
| PFKM | 152556 | 551548 | 15437 | N/A | |
| PFKM | 152556 | 551485 | 15438 | 448315 | 33332 |
| PFKM | 152556 | 551339 | 15439 | 448253 | 33333 |
| PFKM | 152556 | 548345 | 15440 | 449269 | 33334 |
| PFKM | 152556 | 551804 | 15441 | 448177 | |
| PFKM | 152556 | 549022 | 15442 | 446805 | 33336 |
| PFKM | 152556 | 547587 | 15443 | 449426 | 33337 |
| PFKM | 152556 | 546465 | 15444 | 446519 | 33338 |
| PFKM | 152556 | 547148 | 15445 | N/A | |
| PFKM | 152556 | 552752 | 15446 | 446740 | 33339 |
| PFKM | 152556 | 550802 | 15447 | N/A | |
| PFKM | 152556 | 552214 | 15448 | N/A | |
| PFKM | 152556 | 552818 | 15449 | N/A | |
| PFKM | 152556 | 553055 | 15450 | 450091 | 33340 |
| PFKM | 152556 | 312352 | 15451 | 309438 | 33341 |
| PFKM | 152556 | 629846 | 15452 | 486196 | 33342 |
| PFKP | 067057 | 607886 | 15453 | 477128 | 33343 |
| PFKP | 067057 | 381125 | 15454 | 370517 | 33344 |
| PFKP | 067057 | 495715 | 15455 | N/A | |
| PFKP | 067057 | 381075 | 15456 | 370465 | 33345 |
| PFKP | 067057 | 421751 | 15457 | N/A | |
| PFKP | 067057 | 407806 | 15458 | 385880 | 33346 |
| PFKP | 067057 | 415005 | 15459 | 408858 | 33347 |
| PFKP | 067057 | 468050 | 15460 | 476311 | 33348 |
| PFKP | 067057 | 460445 | 15461 | N/A | |
| PFKP | 067057 | 413079 | 15462 | 387871 | 33349 |
| PFKP | 067057 | 381072 | 15463 | 370462 | 33350 |
| PFKP | 067057 | 433193 | 15464 | 410275 | 33351 |
| PGGHG | 142102 | 474221 | 15465 | N/A | |
| PGGHG | 142102 | 409548 | 15466 | 387185 | |
| PGGHG | 142102 | 409655 | 15467 | 386297 | |
| PGGHG | 142102 | 529087 | 15468 | N/A | |
| PGGHG | 142102 | 409479 | 15469 | 387099 | 33354 |
| PGGHG | 142102 | 482937 | 15470 | 431881 | 33355 |
| PGGHG | 142102 | 476372 | 15471 | N/A | |
| PGGHG | 142102 | 397660 | 15472 | 380780 | 33356 |
| PGM2L1 | 165434 | 298198 | 15473 | 298198 | 33357 |
| PGM2L1 | 165434 | 622957 | 15474 | N/A | |
| PGM5 | 154330 | 604870 | 15475 | N/A | |
| PGM5 | 154330 | 396392 | 15476 | 379674 | 33358 |
| PGM5 | 154330 | 396396 | 15477 | 379678 | 33359 |
| PGM5 | 154330 | 431583 | 15478 | 394864 | 33360 |
| PGM5 | 154330 | 587852 | 15479 | N/A | |
| PGM5 | 154330 | 472639 | 15480 | N/A | |
| PGM5 | 154330 | 496758 | 15481 | N/A | |
| PGR | 082175 | 325455 | 15482 | 325120 | 33361 |
| PGR | 082175 | 534013 | 15483 | 436561 | 33362 |

-continued

-continued

| Symbol | ENSG | ENST | SEQ ID | ENSP | SEQ ID |
|---|---|---|---|---|---|
| PGR | 082175 | 533207 | 15484 | N/A | |
| PGR | 082175 | 528960 | 15485 | 432914 | 33363 |
| PGR | 082175 | 534780 | 15486 | 432352 | 33364 |
| PGR | 082175 | 526300 | 15487 | 436803 | 33365 |
| PGR | 082175 | 263463 | 15488 | 263463 | 33366 |
| PGR | 082175 | 530764 | 15489 | N/A | |
| PGR | 082175 | 632634 | 15490 | 487607 | 33367 |
| PGR | 082175 | 619228 | 15491 | 482698 | 33368 |
| PGR | 082175 | 617858 | 15492 | 481227 | 33369 |
| PHACTR2-AS1 | 235740 | 450575 | 15493 | N/A | |
| PHF10 | 130024 | 366780 | 15494 | 355743 | 33370 |
| PHF10 | 130024 | 339209 | 15495 | 341805 | 33371 |
| PHF10 | 130024 | 480008 | 15496 | N/A | |
| PHF10 | 130024 | 464779 | 15497 | N/A | |
| PHF10 | 130024 | 612128 | 15498 | 479515 | 33372 |
| PHF10 | 130024 | 621772 | 15499 | 484117 | 33373 |
| PHF21B | 056487 | 403565 | 15500 | 385053 | 33374 |
| PHF21B | 056487 | 313237 | 15501 | 324403 | 33375 |
| PHF21B | 056487 | 629843 | 15502 | 487086 | 33376 |
| PHF21B | 056487 | 414269 | 15503 | 401091 | 33377 |
| PHF21B | 056487 | 420689 | 15504 | 401294 | 33378 |
| PHF21B | 056487 | 490679 | 15505 | N/A | |
| PHF21B | 056487 | 460507 | 15506 | N/A | |
| PHF21B | 056487 | 474327 | 15507 | N/A | |
| PHF21B | 056487 | 462631 | 15508 | N/A | |
| PHF21B | 056487 | 495348 | 15509 | N/A | |
| PHF21B | 056487 | 491522 | 15510 | N/A | |
| PHF21B | 056487 | 396103 | 15511 | 379410 | 33379 |
| PHF24 | 122733 | 486477 | 15512 | N/A | |
| PHF24 | 122733 | 476115 | 15513 | N/A | |
| PHF24 | 122733 | 242315 | 15514 | 242315 | 33380 |
| PHF24 | 122733 | 440503 | 15515 | N/A | |
| PHKA1 | 067177 | 373542 | 15516 | 362643 | 33381 |
| PHKA1 | 067177 | 373545 | 15517 | 362646 | 33382 |
| PHKA1 | 067177 | 373539 | 15518 | 362640 | 33383 |
| PHKA1 | 067177 | 339490 | 15519 | 342469 | 33384 |
| PHKA1 | 067177 | 541944 | 15520 | 441251 | 33385 |
| PHKA2 | 044446 | 379942 | 15521 | 369274 | 33386 |
| PHKA2 | 044446 | 481718 | 15522 | N/A | |
| PHKA2 | 044446 | 469485 | 15523 | N/A | |
| PHKA2 | 044446 | 473597 | 15524 | N/A | |
| PHKA2 | 044446 | 473739 | 15525 | N/A | |
| PHKA2 | 044446 | 469645 | 15526 | N/A | |
| PHKA2 | 044446 | 486231 | 15527 | N/A | |
| PHKA2 | 044446 | 464455 | 15528 | N/A | |
| PHKG1 | 164776 | 297373 | 15529 | 297373 | 33387 |
| PHKG1 | 164776 | 446428 | 15530 | 389721 | 33388 |
| PHKG1 | 164776 | 432123 | 15531 | 397193 | 33389 |
| PHKG1 | 164776 | 471665 | 15532 | N/A | |
| PHKG1 | 164776 | 395428 | 15533 | 378817 | 33390 |
| PHKG1 | 164776 | 489604 | 15534 | N/A | |
| PHKG1 | 164776 | 467726 | 15535 | N/A | |
| PHKG1 | 164776 | 492124 | 15536 | N/A | |
| PHKG1 | 164776 | 452681 | 15537 | 445440 | 33391 |
| PHKG1 | 164776 | 537360 | 15538 | 441528 | 33392 |
| PHOX2A | 165462 | 546310 | 15539 | 444845 | 33393 |
| PHOX2A | 165462 | 298231 | 15540 | 298231 | 33394 |
| PHOX2A | 165462 | 544057 | 15541 | N/A | |
| PHYHIP | 168490 | 321613 | 15542 | 320017 | 33395 |
| PHYHIP | 168490 | 454243 | 15543 | 415491 | 33396 |
| PHYHIP | 168490 | 523252 | 15544 | 430870 | 33397 |
| PHYHIP | 168490 | 522869 | 15545 | N/A | |
| PHYHIP | 168490 | 518274 | 15546 | N/A | |
| PI16 | 164530 | 373674 | 15547 | 362778 | 33398 |
| PI16 | 164530 | 491324 | 15548 | N/A | |
| PI16 | 164530 | 611814 | 15549 | 478888 | 33399 |
| PID1 | 153823 | 482518 | 15550 | N/A | |
| PID1 | 153823 | 392054 | 15551 | 375907 | 33400 |
| PID1 | 153823 | 409462 | 15552 | 386826 | 33401 |
| PID1 | 153823 | 392055 | 15553 | 375908 | 33402 |
| PID1 | 153823 | 354069 | 15554 | 283937 | 33403 |
| PID1 | 153823 | 534952 | 15555 | 438228 | 33404 |
| PIEZO2 | 154864 | 582937 | 15556 | 462187 | 33405 |
| PIEZO2 | 154864 | 302079 | 15557 | 303316 | 33406 |
| PIEZO2 | 154864 | 538948 | 15558 | 443129 | 33407 |
| PIEZO2 | 154864 | 580640 | 15559 | 463094 | 33408 |

| Symbol | ENSG | ENST | SEQ ID | ENSP | SEQ ID |
|---|---|---|---|---|---|
| PIEZO2 | 154864 | 503781 | 15560 | 421377 | 33409 |
| PIEZO2 | 154864 | 582913 | 15561 | 462115 | 33410 |
| PIEZO2 | 154864 | 581680 | 15562 | N/A | |
| PIEZO2 | 154864 | 579151 | 15563 | N/A | |
| PIEZO2 | 154864 | 579949 | 15564 | 477311 | 33411 |
| PIEZO2 | 154864 | 578145 | 15565 | N/A | |
| PIEZO2 | 154864 | 583325 | 15566 | 462560 | 33412 |
| PIEZO2 | 154864 | 579112 | 15567 | 463589 | 33413 |
| PIEZO2 | 154864 | 579899 | 15568 | N/A | |
| PIEZO2 | 154864 | 383408 | 15569 | 372900 | 33414 |
| PIGA | 165195 | 333590 | 15570 | 369820 | 33415 |
| PIGA | 165195 | 635631 | 15571 | N/A | |
| PIGA | 165195 | 542278 | 15572 | 442653 | 33416 |
| PIGA | 165195 | 635045 | 15573 | N/A | |
| PIGA | 165195 | 635598 | 15574 | 489207 | 33417 |
| PIGA | 165195 | 637626 | 15575 | 489928 | 33418 |
| PIGA | 165195 | 638131 | 15576 | 490483 | 33419 |
| PIGA | 165195 | 637296 | 15577 | 490545 | 33420 |
| PIGA | 165195 | 634582 | 15578 | 489540 | 33421 |
| PIGA | 165195 | 482148 | 15579 | 489528 | 33422 |
| PIGA | 165195 | 634640 | 15580 | 489083 | 33423 |
| PIGA | 165195 | 475746 | 15581 | 488970 | 33424 |
| PIGA | 165195 | 463173 | 15582 | N/A | |
| PIGA | 165195 | 635480 | 15583 | N/A | |
| PIGA | 165195 | 634286 | 15584 | 489491 | 33425 |
| PIGA | 165195 | 474662 | 15585 | N/A | |
| PIGA | 165195 | 637799 | 15586 | N/A | |
| PIGA | 165195 | 634484 | 15587 | N/A | |
| PIGA | 165195 | 635543 | 15588 | 489205 | 33426 |
| PIGH | 100564 | 561272 | 15589 | 453759 | 33427 |
| PIGH | 100564 | 216452 | 15590 | 216452 | 33428 |
| PIGH | 100564 | 558987 | 15591 | 452816 | 33429 |
| PIGH | 100564 | 559118 | 15592 | N/A | |
| PIGH | 100564 | 560722 | 15593 | 453394 | 33430 |
| PIGH | 100564 | 558493 | 15594 | 453158 | 33431 |
| PIGH | 100564 | 558198 | 15595 | 452924 | 33432 |
| PIGH | 100564 | 561303 | 15596 | 452974 | 33433 |
| PIGH | 100564 | 558001 | 15597 | 454061 | 33434 |
| PIGH | 100564 | 559581 | 15598 | 453733 | 33435 |
| PIGH | 100564 | 559415 | 15599 | 452996 | 33436 |
| PIGH | 100564 | 559097 | 15600 | N/A | |
| PIGS | 087111 | 268758 | 15601 | 268758 | 33437 |
| PIGS | 087111 | 487231 | 15602 | N/A | |
| PIGS | 087111 | 492429 | 15603 | N/A | |
| PIGS | 087111 | 395346 | 15604 | 378755 | 33438 |
| PIGS | 087111 | 308360 | 15605 | 309430 | 33439 |
| PIGS | 087111 | 484580 | 15606 | N/A | |
| PIGS | 087111 | 582615 | 15607 | N/A | |
| PIGS | 087111 | 577620 | 15608 | N/A | |
| PIGS | 087111 | 465444 | 15609 | N/A | |
| PIGS | 087111 | 580968 | 15610 | N/A | |
| PIGS | 087111 | 584007 | 15611 | 463406 | 33440 |
| PIGS | 087111 | 582721 | 15612 | 466846 | 33441 |
| PIGS | 087111 | 577594 | 15613 | N/A | |
| PIGS | 087111 | 583631 | 15614 | N/A | |
| PIGS | 087111 | 584413 | 15615 | N/A | |
| PIGZ | 119227 | 412723 | 15616 | 413405 | 33442 |
| PIGZ | 119227 | 413127 | 15617 | 405341 | 33443 |
| PIGZ | 119227 | 443835 | 15618 | 389327 | 33444 |
| PIGZ | 119227 | 238138 | 15619 | N/A | |
| PIH1D3 | 080572 | 372453 | 15620 | 361531 | 33445 |
| PIH1D3 | 080572 | 336387 | 15621 | 337757 | 33446 |
| PIH1D3 | 080572 | 535523 | 15622 | 441930 | 33447 |
| PIK3C2B | 133056 | 367187 | 15623 | 356155 | 33448 |
| PIK3C2B | 133056 | 462752 | 15624 | N/A | |
| PIK3C2B | 133056 | 479079 | 15625 | N/A | |
| PIK3C2B | 133056 | 496872 | 15626 | N/A | |
| PIK3C2B | 133056 | 367184 | 15627 | 356152 | 33449 |
| PIK3C2B | 133056 | 415899 | 15628 | 401795 | 33450 |
| PIK3C2B | 133056 | 429009 | 15629 | 409554 | 33451 |
| PIK3C2B | 133056 | 424712 | 15630 | 400561 | 33452 |
| PIK3R1 | 145675 | 521381 | 15631 | 428056 | 33453 |
| PIK3R1 | 145675 | 521657 | 15632 | 429277 | 33454 |
| PIK3R1 | 145675 | 517643 | 15633 | N/A | |
| PIK3R1 | 145675 | 517412 | 15634 | N/A | |
| PIK3R1 | 145675 | 520675 | 15635 | 428566 | 33455 |

-continued

| Symbol | ENSG | ENST | SEQ ID | ENSP | SEQ ID |
|---|---|---|---|---|---|
| PIK3R1 | 145675 | 523807 | 15636 | 430126 | 33456 |
| PIK3R1 | 145675 | 522084 | 15637 | 429766 | 33457 |
| PIK3R1 | 145675 | 320694 | 15638 | 323512 | 33458 |
| PIK3R1 | 145675 | 521409 | 15639 | 431058 | 33459 |
| PIK3R1 | 145675 | 336483 | 15640 | 338554 | 33460 |
| PIK3R1 | 145675 | 518292 | 15641 | N/A | |
| PIK3R1 | 145675 | 517698 | 15642 | 430424 | 33461 |
| PIK3R1 | 145675 | 518813 | 15643 | N/A | |
| PIK3R1 | 145675 | 519025 | 15644 | 429156 | 33462 |
| PIK3R1 | 145675 | 523872 | 15645 | 430098 | 33463 |
| PIK3R1 | 145675 | 520550 | 15646 | N/A | |
| PILRA | 085514 | 432297 | 15647 | 415111 | 33464 |
| PILRA | 085514 | 198536 | 15648 | 198536 | 33465 |
| PILRA | 085514 | 453419 | 15649 | 390026 | 33466 |
| PILRA | 085514 | 484934 | 15650 | N/A | |
| PILRA | 085514 | 394000 | 15651 | 377569 | 33467 |
| PILRA | 085514 | 350573 | 15652 | 340109 | 33468 |
| PILRA | 085514 | 474013 | 15653 | N/A | |
| PIM3 | 198355 | 360612 | 15654 | 353824 | 33469 |
| PIM3 | 198355 | 467480 | 15655 | N/A | |
| PIN4 | 102309 | 373662 | 15656 | 421392 | 33470 |
| PIN4 | 102309 | 218432 | 15657 | 218432 | 33471 |
| PIN4 | 102309 | 373669 | 15658 | 362773 | 33472 |
| PIN4 | 102309 | 496835 | 15659 | 421676 | 33473 |
| PIN4 | 102309 | 439980 | 15660 | 394066 | 33474 |
| PIN4 | 102309 | 446576 | 15661 | 402330 | 33475 |
| PIN4 | 102309 | 423432 | 15662 | 409154 | 33476 |
| PIP4K2A | 150867 | 376573 | 15663 | 365757 | 33477 |
| PIP4K2A | 150867 | 323883 | 15664 | 326294 | 33478 |
| PIP4K2A | 150867 | 474335 | 15665 | N/A | |
| PIP4K2A | 150867 | 545335 | 15666 | 442098 | 33479 |
| PIP4K2A | 150867 | 604912 | 15667 | 473858 | 33480 |
| PIP4K2A | 150867 | 422321 | 15668 | N/A | |
| PIP4K2A | 150867 | 432610 | 15669 | N/A | |
| PIP4K2A | 150867 | 605011 | 15670 | N/A | |
| PIP5K1C | 186111 | 335312 | 15671 | 335333 | 33481 |
| PIP5K1C | 186111 | 539785 | 15672 | 445992 | 33482 |
| PIP5K1C | 186111 | 589578 | 15673 | 466363 | 33483 |
| PIP5K1C | 186111 | 537021 | 15674 | 444779 | 33484 |
| PIP5K1C | 186111 | 592530 | 15675 | N/A | |
| PIP5K1C | 186111 | 587482 | 15676 | N/A | |
| PIP5K1C | 186111 | 636612 | 15677 | N/A | |
| PIP5K1C | 186111 | 637724 | 15678 | N/A | |
| PIPOX | 179761 | 580241 | 15679 | N/A | |
| PIPOX | 179761 | 580383 | 15680 | N/A | |
| PIPOX | 179761 | 583215 | 15681 | N/A | |
| PIPOX | 179761 | 578748 | 15682 | N/A | |
| PIPOX | 179761 | 577182 | 15683 | N/A | |
| PIPOX | 179761 | 323372 | 15684 | 317721 | 33485 |
| PIPOX | 179761 | 466889 | 15685 | 465428 | 33486 |
| PIPOX | 179761 | 469082 | 15686 | 465329 | 33487 |
| PIPOX | 179761 | 484308 | 15687 | N/A | |
| PIPOX | 179761 | 419875 | 15688 | N/A | |
| PITPNM3 | 091622 | 421306 | 15689 | 407882 | 33488 |
| PITPNM3 | 091622 | 262483 | 15690 | 262483 | 33489 |
| PITPNM3 | 091622 | 576664 | 15691 | N/A | |
| PITPNM3 | 091622 | 572795 | 15692 | N/A | |
| PITPNM3 | 091622 | 575201 | 15693 | 458901 | 33490 |
| PIWIL1 | 125207 | 245255 | 15694 | 245255 | 33491 |
| PIWIL1 | 125207 | 546060 | 15695 | 442086 | 33492 |
| PIWIL1 | 125207 | 539400 | 15696 | 440677 | 33493 |
| PIWIL1 | 125207 | 539995 | 15697 | 439096 | 33494 |
| PIWIL1 | 125207 | 535956 | 15698 | 444353 | 33495 |
| PIWIL1 | 125207 | 542723 | 15699 | 438582 | 33496 |
| PIWIL1 | 125207 | 540672 | 15700 | N/A | |
| PIWIL1 | 125207 | 541480 | 15701 | N/A | |
| PIWIL1 | 275051 | 613226 | 15702 | 481042 | 33497 |
| PIWIL1 | 275051 | 632888 | 15703 | 487688 | 33498 |
| PIWIL1 | 275051 | 634077 | 15704 | 487799 | 33499 |
| PIWIL1 | 275051 | 633272 | 15705 | 487920 | 33500 |
| PIWIL1 | 275051 | 633252 | 15706 | 488716 | 33501 |
| PIWIL1 | 275051 | 634115 | 15707 | 488677 | 33502 |
| PIWIL1 | 275051 | 633042 | 15708 | 488197 | 33503 |
| PIWIL1 | 275051 | 631528 | 15709 | N/A | |
| PIWIL1 | 275051 | 631714 | 15710 | N/A | |
| PKD2L1 | 107593 | 318222 | 15711 | 325296 | 33504 |

-continued

| Symbol | ENSG | ENST | SEQ ID | ENSP | SEQ ID |
|---|---|---|---|---|---|
| PKD2L1 | 107593 | 465680 | 15712 | 434019 | 33505 |
| PKD2L1 | 107593 | 528248 | 15713 | 436514 | 33506 |
| PKD2L1 | 107593 | 532547 | 15714 | 434224 | 33507 |
| PKDCC | 162878 | 294964 | 15715 | 294964 | 33508 |
| PKDCC | 162878 | 401498 | 15716 | 385220 | 33509 |
| PKDCC | 162878 | 485578 | 15717 | N/A | |
| PKDCC | 162878 | 492861 | 15718 | N/A | |
| PKDCC | 162878 | 475868 | 15719 | N/A | |
| PKDCC | 162878 | 475241 | 15720 | N/A | |
| PKDCC | 162878 | 490302 | 15721 | N/A | |
| PKDCC | 162878 | 470578 | 15722 | N/A | |
| PKDCC | 162878 | 480099 | 15723 | N/A | |
| PKIA | 171033 | 396418 | 15724 | 379696 | 33510 |
| PKIA | 171033 | 352966 | 15725 | 336552 | 33511 |
| PKIA | 171033 | 518467 | 15726 | 430887 | 33512 |
| PKMYT1 | 127564 | 431515 | 15727 | 392855 | 33513 |
| PKMYT1 | 127564 | 572832 | 15728 | N/A | |
| PKMYT1 | 127564 | 574333 | 15729 | N/A | |
| PKMYT1 | 127564 | 440027 | 15730 | 397739 | 33514 |
| PKMYT1 | 127564 | 262300 | 15731 | 262300 | 33515 |
| PKMYT1 | 127564 | 575040 | 15732 | 459880 | 33516 |
| PKMYT1 | 127564 | 575981 | 15733 | N/A | |
| PKMYT1 | 127564 | 574680 | 15734 | N/A | |
| PKMYT1 | 127564 | 574385 | 15735 | 458943 | 33517 |
| PKMYT1 | 127564 | 574730 | 15736 | 460868 | 33518 |
| PKMYT1 | 127564 | 573944 | 15737 | 459123 | 33519 |
| PKMYT1 | 127564 | 382240 | 15738 | 371675 | 33520 |
| PKMYT1 | 127564 | 576268 | 15739 | 458545 | 33521 |
| PKMYT1 | 127564 | 574415 | 15740 | 460598 | 33522 |
| PKMYT1 | 127564 | 575632 | 15741 | 461330 | 33523 |
| PKMYT1 | 127564 | 572059 | 15742 | 458842 | 33524 |
| PKMYT1 | 127564 | 572619 | 15743 | 461628 | 33525 |
| PKMYT1 | 127564 | 570649 | 15744 | N/A | |
| PKMYT1 | 127564 | 572658 | 15745 | N/A | |
| PKMYT1 | 127564 | 571102 | 15746 | N/A | |
| PKNOX2 | 165495 | 530517 | 15747 | N/A | |
| PKNOX2 | 165495 | 531116 | 15748 | N/A | |
| PKNOX2 | 165495 | 298282 | 15749 | 298282 | 33526 |
| PKNOX2 | 165495 | 559662 | 15750 | N/A | |
| PKNOX2 | 165495 | 557814 | 15751 | N/A | |
| PKNOX2 | 165495 | 527238 | 15752 | 431599 | 33527 |
| PKNOX2 | 165495 | 561399 | 15753 | N/A | |
| PKNOX2 | 165495 | 532623 | 15754 | 434377 | 33528 |
| PKNOX2 | 165495 | 531212 | 15755 | 434255 | 33529 |
| PKNOX2 | 165495 | 558729 | 15756 | N/A | |
| PKNOX2 | 165495 | 561115 | 15757 | N/A | |
| PKNOX2 | 165495 | 558705 | 15758 | 453374 | 33530 |
| PKNOX2 | 165495 | 561298 | 15759 | N/A | |
| PKNOX2 | 165495 | 526955 | 15760 | N/A | |
| PKP3 | 184363 | 534401 | 15761 | 434517 | 33531 |
| PKP3 | 184363 | 533249 | 15762 | 435383 | 33532 |
| PKP3 | 184363 | 527442 | 15763 | 435522 | 33533 |
| PKP3 | 184363 | 528036 | 15764 | 434110 | 33534 |
| PKP3 | 184363 | 331563 | 15765 | 331678 | 33535 |
| PKP3 | 184363 | 533069 | 15766 | N/A | |
| PKP3 | 184363 | 531857 | 15767 | 435478 | 33536 |
| PKP3 | 184363 | 530695 | 15768 | N/A | |
| PKP3 | 184363 | 524646 | 15769 | N/A | |
| PKP3 | 184363 | 526971 | 15770 | N/A | |
| PKP3 | 184363 | 525642 | 15771 | 436847 | 33537 |
| PLA2G16 | 176485 | 323646 | 15772 | 320337 | 33538 |
| PLA2G16 | 176485 | 394613 | 15773 | N/A | |
| PLA2G16 | 176485 | 540943 | 15774 | 442576 | 33539 |
| PLA2G16 | 176485 | 544269 | 15775 | N/A | |
| PLA2G16 | 176485 | 415826 | 15776 | 389124 | 33540 |
| PLA2G16 | 176485 | 639271 | 15777 | 492682 | 33541 |
| PLA2G3 | 100078 | 215885 | 15778 | 215885 | 33542 |
| PLA2G4A | 116711 | 367466 | 15779 | 356436 | 33543 |
| PLA2G4A | 116711 | 466600 | 15780 | N/A | |
| PLA2G4E | 188089 | 399518 | 15781 | 382434 | 33544 |
| PLA2G4E | 188089 | 547930 | 15782 | N/A | |
| PLA2G4E | 188089 | 551073 | 15783 | N/A | |
| PLA2G5 | 127472 | 486277 | 15784 | N/A | |
| PLA2G5 | 127472 | 465698 | 15785 | N/A | |
| PLA2G5 | 127472 | 460175 | 15786 | N/A | |
| PLA2G5 | 127472 | 469069 | 15787 | N/A | |

-continued

-continued

| Symbol | ENSG | ENST | SEQ ID | ENSP | SEQ ID |
|---|---|---|---|---|---|
| PLA2G5 | 127472 | 489871 | 15788 | N/A | |
| PLA2G5 | 127472 | 498348 | 15789 | N/A | |
| PLA2G5 | 127472 | 375108 | 15790 | 364249 | 33545 |
| PLA2G5 | 127472 | 478803 | 15791 | N/A | |
| PLA2G7 | 146070 | 274793 | 15792 | 274793 | 33546 |
| PLA2G7 | 146070 | 537365 | 15793 | 445666 | 33547 |
| PLAG1 | 181690 | 316981 | 15794 | 325546 | 33548 |
| PLAG1 | 181690 | 522009 | 15795 | N/A | |
| PLAG1 | 181690 | 423799 | 15796 | 404067 | 33549 |
| PLAG1 | 181690 | 429357 | 15797 | 416537 | 33550 |
| PLAG1 | 181690 | 519027 | 15798 | N/A | |
| PLAT | 104368 | 429089 | 15799 | 392045 | 33551 |
| PLAT | 104368 | 220809 | 15800 | 220809 | 33552 |
| PLAT | 104368 | 352041 | 15801 | 270188 | 33553 |
| PLAT | 104368 | 519510 | 15802 | 428886 | 33554 |
| PLAT | 104368 | 429710 | 15803 | 407861 | 33555 |
| PLAT | 104368 | 524009 | 15804 | 429401 | 33556 |
| PLAT | 104368 | 522812 | 15805 | N/A | |
| PLAT | 104368 | 521042 | 15806 | 429542 | 33557 |
| PLAT | 104368 | 524261 | 15807 | N/A | |
| PLAT | 104368 | 521647 | 15808 | N/A | |
| PLAT | 104368 | 520523 | 15809 | 428797 | 33558 |
| PLAT | 104368 | 521694 | 15810 | 429801 | 33559 |
| PLCB1 | 182621 | 637919 | 15811 | 490862 | 33560 |
| PLCB1 | 182621 | 625874 | 15812 | 486301 | 33561 |
| PLCB1 | 182621 | 630495 | 15813 | 486655 | 33562 |
| PLCB1 | 182621 | 378641 | 15814 | 367908 | 33563 |
| PLCB1 | 182621 | 338037 | 15815 | 338185 | 33564 |
| PLCB1 | 182621 | 629992 | 15816 | 486531 | 33565 |
| PLCB1 | 182621 | 636319 | 15817 | 490455 | 33566 |
| PLCB1 | 182621 | 626161 | 15818 | N/A | |
| PLCB1 | 182621 | 404098 | 15819 | 384001 | 33567 |
| PLCB1 | 182621 | 378637 | 15820 | 367904 | 33568 |
| PLCB1 | 182621 | 630757 | 15821 | N/A | |
| PLCB1 | 182621 | 637204 | 15822 | 490771 | 33569 |
| PLCB1 | 182621 | 636825 | 15823 | N/A | |
| PLCB1 | 182621 | 635830 | 15824 | N/A | |
| PLCB1 | 182621 | 636784 | 15825 | N/A | |
| PLCB1 | 182621 | 626114 | 15826 | N/A | |
| PLCB1 | 182621 | 628900 | 15827 | N/A | |
| PLCB1 | 182621 | 626966 | 15828 | 487075 | 33570 |
| PLCB1 | 182621 | 637000 | 15829 | N/A | |
| PLCB1 | 182621 | 635850 | 15830 | N/A | |
| PLCB1 | 182621 | 475958 | 15831 | 486428 | 33571 |
| PLCB1 | 182621 | 487210 | 15832 | 431704 | 33572 |
| PLCB1 | 182621 | 494924 | 15833 | N/A | |
| PLCB1 | 182621 | 636711 | 15834 | N/A | |
| PLCB1 | 182621 | 439627 | 15835 | 391162 | 33573 |
| PLCB1 | 182621 | 628239 | 15836 | 487544 | 33574 |
| PLCB1 | 182621 | 635929 | 15837 | 490792 | 33575 |
| PLCB1 | 182621 | 437439 | 15838 | 389911 | 33576 |
| PLCB1 | 182621 | 637422 | 15839 | 489643 | 33577 |
| PLCB1 | 182621 | 637935 | 15840 | 490641 | 33578 |
| PLCB1 | 182621 | 637254 | 15841 | N/A | |
| PLCB1 | 182621 | 637273 | 15842 | N/A | |
| PLCB1 | 182621 | 617005 | 15843 | 477664 | 33579 |
| PLCB1 | 182621 | 612075 | 15844 | 479997 | 33580 |
| PLCE1 | 138193 | 371380 | 15845 | 360431 | 33581 |
| PLCE1 | 138193 | 371375 | 15846 | 360426 | 33582 |
| PLCE1 | 138193 | 464214 | 15847 | N/A | |
| PLCE1 | 138193 | 371385 | 15848 | 360438 | 33583 |
| PLCH1 | 114805 | 494598 | 15849 | 419100 | 33584 |
| PLCH1 | 114805 | 460012 | 15850 | 417502 | 33585 |
| PLCH1 | 114805 | 447496 | 15851 | 402759 | 33586 |
| PLCH1 | 114805 | 340059 | 15852 | 345968 | 33587 |
| PLCH1 | 114805 | 469040 | 15853 | N/A | |
| PLCH1 | 114805 | 334686 | 15854 | 335469 | 33588 |
| PLCH2 | 276429 | 627854 | 15855 | 487140 | 33589 |
| PLCH2 | 276429 | 626246 | 15856 | 486186 | 33590 |
| PLCH2 | 276429 | 627279 | 15857 | N/A | |
| PLCH2 | 276429 | 625637 | 15858 | N/A | |
| PLCH2 | 276429 | 627778 | 15859 | N/A | |
| PLCH2 | 276429 | 620687 | 15860 | 481938 | 33591 |
| PLCH2 | 149527 | 609981 | 15861 | 476436 | 33592 |
| PLCH2 | 149527 | 449969 | 15862 | 397289 | 33593 |
| PLCH2 | 149527 | 419816 | 15863 | 389803 | 33594 |

| Symbol | ENSG | ENST | SEQ ID | ENSP | SEQ ID |
|---|---|---|---|---|---|
| PLCH2 | 149527 | 343889 | 15864 | N/A | |
| PLCH2 | 149527 | 278878 | 15865 | 278878 | 33595 |
| PLCH2 | 149527 | 473964 | 15866 | N/A | |
| PLCH2 | 149527 | 462379 | 15867 | N/A | |
| PLCH2 | 149527 | 378486 | 15868 | 367747 | 33596 |
| PLCL1 | 115896 | 428675 | 15869 | 402861 | 33597 |
| PLCL1 | 115896 | 435320 | 15870 | 410488 | 33598 |
| PLCL1 | 115896 | 487695 | 15871 | 457588 | 33599 |
| PLCL1 | 115896 | 625084 | 15872 | N/A | |
| PLCL1 | 115896 | 472193 | 15873 | N/A | |
| PLCL1 | 115896 | 437704 | 15874 | 414138 | 33600 |
| PLCXD3 | 182836 | 377801 | 15875 | 367032 | 33601 |
| PLCXD3 | 182836 | 328457 | 15876 | 333751 | 33602 |
| PLD1 | 075651 | 463281 | 15877 | N/A | |
| PLD1 | 075651 | 356327 | 15878 | 348681 | 33603 |
| PLD1 | 075651 | 351298 | 15879 | 342793 | 33604 |
| PLD1 | 075651 | 446289 | 15880 | 395556 | 33605 |
| PLD1 | 075651 | 465816 | 15881 | N/A | |
| PLD1 | 075651 | 467432 | 15882 | N/A | |
| PLD1 | 075651 | 471075 | 15883 | N/A | |
| PLD1 | 075651 | 481505 | 15884 | N/A | |
| PLD1 | 075651 | 498278 | 15885 | N/A | |
| PLD1 | 075651 | 475273 | 15886 | N/A | |
| PLD1 | 075651 | 440204 | 15887 | 391164 | 33606 |
| PLD1 | 075651 | 418087 | 15888 | 400639 | 33607 |
| PLD1 | 075651 | 489995 | 15889 | N/A | |
| PLD1 | 075651 | 460926 | 15890 | N/A | |
| PLD1 | 075651 | 497307 | 15891 | N/A | |
| PLD1 | 075651 | 627725 | 15892 | 486967 | 33608 |
| PLD1 | 075651 | 331659 | 15893 | 328422 | 33609 |
| PLD4 | 166428 | 540372 | 15894 | 438677 | 33610 |
| PLD4 | 166428 | 392593 | 15895 | 376372 | 33611 |
| PLD4 | 166428 | 557573 | 15896 | 451278 | 33612 |
| PLD4 | 166428 | 472901 | 15897 | N/A | |
| PLD4 | 166428 | 472702 | 15898 | N/A | |
| PLD4 | 166428 | 553861 | 15899 | 451636 | 33613 |
| PLD5 | 180287 | 536534 | 15900 | 440896 | 33614 |
| PLD5 | 180287 | 314833 | 15901 | 314748 | 33615 |
| PLD5 | 180287 | 366545 | 15902 | 355503 | 33616 |
| PLD5 | 180287 | 467561 | 15903 | 440132 | 33617 |
| PLD5 | 180287 | 474177 | 15904 | N/A | |
| PLD5 | 180287 | 459864 | 15905 | 438191 | 33618 |
| PLD5 | 180287 | 442594 | 15906 | 414188 | 33619 |
| PLD5 | 180287 | 427495 | 15907 | 401285 | 33620 |
| PLEKHD1 | 175985 | 556123 | 15908 | N/A | |
| PLEKHD1 | 175985 | 322564 | 15909 | 317175 | 33621 |
| PLEKHG3 | 126822 | 555982 | 15910 | 450501 | 33622 |
| PLEKHG3 | 126822 | 634379 | 15911 | 489373 | 33623 |
| PLEKHG3 | 126822 | 247226 | 15912 | 247226 | 33624 |
| PLEKHG3 | 126822 | 554088 | 15913 | 450880 | 33625 |
| PLEKHG3 | 126822 | 554499 | 15914 | 451256 | 33626 |
| PLEKHG3 | 126822 | 556801 | 15915 | N/A | |
| PLEKHG3 | 126822 | 490180 | 15916 | N/A | |
| PLEKHG3 | 126822 | 471182 | 15917 | 450945 | 33627 |
| PLEKHG3 | 126822 | 484731 | 15918 | 450973 | 33628 |
| PLEKHG3 | 126822 | 492928 | 15919 | N/A | |
| PLEKHG3 | 126822 | 394691 | 15920 | 378183 | 33629 |
| PLEKHG5 | 171680 | 377748 | 15921 | 366977 | 33630 |
| PLEKHG5 | 171680 | 487949 | 15922 | N/A | |
| PLEKHG5 | 171680 | 377725 | 15923 | 366954 | 33631 |
| PLEKHG5 | 171680 | 377728 | 15924 | 366957 | 33632 |
| PLEKHG5 | 171680 | 377732 | 15925 | 366961 | 33633 |
| PLEKHG5 | 171680 | 400915 | 15926 | 383706 | 33634 |
| PLEKHG5 | 171680 | 377740 | 15927 | 366969 | 33635 |
| PLEKHG5 | 171680 | 639593 | 15928 | 491569 | 33636 |
| PLEKHG5 | 171680 | 400913 | 15929 | 383704 | 33637 |
| PLEKHG5 | 171680 | 535355 | 15930 | 441445 | 33638 |
| PLEKHG5 | 171680 | 340850 | 15931 | 344570 | 33639 |
| PLEKHG5 | 171680 | 537245 | 15932 | 439625 | 33640 |
| PLEKHG5 | 171680 | 489097 | 15933 | N/A | |
| PLEKHH1 | 054690 | 329153 | 15934 | 330278 | 33641 |
| PLEKHH1 | 054690 | 558386 | 15935 | N/A | |
| PLEKHH1 | 054690 | 561456 | 15936 | N/A | |
| PLEKHH1 | 054690 | 558981 | 15937 | N/A | |
| PLEKHH1 | 054690 | 557971 | 15938 | N/A | |
| PLEKHH1 | 054690 | 561135 | 15939 | N/A | |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| PLEKHH1 | 054690 | 561370 | 15940 | 452988 | 33642 | 5 | PLP1 | 123560 | 496836 | 16016 | N/A | |
| PLEKHH1 | 054690 | 558296 | 15941 | N/A | | | PLP1 | 123560 | 612423 | 16017 | 481006 | 33674 |
| PLEKHH1 | 054690 | 560100 | 15942 | N/A | | | PLPP2 | 141934 | 327790 | 16018 | 329697 | 33675 |
| PLEKHH1 | 054690 | 558366 | 15943 | N/A | | | PLPP2 | 141934 | 434325 | 16019 | 388565 | 33676 |
| PLEKHH1 | 054690 | 559981 | 15944 | N/A | | | PLPP2 | 141934 | 269812 | 16020 | 269812 | 33677 |
| PLEKHH1 | 054690 | 561057 | 15945 | 453343 | 33643 | | PLPP2 | 141934 | 621795 | 16021 | N/A | |
| PLEKHH1 | 054690 | 559766 | 15946 | N/A | | 10 | PLPP2 | 141934 | 633125 | 16022 | 488312 | 33678 |
| PLEKHH1 | 054690 | 559832 | 15947 | N/A | | | PLPP2 | 141934 | 586998 | 16023 | 466947 | 33679 |
| PLEKHH1 | 054690 | 559168 | 15948 | 453699 | 33644 | | PLPP2 | 141934 | 591572 | 16024 | 466545 | 33680 |
| PLEKHH1 | 054690 | 558214 | 15949 | N/A | | | PLPP2 | 141934 | 589672 | 16025 | N/A | |
| PLEKHH2 | 152527 | 282406 | 15950 | 282406 | 33645 | | PLPP3 | 162407 | 371250 | 16026 | 360296 | 33681 |
| PLEKHH2 | 152527 | 405223 | 15951 | N/A | | | PLPP3 | 162407 | 472957 | 16027 | N/A | |
| PLEKHH2 | 152527 | 405000 | 15952 | N/A | | 15 | PLPP3 | 162407 | 459962 | 16028 | N/A | |
| PLEKHH2 | 152527 | 491692 | 15953 | 427746 | 33646 | | PLPP3 | 162407 | 461655 | 16029 | N/A | |
| PLEKHH2 | 152527 | 460356 | 15954 | N/A | | | PLPP3 | 162407 | 476206 | 16030 | N/A | |
| PLEKHH2 | 152527 | 480103 | 15955 | N/A | | | PLPP4 | 203805 | 427079 | 16031 | 407979 | 33682 |
| PLEKHH2 | 152527 | 493408 | 15956 | N/A | | | PLPP4 | 203805 | 369073 | 16032 | 358069 | 33683 |
| PLEKHH2 | 152527 | 490038 | 15957 | 430377 | 33647 | | PLPP4 | 203805 | 496437 | 16033 | N/A | |
| PLEKHO2 | 241839 | 323544 | 15958 | 326706 | 33648 | 20 | PLPP4 | 203805 | 398250 | 16034 | 381302 | 33684 |
| PLEKHO2 | 241839 | 616065 | 15959 | 483505 | 33649 | | PLPPR1 | 148123 | 374874 | 16035 | 364008 | 33685 |
| PLK2 | 145632 | 274289 | 15960 | 274289 | 33650 | | PLPPR1 | 148123 | 456287 | 16036 | 410223 | 33686 |
| PLK2 | 145632 | 502671 | 15961 | N/A | | | PLPPR1 | 148123 | 494890 | 16037 | N/A | |
| PLK2 | 145632 | 511326 | 15962 | N/A | | | PLPPR1 | 148123 | 395056 | 16038 | 378496 | 33687 |
| PLK2 | 145632 | 503378 | 15963 | N/A | | | PLPPR1 | 148123 | 463206 | 16039 | N/A | |
| PLK2 | 145632 | 505244 | 15964 | N/A | | | PLPPR1 | 276539 | 611695 | 16040 | 478338 | 33688 |
| PLK2 | 145632 | 503713 | 15965 | N/A | | 25 | PLPPR1 | 276539 | 633861 | 16041 | 488301 | 33689 |
| PLK2 | 145632 | 510629 | 15966 | N/A | | | PLPPR1 | 276539 | 631622 | 16042 | N/A | |
| PLK2 | 145632 | 503115 | 15967 | N/A | | | PLPPR1 | 276539 | 614834 | 16043 | 477959 | 33690 |
| PLK2 | 145632 | 515415 | 15968 | N/A | | | PLPPR1 | 276539 | 632580 | 16044 | 488839 | 33691 |
| PLK2 | 145632 | 509555 | 15969 | N/A | | | PLPPR4 | 117600 | 370185 | 16045 | 359204 | 33692 |
| PLK2 | 145632 | 509422 | 15970 | N/A | | | PLPPR4 | 117600 | 370184 | 16016 | 359203 | 33693 |
| PLK2 | 145632 | 508300 | 15971 | N/A | | 30 | PLPPR4 | 117600 | 457765 | 16047 | 394913 | 33694 |
| PLK2 | 145632 | 514306 | 15972 | N/A | | | PLS1 | 120756 | 457734 | 16048 | 387890 | 33695 |
| PLK2 | 145632 | 504196 | 15973 | N/A | | | PLS1 | 120756 | 483373 | 16049 | 419893 | 33696 |
| PLK2 | 145632 | 617412 | 15974 | 478685 | 33651 | | PLS1 | 120756 | 475296 | 16050 | 417311 | 33697 |
| PLK5 | 185988 | 454744 | 15975 | 468376 | 33652 | | PLS1 | 120756 | 495744 | 16051 | 419531 | 33698 |
| PLK5 | 185988 | 642079 | 15976 | 493341 | 33653 | | PLS1 | 120756 | 476044 | 16052 | 417481 | 33699 |
| PLK5 | 185988 | 334770 | 15977 | 466248 | 33654 | 35 | PLS1 | 120756 | 461644 | 16053 | 419271 | 33700 |
| PLK5 | 185988 | 588430 | 15978 | 465896 | 33655 | | PLS1 | 120756 | 464320 | 16054 | 418880 | 33701 |
| PLK5 | 185988 | 588292 | 15979 | N/A | | | PLS1 | 120756 | 337777 | 16055 | 336831 | 33702 |
| PLLP | 102934 | 564376 | 15980 | N/A | | | PLS1 | 120756 | 497199 | 16056 | 417491 | 33703 |
| PLLP | 102934 | 613167 | 15981 | 481720 | 33656 | | PLS1 | 120756 | 497002 | 16057 | 418700 | 33704 |
| PLLP | 102934 | 219207 | 15982 | 219207 | 33657 | | PLS1 | 120756 | 460104 | 16058 | N/A | |
| PLLP | 102934 | 569059 | 15983 | 454656 | 33658 | 40 | PLS1 | 120756 | 483507 | 16059 | N/A | |
| PLLP | 102934 | 564018 | 15984 | 463575 | 33659 | | PLSCR1 | 188313 | 342435 | 16060 | 345494 | 33705 |
| PLOD2 | 152952 | 461497 | 15985 | 419354 | 33660 | | PLSCR1 | 188313 | 493432 | 16061 | 419680 | 33706 |
| PLOD2 | 152952 | 282903 | 15986 | 282903 | 33661 | | PLSCR1 | 188313 | 463777 | 16062 | 419228 | 33707 |
| PLOD2 | 152952 | 360060 | 15987 | 353170 | 33662 | | PLSCR1 | 188313 | 487389 | 16063 | 417792 | 33708 |
| PLOD2 | 152952 | 494950 | 15988 | 420094 | 33663 | | PLSCR1 | 188313 | 468985 | 16064 | 417469 | 33709 |
| PLOD2 | 152952 | 495700 | 15989 | N/A | | | PLSCR1 | 188313 | 448787 | 16065 | 411675 | 33710 |
| PLOD2 | 152952 | 475505 | 15990 | N/A | | 45 | PLSCR1 | 188313 | 488253 | 16066 | 418654 | 33711 |
| PLOD2 | 152952 | 478436 | 15991 | N/A | | | PLSCR1 | 188313 | 489775 | 16067 | 417733 | 33712 |
| PLOD2 | 152952 | 460520 | 15992 | N/A | | | PLSCR1 | 188313 | 483300 | 16068 | 420006 | 33713 |
| PLOD2 | 152952 | 469350 | 15993 | 419963 | 33664 | | PLSCR1 | 188313 | 484560 | 16069 | N/A | |
| PLOD2 | 152952 | 480704 | 15994 | 419880 | 33665 | | PLSCR1 | 188313 | 478267 | 16070 | 417588 | 33714 |
| PLP1 | 123560 | 434483 | 15995 | 403533 | 33666 | | PLSCR1 | 188313 | 470496 | 16071 | N/A | |
| PLP1 | 123560 | 494475 | 15996 | 480409 | 33667 | 50 | PLSCR1 | 188313 | 462666 | 16072 | 418103 | 33715 |
| PLP1 | 123560 | 455268 | 15997 | 409802 | 33668 | | PLSCR1 | 188313 | 486631 | 16073 | 418550 | 33716 |
| PLP1 | 123560 | 422393 | 15998 | 413931 | 33669 | | PLSCR1 | 188313 | 472349 | 16074 | 420523 | 33717 |
| PLP1 | 123560 | 433491 | 15999 | 393391 | 33670 | | PLSCR1 | 188313 | 494568 | 16075 | N/A | |
| PLP1 | 123560 | 443502 | 16000 | 391853 | 33671 | | PLSCR1 | 188313 | 490745 | 16076 | N/A | |
| PLP1 | 123560 | 621218 | 16001 | 484450 | 33672 | | PLSCR1 | 188313 | 469266 | 16077 | N/A | |
| PLP1 | 123560 | 619236 | 16002 | 477619 | 33673 | 55 | PLSCR1 | 188313 | 477974 | 16078 | N/A | |
| PLP1 | 123560 | 464776 | 16003 | N/A | | | PLSCR4 | 114698 | 354952 | 16079 | 347038 | 33718 |
| PLP1 | 123560 | 619257 | 16004 | N/A | | | PLSCR4 | 114698 | 433593 | 16080 | 415605 | 33719 |
| PLP1 | 123560 | 465975 | 16005 | N/A | | | PLSCR4 | 114698 | 446574 | 16081 | 399315 | 33720 |
| PLP1 | 123560 | 480325 | 16006 | N/A | | | PLSCR4 | 114698 | 493382 | 16082 | 419040 | 33721 |
| PLP1 | 123560 | 485931 | 16007 | N/A | | | PLSCR4 | 114698 | 475019 | 16083 | N/A | |
| PLP1 | 123560 | 495678 | 16008 | N/A | | 60 | PLSCR4 | 114698 | 460350 | 16084 | 417896 | 33722 |
| PLP1 | 123560 | 479569 | 16009 | N/A | | | PLSCR4 | 114698 | 460885 | 16085 | 420385 | 33723 |
| PLP1 | 123560 | 485688 | 16010 | N/A | | | PLSCR4 | 114698 | 476202 | 16086 | 418173 | 33724 |
| PLP1 | 123560 | 478642 | 16011 | N/A | | | PLSCR4 | 114698 | 481701 | 16087 | 418419 | 33725 |
| PLP1 | 123560 | 476160 | 16012 | N/A | | | PLSCR4 | 114698 | 498625 | 16088 | 417248 | 33726 |
| PLP1 | 123560 | 461231 | 16013 | N/A | | | PLSCR4 | 114698 | 383083 | 16089 | 372561 | 33727 |
| PLP1 | 123560 | 466486 | 16014 | N/A | | 65 | PLTP | 100979 | 354050 | 16090 | 335290 | 33728 |
| PLP1 | 123560 | 494119 | 16015 | N/A | | | PLTP | 100979 | 372420 | 16091 | 361497 | 33729 |

-continued

-continued

| Symbol | ENSG | ENST | SEQ ID | ENSP | SEQ ID |
|---|---|---|---|---|---|
| PLTP | 100979 | 372431 | 16092 | 361508 | 33730 |
| PLTP | 100979 | 477313 | 16093 | 417138 | 33731 |
| PLTP | 100979 | 420868 | 16094 | 411671 | 33732 |
| PLXDC1 | 161381 | 315392 | 16095 | 323927 | 33733 |
| PLXDC1 | 161381 | 394318 | 16096 | N/A | |
| PLXDC1 | 161381 | 578390 | 16097 | 462089 | 33734 |
| PLXDC1 | 161381 | 578517 | 16098 | N/A | |
| PLXDC1 | 161381 | 493200 | 16099 | N/A | |
| PLXDC1 | 161381 | 461225 | 16100 | N/A | |
| PLXDC1 | 161381 | 444911 | 16101 | 409687 | 33735 |
| PLXDC1 | 161381 | 578277 | 16102 | N/A | |
| PLXDC1 | 161381 | 582025 | 16103 | N/A | |
| PLXDC1 | 161381 | 579417 | 16104 | N/A | |
| PLXDC1 | 161381 | 579279 | 16105 | 464353 | 33736 |
| PLXDC1 | 161381 | 578808 | 16106 | 462241 | 33737 |
| PLXDC1 | 161381 | 441877 | 16107 | 393227 | 33738 |
| PLXDC1 | 161381 | 444435 | 16108 | N/A | |
| PLXDC1 | 161381 | 577838 | 16109 | N/A | |
| PLXDC1 | 161381 | 415163 | 16110 | 416819 | 33739 |
| PLXDC1 | 161381 | 579190 | 16111 | 464029 | 33740 |
| PLXDC1 | 161381 | 580667 | 16112 | N/A | |
| PLXDC1 | 161381 | 577941 | 16113 | N/A | |
| PLXDC1 | 161381 | 583285 | 16114 | N/A | |
| PLXDC2 | 120594 | 377242 | 16115 | 366450 | 33741 |
| PLXDC2 | 120594 | 377252 | 16116 | 366460 | 33742 |
| PLXDC2 | 120594 | 377238 | 16117 | N/A | |
| PLXNA1 | 114554 | 393409 | 16118 | 377061 | 33743 |
| PLXNA1 | 114554 | 503234 | 16119 | N/A | |
| PLXNA1 | 114554 | 503363 | 16120 | N/A | |
| PLXNA1 | 114554 | 505278 | 16121 | N/A | |
| PLXNA4 | 221866 | 359827 | 16122 | 352882 | 33744 |
| PLXNA4 | 221866 | 496550 | 16123 | N/A | |
| PLXNA4 | 221866 | 423507 | 16124 | 392772 | 33745 |
| PLXNA4 | 221866 | 378539 | 16125 | 367800 | 33746 |
| PLXNA4 | 221866 | 321063 | 16126 | 323194 | 33747 |
| PLXNB1 | 164050 | 296410 | 16127 | 296410 | 33748 |
| PLXNB1 | 164050 | 485535 | 16128 | N/A | |
| PLXNB1 | 164050 | 358536 | 16129 | 351338 | 33749 |
| PLXNB1 | 164050 | 456774 | 16130 | 414199 | 33750 |
| PLXNB1 | 164050 | 483753 | 16131 | N/A | |
| PLXNB1 | 164050 | 497627 | 16132 | N/A | |
| PLXNB1 | 164050 | 483676 | 16133 | N/A | |
| PLXNB1 | 164050 | 478171 | 16134 | N/A | |
| PLXNB1 | 164050 | 470525 | 16135 | N/A | |
| PLXNB1 | 164050 | 461261 | 16136 | N/A | |
| PLXNB1 | 164050 | 473996 | 16137 | N/A | |
| PLXNB1 | 164050 | 449094 | 16138 | 395987 | 33751 |
| PLXNB1 | 164050 | 465117 | 16139 | N/A | |
| PLXNB1 | 164050 | 467913 | 16140 | N/A | |
| PLXNB1 | 164050 | 464294 | 16141 | N/A | |
| PLXNB1 | 164050 | 484485 | 16142 | N/A | |
| PLXNB1 | 164050 | 462738 | 16143 | N/A | |
| PLXNB1 | 164050 | 466353 | 16144 | N/A | |
| PLXNB1 | 164050 | 473683 | 16145 | N/A | |
| PLXNB3 | 198753 | 361971 | 16146 | 355378 | 33752 |
| PLXNB3 | 198753 | 411613 | 16147 | 391650 | 33753 |
| PLXNB3 | 198753 | 482654 | 16148 | N/A | |
| PLXNB3 | 198753 | 455214 | 16149 | 396048 | 33754 |
| PLXNB3 | 198753 | 485980 | 16150 | N/A | |
| PLXNB3 | 198753 | 448847 | 16151 | 412454 | 33755 |
| PLXNB3 | 198753 | 469190 | 16152 | N/A | |
| PLXNB3 | 198753 | 472415 | 16153 | N/A | |
| PLXNB3 | 198753 | 538966 | 16154 | 442736 | 33756 |
| PLXNC1 | 136040 | 258526 | 16155 | 258526 | 33757 |
| PLXNC1 | 136040 | 546732 | 16156 | N/A | |
| PLXNC1 | 136040 | 551850 | 16157 | 447843 | 33758 |
| PLXNC1 | 136040 | 546659 | 16158 | N/A | |
| PLXNC1 | 136040 | 549810 | 16159 | N/A | |
| PLXNC1 | 136040 | 549217 | 16160 | 446781 | 33759 |
| PLXNC1 | 136040 | 550080 | 16161 | 447625 | 33760 |
| PLXNC1 | 136040 | 547057 | 16162 | 446720 | 33761 |
| PLXNC1 | 136040 | 551495 | 16163 | N/A | |
| PLXNC1 | 136040 | 545312 | 16164 | 439225 | 33762 |
| PLXNC1 | 136040 | 549187 | 16165 | N/A | |
| PMEL | 185664 | 449260 | 16166 | 402758 | 33763 |
| PMEL | 185664 | 552882 | 16167 | 449690 | 33764 |

| Symbol | ENSG | ENST | SEQ ID | ENSP | SEQ ID |
|---|---|---|---|---|---|
| PMEL | 185664 | 550164 | 16168 | 450036 | 33765 |
| PMEL | 185664 | 548747 | 16169 | 448828 | 33766 |
| PMEL | 185664 | 548493 | 16170 | 447374 | 33767 |
| PMEL | 185664 | 550447 | 16171 | 448029 | 33768 |
| PMEL | 185664 | 549564 | 16172 | N/A | |
| PMEL | 185664 | 549404 | 16173 | 449520 | 33769 |
| PMEL | 185664 | 550762 | 16174 | N/A | |
| PMEL | 185664 | 548803 | 16175 | 447732 | 33770 |
| PMEL | 185664 | 547137 | 16176 | 448849 | 33771 |
| PMEL | 185664 | 546543 | 16177 | 446662 | 33772 |
| PMEL | 185664 | 556802 | 16178 | N/A | |
| PMEL | 185664 | 548689 | 16179 | N/A | |
| PMEL | 185664 | 550590 | 16180 | N/A | |
| PMEL | 185664 | 549430 | 16181 | N/A | |
| PMEL | 185664 | 549418 | 16182 | 446633 | 33773 |
| PMEL | 185664 | 549233 | 16183 | 448871 | 33774 |
| PMEL | 185664 | 549413 | 16184 | N/A | |
| PMEPA1 | 124225 | 341744 | 16185 | 345826 | 33775 |
| PMEPA1 | 124225 | 395816 | 16186 | 379161 | 33776 |
| PMEPA1 | 124225 | 347215 | 16187 | 344014 | 33777 |
| PMEPA1 | 124225 | 395814 | 16188 | 379159 | 33778 |
| PMEPA1 | 124225 | 414037 | 16189 | 401506 | 33779 |
| PMEPA1 | 124225 | 395819 | 16190 | 379164 | 33780 |
| PMEPA1 | 124225 | 472841 | 16191 | N/A | |
| PMEPA1 | 124225 | 265626 | 16192 | 265626 | 33781 |
| PMP2 | 147588 | 256103 | 16193 | 256103 | 33782 |
| PMP2 | 147588 | 519260 | 16194 | 429917 | 33783 |
| PMP22 | 109099 | 395938 | 16195 | 379269 | 33784 |
| PMP22 | 109099 | 312280 | 16196 | 308937 | 33785 |
| PMP22 | 109099 | 494511 | 16197 | 462782 | 33786 |
| PMP22 | 109099 | 395936 | 16198 | 379268 | 33787 |
| PMP22 | 109099 | 580584 | 16199 | 464468 | 33788 |
| PMP22 | 109099 | 426385 | 16200 | 409824 | 33789 |
| PMP22 | 109099 | 580497 | 16201 | N/A | |
| PMP22 | 109099 | 471150 | 16202 | N/A | |
| PMP22 | 109099 | 612492 | 16203 | 484631 | 33790 |
| PMVK | 163344 | 368467 | 16204 | 357452 | 33791 |
| PNLIP | 175535 | 369221 | 16205 | 358223 | 33792 |
| PNLIP | 175535 | 470562 | 16206 | N/A | |
| PNMA2 | 240694 | 522362 | 16207 | 429344 | 33793 |
| PNMA2 | 240694 | 521740 | 16208 | N/A | |
| PNMA2 | 240694 | 518212 | 16209 | N/A | |
| PNMA2 | 240694 | 521875 | 16210 | N/A | |
| PNMA2 | 240694 | 523244 | 16211 | N/A | |
| PNMA2 | 240694 | 522450 | 16212 | N/A | |
| PNMA2 | 240694 | 522764 | 16213 | N/A | |
| PNMA2 | 240694 | 523616 | 16214 | N/A | |
| PNP | 198805 | 553418 | 16215 | 450663 | 33794 |
| PNP | 198805 | 361505 | 16216 | 354532 | 33795 |
| PNP | 198805 | 556293 | 16217 | N/A | |
| PNP | 198805 | 557229 | 16218 | N/A | |
| PNP | 198805 | 554056 | 16219 | N/A | |
| PNP | 198805 | 553591 | 16220 | 452421 | 33796 |
| PNP | 198805 | 554065 | 16221 | 451108 | 33797 |
| PNP | 198805 | 556754 | 16222 | N/A | |
| PNPLA3 | 100344 | 216180 | 16223 | 216180 | 33798 |
| PNPLA3 | 100344 | 406117 | 16224 | 384668 | 33799 |
| PNPLA3 | 100344 | 423180 | 16225 | 397987 | 33800 |
| PNPLA3 | 100344 | 478713 | 16226 | N/A | |
| PNPLA3 | 100344 | 497129 | 16227 | N/A | |
| PNPLA8 | 135241 | 426128 | 16228 | 394988 | 33801 |
| PNPLA8 | 135241 | 257694 | 16229 | 257694 | 33802 |
| PNPLA8 | 135241 | 422087 | 16230 | 410804 | 33803 |
| PNPLA8 | 135241 | 453144 | 16231 | 387789 | 33804 |
| PNPLA8 | 135241 | 436062 | 16232 | 406779 | 33805 |
| PNPLA8 | 135241 | 453085 | 16233 | 402274 | 33806 |
| PNPLA8 | 135241 | 483879 | 16234 | N/A | |
| PNPLA8 | 135241 | 476592 | 16235 | N/A | |
| PNPLA8 | 135241 | 462466 | 16236 | N/A | |
| PNPLA8 | 135241 | 489738 | 16237 | N/A | |
| PNPLA8 | 135241 | 427008 | 16238 | 406033 | 33807 |
| PNPLA8 | 135241 | 415498 | 16239 | 391872 | 33808 |
| POLR2A | 181222 | 617998 | 16240 | N/A | |
| POLR2A | 181222 | 572844 | 16241 | 461879 | 33809 |
| POLR2A | 181222 | 576952 | 16242 | N/A | |
| POLR2A | 181222 | 575547 | 16243 | N/A | |

511

-continued

| Symbol | ENSG | ENST | SEQ ID | ENSP | SEQ ID |
|---|---|---|---|---|---|
| POLR2A | 181222 | 576114 | 16244 | N/A | |
| POLR2A | 181222 | 576718 | 16245 | N/A | |
| POLR2A | 181222 | 574158 | 16246 | N/A | |
| POLR2A | 181222 | 573603 | 16247 | N/A | |
| POLR2A | 181222 | 576553 | 16248 | N/A | |
| POLR2J3 | 168255 | 464525 | 16249 | 419082 | 33810 |
| POLR2J3 | 168255 | 489144 | 16250 | 419145 | 33811 |
| POLR2J3 | 168255 | 379340 | 16251 | 368645 | 33812 |
| POLR2J3 | 168255 | 486319 | 16252 | 419146 | 33813 |
| POLR2J3 | 168255 | 503564 | 16253 | N/A | |
| POLR2J3 | 168255 | 511773 | 16254 | N/A | |
| POLR2J3 | 168255 | 508848 | 16255 | 425877 | 33814 |
| POLR2J3 | 168255 | 513506 | 16256 | 421085 | 33815 |
| POLR2J3 | 168255 | 501677 | 16257 | N/A | |
| POLR2J3 | 168255 | 506060 | 16258 | N/A | |
| POLR2J3 | 168255 | 502415 | 16259 | N/A | |
| POLR2J3 | 168255 | 507355 | 16260 | 426619 | 33816 |
| POLR2J3 | 168255 | 608621 | 16261 | 477228 | 33817 |
| POLR2J3 | 168255 | 511313 | 16262 | 422109 | 33818 |
| POLR2J3 | 168255 | 504157 | 16263 | N/A | |
| POLR2J3 | 168255 | 508910 | 16264 | N/A | |
| POLR2J3 | 168255 | 621093 | 16265 | 483328 | 33819 |
| POLR2J3 | 168255 | 443430 | 16266 | N/A | |
| POLR2J3 | 168255 | 513438 | 16267 | 421950 | 33820 |
| POLR2J3 | 168255 | 504101 | 16268 | N/A | |
| POLR2J3 | 168255 | 613744 | 16269 | 482932 | 33821 |
| PON2 | 105854 | 455123 | 16270 | 414515 | 33822 |
| PON2 | 105854 | 433091 | 16271 | 404622 | 33823 |
| PON2 | 105854 | 222572 | 16272 | 222572 | 33824 |
| PON2 | 105854 | 633192 | 16273 | 488378 | 33825 |
| PON2 | 105854 | 483292 | 16274 | 488874 | 33826 |
| PON2 | 105854 | 446142 | 16275 | 405211 | 33827 |
| PON2 | 105854 | 459842 | 16276 | N/A | |
| PON2 | 105854 | 469926 | 16277 | 488550 | 33828 |
| PON2 | 105854 | 491069 | 16278 | 488462 | 33829 |
| PON2 | 105854 | 490778 | 16279 | 488826 | 33830 |
| PON2 | 105854 | 632034 | 16280 | 487898 | 33831 |
| PON2 | 105854 | 493290 | 16281 | 488822 | 33832 |
| PON2 | 105854 | 478801 | 16282 | 487703 | 33833 |
| PON2 | 105854 | 460873 | 16283 | N/A | |
| PON2 | 105854 | 493469 | 16284 | N/A | |
| PON2 | 105854 | 471883 | 16285 | N/A | |
| PON2 | 105854 | 469716 | 16286 | N/A | |
| PON2 | 105854 | 633531 | 16287 | 488838 | 33834 |
| POR | 127948 | 453773 | 16288 | 395813 | 33835 |
| POR | 127948 | 439963 | 16289 | 390540 | 33836 |
| POR | 127948 | 461988 | 16290 | 419970 | 33837 |
| POR | 127948 | 448410 | 16291 | 399409 | 33838 |
| POR | 127948 | 421059 | 16292 | 409881 | 33839 |
| POR | 127948 | 471238 | 16293 | N/A | |
| POR | 127948 | 394893 | 16294 | 378355 | 33840 |
| POR | 127948 | 412521 | 16295 | 409238 | 33841 |
| POR | 127948 | 414186 | 16296 | 399327 | 33842 |
| POR | 127948 | 432753 | 16297 | 389409 | 33843 |
| POR | 127948 | 449920 | 16298 | 399556 | 33844 |
| POR | 127948 | 418341 | 16299 | 389719 | 33845 |
| POR | 127948 | 412064 | 16300 | 404731 | 33846 |
| POR | 127948 | 454934 | 16301 | 414263 | 33847 |
| POR | 127948 | 447222 | 16302 | 393527 | 33848 |
| POR | 127948 | 426184 | 16303 | 400964 | 33849 |
| POR | 127948 | 439297 | 16304 | 403494 | 33850 |
| POR | 127948 | 475509 | 16305 | N/A | |
| POR | 127948 | 460892 | 16306 | N/A | |
| POR | 127948 | 439269 | 16307 | 412490 | 33851 |
| POR | 127948 | 496888 | 16308 | N/A | |
| POR | 127948 | 487247 | 16309 | N/A | |
| POR | 127948 | 495770 | 16310 | N/A | |
| POR | 127948 | 493973 | 16311 | N/A | |
| POU3F2 | 184486 | 328345 | 16312 | 329170 | 33852 |
| PPARG | 132170 | 397010 | 16313 | 380205 | 33853 |
| PPARG | 132170 | 397029 | 16314 | 380224 | 33854 |
| PPARG | 132170 | 309576 | 16315 | 312472 | 33855 |
| PPARG | 132170 | 397015 | 16316 | 380210 | 33856 |
| PPARG | 132170 | 455517 | 16317 | 411931 | 33857 |
| PPARG | 132170 | 397012 | 16318 | 380207 | 33858 |
| PPARG | 132170 | 397026 | 16319 | 380221 | 33859 |

512

-continued

| Symbol | ENSG | ENST | SEQ ID | ENSP | SEQ ID |
|---|---|---|---|---|---|
| PPARG | 132170 | 497594 | 16320 | N/A | |
| PPARG | 132170 | 438682 | 16321 | 392285 | 33860 |
| PPARG | 132170 | 397000 | 16322 | 380196 | 33861 |
| PPARG | 132170 | 477039 | 16323 | N/A | |
| PPARG | 132170 | 287820 | 16324 | 287820 | 33862 |
| PPARG | 132170 | 397023 | 16325 | 380218 | 33863 |
| PPARG | 132170 | 396999 | 16326 | 380195 | 33864 |
| PPFIA4 | 143847 | 367240 | 16327 | 356209 | 33865 |
| PPFIA4 | 143847 | 447715 | 16328 | 402576 | 33866 |
| PPFIA4 | 143847 | 601609 | 16329 | N/A | |
| PPFIA4 | 143847 | 600426 | 16330 | 470427 | 33867 |
| PPFIA4 | 143847 | 272198 | 16331 | 272198 | 33868 |
| PPFIA4 | 143847 | 599966 | 16332 | 471264 | 33869 |
| PPFIA4 | 143847 | 600447 | 16333 | N/A | |
| PPFIA4 | 143847 | 599514 | 16334 | 472251 | 33870 |
| PPFIA4 | 143847 | 594656 | 16335 | N/A | |
| PPFIA4 | 143847 | 486360 | 16336 | N/A | |
| PPFIA4 | 143847 | 597023 | 16337 | N/A | |
| PPFIA4 | 143847 | 594572 | 16338 | N/A | |
| PPFIA4 | 143847 | 295706 | 16339 | 295706 | 33871 |
| PPFIBP1 | 110841 | 538433 | 16340 | 442462 | 33872 |
| PPFIBP1 | 110841 | 545381 | 16341 | 445822 | 33873 |
| PPFIBP1 | 110841 | 545334 | 16342 | 438036 | 33874 |
| PPFIBP1 | 110841 | 540114 | 16343 | 444304 | 33875 |
| PPFIBP1 | 110841 | 541633 | 16344 | N/A | |
| PPFIBP1 | 110841 | 537927 | 16345 | 445425 | 33876 |
| PPFIBP1 | 110841 | 318304 | 16346 | 314724 | 33877 |
| PPFIBP1 | 110841 | 535047 | 16347 | 444016 | 33878 |
| PPFIBP1 | 110841 | 542629 | 16348 | 443442 | 33879 |
| PPFIBP1 | 110841 | 228425 | 16349 | 228425 | 33880 |
| PPFIBP1 | 110841 | 535575 | 16350 | 437438 | 33881 |
| PPFIBP1 | 110841 | 542187 | 16351 | 445132 | 33882 |
| PPFIBP1 | 110841 | 534917 | 16352 | N/A | |
| PPFIBP1 | 110841 | 537261 | 16353 | 443324 | 33883 |
| PPFIBP1 | 110841 | 619325 | 16354 | 479763 | 33884 |
| PPFIBP1 | 110841 | 540503 | 16355 | N/A | |
| PPFIBP1 | 110841 | 539326 | 16356 | 438174 | 33885 |
| PPFIBP1 | 110841 | 540256 | 16357 | N/A | |
| PPFIBP2 | 166387 | 526873 | 16358 | 434641 | 33886 |
| PPFIBP2 | 166387 | 528947 | 16359 | 431724 | 33887 |
| PPFIBP2 | 166387 | 299492 | 16360 | 299492 | 33888 |
| PPFIBP2 | 166387 | 527790 | 16361 | 434981 | 33889 |
| PPFIBP2 | 166387 | 526016 | 16362 | 433026 | 33890 |
| PPFIBP2 | 166387 | 524548 | 16363 | 433917 | 33891 |
| PPFIBP2 | 166387 | 529575 | 16364 | 435794 | 33892 |
| PPFIBP2 | 166387 | 533792 | 16365 | 436498 | 33893 |
| PPFIBP2 | 166387 | 532926 | 16366 | N/A | |
| PPFIBP2 | 166387 | 525597 | 16367 | 433839 | 33894 |
| PPFIBP2 | 166387 | 529021 | 16368 | N/A | |
| PPFIBP2 | 166387 | 528883 | 16369 | 435469 | 33895 |
| PPFIBP2 | 166387 | 529321 | 16370 | N/A | |
| PPFIBP2 | 166387 | 530189 | 16371 | N/A | |
| PPFIBP2 | 166387 | 530181 | 16372 | 437321 | 33896 |
| PPFIBP2 | 166387 | 532416 | 16373 | N/A | |
| PPFIBP2 | 166387 | 534409 | 16374 | 433713 | 33897 |
| PPFIBP2 | 166387 | 530582 | 16375 | N/A | |
| PPFIBP2 | 166387 | 532381 | 16376 | N/A | |
| PPFIBP2 | 166387 | 530081 | 16377 | 436739 | 33898 |
| PPFIBP2 | 166387 | 532172 | 16378 | N/A | |
| PPFIBP2 | 166387 | 524495 | 16379 | N/A | |
| PPFIBP2 | 166387 | 532112 | 16380 | N/A | |
| PPFIBP2 | 166387 | 528929 | 16381 | N/A | |
| PPFIBP2 | 166387 | 529664 | 16382 | N/A | |
| PPFIBP2 | 166387 | 534552 | 16383 | 436489 | 33899 |
| PPM1E | 175175 | 308249 | 16384 | 312411 | 33900 |
| PPM1H | 111110 | 228705 | 16385 | 228705 | 33901 |
| PPM1H | 111110 | 551214 | 16386 | N/A | |
| PPM1H | 111110 | 551519 | 16387 | N/A | |
| PPM1H | 111110 | 548414 | 16388 | N/A | |
| PPM1H | 111110 | 547857 | 16389 | N/A | |
| PPM1J | 155367 | 471106 | 16390 | 474405 | 33902 |
| PPM1J | 155367 | 309276 | 16391 | 308926 | 33903 |
| PPM1J | 155367 | 464951 | 16392 | 475711 | 33904 |
| PPM1J | 155367 | 482367 | 16393 | 474145 | 33905 |
| PPM1J | 155367 | 486709 | 16394 | N/A | |
| PPP1R11 | 237403 | 455350 | 16395 | 397132 | 33906 |

| Symbol | ENSG | ENST | SEQ ID | ENSP | SEQ ID |
|---|---|---|---|---|---|
| PPP1R11 | 237403 | 448378 | 16396 | 403557 | 33907 |
| PPP1R11 | 237403 | 429382 | 16397 | 390917 | 33908 |
| PPP1R11 | 237403 | 418211 | 16398 | 411976 | 33909 |
| PPP1R11 | 237403 | 444101 | 16399 | 396522 | 33910 |
| PPP1R11 | 237403 | 430959 | 16400 | 399723 | 33911 |
| PPP1R11 | 233314 | 441553 | 16401 | 392044 | 33912 |
| PPP1R11 | 233314 | 437937 | 16402 | 394056 | 33913 |
| PPP1R11 | 233314 | 446310 | 16403 | 400763 | 33914 |
| PPP1R11 | 233314 | 414618 | 16404 | 404824 | 33915 |
| PPP1R11 | 233314 | 434591 | 16405 | 399965 | 33916 |
| PPP1R11 | 233314 | 452227 | 16406 | 392260 | 33917 |
| PPP1R11 | 236560 | 448550 | 16407 | 411693 | 33918 |
| PPP1R11 | 236560 | 431424 | 16408 | 411038 | 33919 |
| PPP1R11 | 236560 | 414032 | 16409 | 408173 | 33920 |
| PPP1R11 | 236560 | 439463 | 16410 | 416038 | 33921 |
| PPP1R11 | 236560 | 451993 | 16411 | 415651 | 33922 |
| PPP1R11 | 236560 | 450177 | 16412 | 399167 | 33923 |
| PPP1R11 | 234058 | 436591 | 16413 | 414808 | 33924 |
| PPP1R11 | 234058 | 448210 | 16414 | 414471 | 33925 |
| PPP1R11 | 234058 | 422273 | 16415 | 406410 | 33926 |
| PPP1R11 | 234058 | 430828 | 16416 | 391581 | 33927 |
| PPP1R11 | 234058 | 412077 | 16417 | 401267 | 33928 |
| PPP1R11 | 234058 | 444994 | 16418 | 390548 | 33929 |
| PPP1R11 | 204619 | 376773 | 16419 | 365964 | 33930 |
| PPP1R11 | 204619 | 376772 | 16420 | 365963 | 33931 |
| PPP1R11 | 204619 | 376769 | 16421 | 365960 | 33932 |
| PPP1R11 | 204619 | 376765 | 16422 | 365956 | 33933 |
| PPP1R11 | 204619 | 376763 | 16423 | 365954 | 33934 |
| PPP1R11 | 204619 | 376758 | 16424 | 365949 | 33935 |
| PPP1R11 | 227720 | 433942 | 16425 | 399222 | 33936 |
| PPP1R11 | 227720 | 452679 | 16426 | 412297 | 33937 |
| PPP1R11 | 227720 | 417223 | 16427 | 412526 | 33938 |
| PPP1R11 | 227720 | 436833 | 16428 | 400589 | 33939 |
| PPP1R11 | 227720 | 428563 | 16429 | 406648 | 33940 |
| PPP1R11 | 227720 | 449435 | 16430 | 409066 | 33941 |
| PPP1R11 | 206501 | 400658 | 16431 | 383499 | 33942 |
| PPP1R11 | 206501 | 383612 | 16432 | 373107 | 33943 |
| PPP1R11 | 206501 | 400657 | 16433 | 383498 | 33944 |
| PPP1R11 | 206501 | 400656 | 16434 | 383497 | 33945 |
| PPP1R11 | 206501 | 400655 | 16435 | 383496 | 33946 |
| PPP1R11 | 206501 | 400654 | 16436 | 383495 | 33947 |
| PPP1R11 | 237829 | 437171 | 16437 | 404779 | 33948 |
| PPP1R11 | 237829 | 449087 | 16438 | 398205 | 33949 |
| PPP1R11 | 237829 | 431977 | 16439 | 407981 | 33950 |
| PPP1R11 | 237829 | 433662 | 16440 | 410429 | 33951 |
| PPP1R11 | 237829 | 458506 | 16441 | 403611 | 33952 |
| PPP1R11 | 237829 | 455887 | 16442 | 388044 | 33953 |
| PPP1R14A | 167641 | 587515 | 16443 | 465811 | 33954 |
| PPP1R14A | 167641 | 591291 | 16444 | 466572 | 33955 |
| PPP1R14A | 167641 | 347262 | 16445 | 301243 | 33956 |
| PPP1R14A | 167641 | 301242 | 16446 | 301242 | 33957 |
| PPP1R14A | 167641 | 591585 | 16447 | 465104 | 33958 |
| PPP1R15A | 087074 | 200453 | 16448 | 200453 | 33959 |
| PPP1R15A | 087074 | 600406 | 16449 | 469239 | 33960 |
| PPP1R16B | 101445 | 299824 | 16450 | 299824 | 33961 |
| PPP1R16B | 101445 | 373331 | 16451 | 362428 | 33962 |
| PPP1R16B | 101445 | 468265 | 16452 | N/A | |
| PPP1R16B | 101445 | 463749 | 16453 | N/A | |
| PPP1R17 | 106341 | 342032 | 16454 | 340125 | 33963 |
| PPP1R17 | 106341 | 409146 | 16455 | 386459 | 33964 |
| PPP1R17 | 106341 | 498609 | 16456 | N/A | |
| PPP1R1C | 150722 | 495820 | 16457 | N/A | |
| PPP1R1C | 150722 | 486067 | 16458 | N/A | |
| PPP1R1C | 150722 | 475249 | 16459 | N/A | |
| PPP1R1C | 150722 | 464264 | 16460 | N/A | |
| PPP1R1C | 150722 | 490645 | 16461 | N/A | |
| PPP1R1C | 150722 | 465612 | 16462 | N/A | |
| PPP1R1C | 150722 | 409137 | 16463 | 386359 | 33965 |
| PPP1R1C | 150722 | 280295 | 16464 | 280295 | 33966 |
| PPP1R1C | 150722 | 409702 | 16465 | 386778 | 33967 |
| PPP1R1C | 150722 | 479855 | 16466 | N/A | |
| PPP1R1C | 150722 | 461410 | 16467 | N/A | |
| PPP1R1C | 150722 | 494189 | 16468 | N/A | |
| PPP1R36 | 165807 | 298705 | 16469 | 298705 | 33968 |
| PPP1R36 | 165807 | 555645 | 16470 | 451900 | 33969 |
| PPP1R36 | 165807 | 467261 | 16471 | 435229 | 33970 |

| Symbol | ENSG | ENST | SEQ ID | ENSP | SEQ ID |
|---|---|---|---|---|---|
| PPP1R36 | 165807 | 557202 | 16472 | 452491 | 33971 |
| PPP1R36 | 165807 | 554400 | 16473 | N/A | |
| PPP1R36 | 165807 | 556023 | 16474 | N/A | |
| PPP2CA | 113575 | 481195 | 16475 | 418447 | 33972 |
| PPP2CA | 113575 | 472253 | 16476 | N/A | |
| PPP2CA | 113575 | 495833 | 16477 | N/A | |
| PPP2CA | 113575 | 522385 | 16478 | 430869 | 33973 |
| PPP2CA | 113575 | 523082 | 16479 | 428816 | 33974 |
| PPP2CA | 113575 | 231504 | 16480 | N/A | |
| PPP2R2C | 074211 | 335585 | 16481 | 335083 | 33975 |
| PPP2R2C | 074211 | 506140 | 16482 | 423649 | 33976 |
| PPP2R2C | 074211 | 515571 | 16483 | 422374 | 33977 |
| PPP2R2C | 074211 | 382599 | 16484 | 372042 | 33978 |
| PPP2R2C | 074211 | 507294 | 16485 | 425247 | 33979 |
| PPP2R2C | 074211 | 513943 | 16486 | N/A | |
| PPP2R2C | 074211 | 314348 | 16487 | N/A | |
| PPP2R2C | 074211 | 509917 | 16488 | 423650 | 33980 |
| PPP2R2C | 074211 | 507028 | 16489 | N/A | |
| PPP4R4 | 119698 | 304338 | 16490 | 305924 | 33981 |
| PPP4R4 | 119698 | 328839 | 16491 | 330831 | 33982 |
| PPP4R4 | 119698 | 553661 | 16492 | 451543 | 33983 |
| PPP4R4 | 119698 | 556884 | 16493 | 452121 | 33984 |
| PPP4R4 | 119698 | 555690 | 16494 | N/A | |
| PPP4R4 | 119698 | 556470 | 16495 | 451556 | 33985 |
| PPP4R4 | 278326 | 630860 | 16496 | 487248 | 33986 |
| PPP4R4 | 278326 | 619905 | 16497 | 480902 | 33987 |
| PPP4R4 | 278326 | 614957 | 16498 | 482849 | 33988 |
| PPP4R4 | 278326 | 628432 | 16499 | 487271 | 33989 |
| PPP4R4 | 278326 | 630154 | 16500 | 486247 | 33990 |
| PPP6R2 | 100239 | 359139 | 16501 | 352051 | 33991 |
| PPP6R2 | 100239 | 395741 | 16502 | 379090 | 33992 |
| PPP6R2 | 100239 | 395744 | 16503 | 379093 | 33993 |
| PPP6R2 | 100239 | 216061 | 16504 | 216061 | 33994 |
| PPP6R2 | 100239 | 401672 | 16505 | 384532 | 33995 |
| PPP6R2 | 100239 | 427222 | 16506 | 391595 | 33996 |
| PPP6R2 | 100239 | 473283 | 16507 | N/A | |
| PPP6R2 | 100239 | 470016 | 16508 | N/A | |
| PPP6R2 | 100239 | 612753 | 16509 | 478417 | 33997 |
| PRAG1 | 275342 | 615670 | 16510 | 481109 | 33998 |
| PRAG1 | 275342 | 622241 | 16511 | 479068 | 33999 |
| PRDM1 | 057657 | 369091 | 16512 | 358087 | 34000 |
| PRDM1 | 057657 | 369096 | 16513 | 358092 | 34001 |
| PRDM1 | 057657 | 424894 | 16514 | 395566 | 34002 |
| PRDM1 | 057657 | 489365 | 16515 | N/A | |
| PRDM1 | 057657 | 450060 | 16516 | 399772 | 34003 |
| PRDM1 | 057657 | 481163 | 16517 | N/A | |
| PRDM1 | 057657 | 369089 | 16518 | 358085 | 34004 |
| PRDM8 | 152784 | 508965 | 16519 | N/A | |
| PRDM8 | 152784 | 509375 | 16520 | N/A | |
| PRDM8 | 152784 | 506547 | 16521 | N/A | |
| PRDM8 | 152784 | 511825 | 16522 | N/A | |
| PRDM8 | 152784 | 504452 | 16523 | 423985 | 34005 |
| PRDM8 | 152784 | 508061 | 16524 | N/A | |
| PRDM8 | 152784 | 515013 | 16525 | 425149 | 34006 |
| PRDM8 | 152784 | 507025 | 16526 | N/A | |
| PRDM8 | 152784 | 415738 | 16527 | 406998 | 34007 |
| PRDM8 | 152784 | 339711 | 16528 | 339764 | 34008 |
| PRELP | 188783 | 343110 | 16529 | 343924 | 34009 |
| PREX1 | 124126 | 482556 | 16530 | 434632 | 34010 |
| PREX1 | 124126 | 371941 | 16531 | 361009 | 34011 |
| PREX1 | 124126 | 496915 | 16532 | N/A | |
| PREX1 | 124126 | 620554 | 16533 | 481444 | 34012 |
| PREX2 | 046889 | 288368 | 16534 | 288368 | 34013 |
| PREX2 | 046889 | 529398 | 16535 | N/A | |
| PREX2 | 046889 | 517617 | 16536 | N/A | |
| PREX2 | 046889 | 522247 | 16537 | N/A | |
| PREX2 | 046889 | 520235 | 16538 | N/A | |
| PRICKLE1 | 139174 | 345127 | 16539 | 345064 | 34014 |
| PRICKLE1 | 139174 | 639589 | 16540 | 491051 | 34015 |
| PRICKLE1 | 139174 | 445766 | 16541 | 398947 | 34016 |
| PRICKLE1 | 139174 | 640132 | 16542 | 491228 | 34017 |
| PRICKLE1 | 139174 | 455697 | 16543 | 401060 | 34018 |
| PRICKLE1 | 139174 | 640840 | 16544 | N/A | |
| PRICKLE1 | 139174 | 640055 | 16545 | 492763 | 34019 |
| PRICKLE1 | 139174 | 639958 | 16546 | 492644 | 34020 |
| PRICKLE1 | 139174 | 548696 | 16547 | 448359 | 34021 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| PRICKLE1 | 139174 | 639566 | 16548 | 492332 | 34022 | 5 | PRKG1 | 185532 | 373985 | 16624 | 363097 | 34074 |
| PRICKLE1 | 139174 | 552240 | 16549 | 449819 | 34023 | | PRKG1 | 185532 | 373980 | 16625 | 363092 | 34075 |
| PRICKLE1 | 139174 | 640361 | 16550 | N/A | | | PRKG1 | 185532 | 373976 | 16626 | 363087 | 34076 |
| PRICKLE1 | 139174 | 640946 | 16551 | N/A | | | PRKG1 | 185532 | 373975 | 16627 | N/A | |
| PRICKLE1 | 139174 | 552108 | 16552 | 447870 | 34024 | | PRKG1 | 185532 | 401604 | 16628 | 384200 | 34077 |
| PRICKLE1 | 139174 | 640801 | 16553 | 491473 | 34025 | | PRKG2 | 138669 | 395578 | 16629 | 378945 | 34078 |
| PRICKLE1 | 139174 | 551050 | 16554 | 446970 | 34026 | 10 | PRKG2 | 138669 | 628926 | 16630 | 486129 | 34079 |
| PRICKLE1 | 139174 | 547113 | 16555 | 446699 | 34027 | | PRKG2 | 138669 | 509169 | 16631 | N/A | |
| PRICKLE1 | 139174 | 640646 | 16556 | 492483 | 34028 | | PRKG2 | 138669 | 509474 | 16632 | N/A | |
| PRICKLE1 | 139174 | 639414 | 16557 | N/A | | | PRKG2 | 138669 | 456882 | 16633 | N/A | |
| PRICKLE1 | 139174 | 552200 | 16558 | N/A | | | PRKG2 | 138669 | 545647 | 16634 | 439967 | 34080 |
| PRICKLE1 | 139174 | 639588 | 16559 | N/A | | | PRKG2 | 138669 | 264399 | 16635 | 264399 | 34081 |
| PRIMA1 | 175785 | 393140 | 16560 | 376848 | 34029 | 15 | PRKY | 099725 | 528056 | 16636 | N/A | |
| PRIMA1 | 175785 | 477603 | 16561 | 434370 | 34030 | | PRKY | 099725 | 533551 | 16637 | N/A | |
| PRIMA1 | 175785 | 393143 | 16562 | 376851 | 34031 | | PRKY | 099725 | 495163 | 16638 | N/A | |
| PRIMA1 | 175785 | 316227 | 16563 | 320948 | 34032 | | PRKY | 099725 | 472666 | 16639 | N/A | |
| PRIMA1 | 274089 | 629961 | 16564 | 486953 | 34033 | | PRMT8 | 111218 | 452611 | 16640 | 414507 | 34082 |
| PRIMA1 | 274089 | 627063 | 16565 | 486875 | 34034 | | PRMT8 | 111218 | 382622 | 16641 | 372067 | 34083 |
| PRIMA1 | 274089 | 617019 | 16566 | 479855 | 34035 | 20 | PRMT8 | 111218 | 543701 | 16642 | N/A | |
| PRIMA1 | 274089 | 611347 | 16567 | 479082 | 34036 | | PRMT8 | 111218 | 261252 | 16643 | N/A | |
| PRKAG2 | 106617 | 287878 | 16568 | 287878 | 34037 | | PRMT9 | 164169 | 322396 | 16644 | 314396 | 34084 |
| PRKAG2 | 106617 | 418337 | 16569 | 387386 | 34038 | | PRMT9 | 164169 | 510269 | 16645 | N/A | |
| PRKAG2 | 106617 | 492843 | 16570 | 419577 | 34039 | | PRMT9 | 164169 | 514886 | 16646 | 426732 | 34085 |
| PRKAG2 | 106617 | 392801 | 16571 | 376549 | 34040 | | PRMT9 | 164169 | 511687 | 16647 | N/A | |
| PRKAG2 | 106617 | 479461 | 16572 | N/A | | 25 | PRNP | 171867 | 379440 | 16648 | 368752 | 34086 |
| PRKAG2 | 106617 | 485183 | 16573 | N/A | | | PRNP | 171867 | 430350 | 16649 | 399376 | 34087 |
| PRKAG2 | 106617 | 478989 | 16574 | 420645 | 34041 | | PRNP | 171867 | 424424 | 16650 | 411599 | 34088 |
| PRKAG2 | 106617 | 488258 | 16575 | 420783 | 34042 | | PRNP | 171867 | 457586 | 16651 | 415284 | 34089 |
| PRKAG2 | 106617 | 476632 | 16576 | 419493 | 34043 | | PROCR | 101000 | 216968 | 16652 | 216968 | 34090 |
| PRKAG2 | 106617 | 493872 | 16577 | 417252 | 34044 | | PROCR | 101000 | 635377 | 16653 | 489117 | 34091 |
| PRKAG2 | 106617 | 491938 | 16578 | N/A | | | PROCR | 101000 | 634509 | 16654 | 489456 | 34092 |
| PRKAG2 | 106617 | 483775 | 16579 | N/A | | 30 | PRODH | 100033 | 491604 | 16655 | N/A | |
| PRKAG2 | 106617 | 481434 | 16580 | N/A | | | PRODH | 100033 | 420436 | 16656 | 410805 | 34093 |
| PRKAG2 | 106617 | 487375 | 16581 | N/A | | | PRODH | 100033 | 313755 | 16657 | N/A | |
| PRKAG2 | 106617 | 461529 | 16582 | N/A | | | PRODH | 100033 | 429300 | 16658 | N/A | |
| PRKAG2 | 106617 | 474383 | 16583 | N/A | | | PRODH | 100033 | 482858 | 16659 | N/A | |
| PRKAG3 | 115592 | 233944 | 16584 | 233944 | 34045 | | PRODH | 100033 | 334029 | 16660 | 334726 | 34094 |
| PRKAG3 | 115592 | 529249 | 16585 | 436068 | 34046 | 35 | PRODH | 100033 | 357068 | 16661 | 349577 | 34095 |
| PRKAG3 | 115592 | 470307 | 16586 | 419272 | 34047 | | PRODH | 100033 | 609229 | 16662 | N/A | |
| PRKAG3 | 115592 | 490971 | 16587 | N/A | | | PRODH | 100033 | 446371 | 16663 | N/A | |
| PRKAG3 | 115592 | 430489 | 16588 | 416100 | 34048 | | PRODH | 100033 | 438924 | 16664 | 409742 | 34096 |
| PRKAG3 | 115592 | 439262 | 16589 | 397133 | 34049 | | PRODH | 100033 | 399694 | 16665 | N/A | |
| PRKCB | 166501 | 321728 | 16590 | 318315 | 34050 | | PRODH | 100033 | 450579 | 16666 | 396806 | 34097 |
| PRKCB | 166501 | 303531 | 16591 | 305355 | 34051 | 40 | PRODH | 100033 | 457083 | 16667 | 413941 | 34098 |
| PRKCB | 166501 | 498058 | 16592 | 454428 | 34052 | | PRODH | 100033 | 496625 | 16668 | N/A | |
| PRKCB | 166501 | 498739 | 16593 | 459227 | 34053 | | PRODH | 100033 | 610940 | 16669 | 480347 | 34099 |
| PRKCB | 166501 | 486868 | 16594 | N/A | | | PROX1 | 117707 | 471129 | 16670 | 419517 | 34100 |
| PRKCB | 166501 | 482000 | 16595 | N/A | | | PROX1 | 117707 | 366958 | 16671 | 355925 | 34101 |
| PRKCB | 166501 | 472066 | 16596 | 457980 | 34054 | | PROX1 | 117707 | 607726 | 16672 | N/A | |
| PRKCB | 166501 | 463752 | 16597 | N/A | | | PROX1 | 117707 | 435016 | 16673 | 400694 | 34102 |
| PRKCB | 166501 | 487674 | 16598 | N/A | | 45 | PROX1 | 117707 | 607425 | 16674 | 475357 | 34103 |
| PRKCB | 166501 | 466124 | 16599 | 458564 | 34055 | | PROX1 | 117707 | 498508 | 16675 | 420283 | 34104 |
| PRKCD | 163932 | 478843 | 16600 | 419726 | 34056 | | PROX1 | 117707 | 261454 | 16676 | 261454 | 34105 |
| PRKCD | 163932 | 394729 | 16601 | 378217 | 34057 | | PRR5 | 186654 | 432186 | 16677 | 400925 | 34106 |
| PRKCD | 163932 | 330452 | 16602 | 331602 | 34058 | | PRR5 | 186654 | 492475 | 16678 | N/A | |
| PRKCD | 163932 | 477794 | 16603 | N/A | | | PRR5 | 186654 | 006251 | 16679 | 006251 | 34107 |
| PRKCD | 163932 | 487897 | 16604 | 418106 | 34059 | 50 | PRR5 | 186654 | 459857 | 16680 | N/A | |
| PRKCD | 163932 | 464818 | 16605 | 419629 | 34060 | | PRR5 | 186654 | 403581 | 16681 | 384848 | 34108 |
| PRKCG | 126583 | 479081 | 16606 | 471544 | 34061 | | PRR5 | 186654 | 492289 | 16682 | N/A | |
| PRKCG | 126583 | 474397 | 16607 | 471271 | 34062 | | PRR5 | 186654 | 336983 | 16683 | 337464 | 34109 |
| PRKCG | 126583 | 263431 | 16608 | 263431 | 34063 | | PRR5 | 186654 | 403696 | 16684 | 384746 | 34110 |
| PRKCG | 126583 | 419486 | 16609 | 387919 | 34064 | | PRR5 | 186654 | 457960 | 16685 | 410215 | 34111 |
| PRKCQ | 065675 | 539722 | 16610 | 441752 | 34065 | 55 | PRR5 | 186654 | 431834 | 16686 | 407637 | 34112 |
| PRKCQ | 065675 | 263125 | 16611 | 263125 | 34066 | | PRR5 | 186654 | 432916 | 16687 | 392026 | 34113 |
| PRKCQ | 065675 | 610727 | 16612 | 483428 | 34067 | | PRR5 | 186654 | 477331 | 16688 | N/A | |
| PRKCQ | 065675 | 397176 | 16613 | 380361 | 34068 | | PRR5 | 186654 | 455389 | 16689 | N/A | |
| PRKD3 | 115825 | 379066 | 16614 | 368356 | 34069 | | PRR5 | 186654 | 495017 | 16690 | N/A | |
| PRKD3 | 115825 | 469275 | 16615 | N/A | | | PRR5 | 186654 | 475850 | 16691 | N/A | |
| PRKD3 | 115825 | 452104 | 16616 | 399540 | 34070 | 60 | PRR5 | 186654 | 611394 | 16692 | 480357 | 34114 |
| PRKD3 | 115825 | 443977 | 16617 | 398743 | 34071 | | PRR5 | 186654 | 624862 | 16693 | 485597 | 34115 |
| PRKD3 | 115825 | 494667 | 16618 | N/A | | | PRR5 | 186654 | 617066 | 16694 | 479623 | 34116 |
| PRKD3 | 115825 | 475912 | 16619 | N/A | | | PRR5L | 135362 | 531269 | 16695 | N/A | |
| PRKD3 | 115825 | 443187 | 16620 | 401839 | 34072 | | PRR5L | 135362 | 529034 | 16696 | N/A | |
| PRKD3 | 115825 | 464552 | 16621 | N/A | | | PRR5L | 135362 | 530639 | 16697 | 435050 | 34117 |
| PRKD3 | 115825 | 477132 | 16622 | N/A | | 65 | PRR5L | 135362 | 527172 | 16698 | 433708 | 34118 |
| PRKD3 | 115825 | 234179 | 16623 | 234179 | 34073 | | PRR5L | 135362 | 532121 | 16699 | 433893 | 34119 |

-continued

| Symbol | ENSG | ENST | SEQ ID | ENSP | SEQ ID |
|---|---|---|---|---|---|
| PRR5L | 135362 | 526728 | 16700 | 431610 | 34120 |
| PRR5L | 135362 | 378867 | 16701 | 368144 | 34121 |
| PRR5L | 135362 | 389693 | 16702 | N/A | |
| PRR5L | 135362 | 524380 | 16703 | 433305 | 34122 |
| PRR5L | 135362 | 526682 | 16704 | 436485 | 34123 |
| PRR5L | 135362 | 532843 | 16705 | N/A | |
| PRR5L | 135362 | 527751 | 16706 | N/A | |
| PRR5L | 135362 | 530252 | 16707 | 431475 | 34124 |
| PRR5L | 135362 | 532578 | 16708 | N/A | |
| PRR5L | 135362 | 530050 | 16709 | 432203 | 34125 |
| PRR5L | 135362 | 526679 | 16710 | 436402 | 34126 |
| PRR5L | 135362 | 527487 | 16711 | 435241 | 34127 |
| PRR5L | 135362 | 525672 | 16712 | N/A | |
| PRR5L | 135362 | 529020 | 16713 | N/A | |
| PRR5L | 135362 | 530627 | 16714 | N/A | |
| PRRC1 | 164244 | 296666 | 16715 | 296666 | 34128 |
| PRRC1 | 164244 | 512871 | 16716 | N/A | |
| PRRC1 | 164244 | 442138 | 16717 | 392873 | 34129 |
| PRRC1 | 164244 | 512635 | 16718 | 421965 | 34130 |
| PRRC1 | 164244 | 507774 | 16719 | N/A | |
| PRRC1 | 164244 | 513427 | 16720 | N/A | |
| PRRG3 | 130032 | 448726 | 16721 | 411509 | 34131 |
| PRRG3 | 130032 | 370354 | 16722 | 359379 | 34132 |
| PRRG3 | 130032 | 370353 | 16723 | 359378 | 34133 |
| PRRG3 | 130032 | 448324 | 16724 | 394121 | 34134 |
| PRRG3 | 130032 | 538575 | 16725 | 440217 | 34135 |
| PRRT2 | 167371 | 568516 | 16726 | N/A | |
| PRRT2 | 167371 | 637596 | 16727 | 489805 | 34136 |
| PRRT2 | 167371 | 562148 | 16728 | 454634 | 34137 |
| PRRT2 | 167371 | 637542 | 16729 | N/A | |
| PRRT2 | 167371 | 636001 | 16730 | N/A | |
| PRRT2 | 167371 | 358758 | 16731 | 351608 | 34138 |
| PRRT2 | 167371 | 636131 | 16732 | 490390 | 34139 |
| PRRT2 | 167371 | 567551 | 16733 | 489813 | 34140 |
| PRRT2 | 167371 | 637290 | 16734 | 490278 | 34141 |
| PRRT2 | 167371 | 567659 | 16735 | 456226 | 34142 |
| PRRT2 | 167371 | 637565 | 16736 | 490207 | 34143 |
| PRRT2 | 167371 | 636619 | 16737 | 489669 | 34144 |
| PRRT2 | 167371 | 636019 | 16738 | N/A | |
| PRRT2 | 167371 | 300797 | 16739 | 300797 | 34145 |
| PRRT2 | 167371 | 637403 | 16740 | 489782 | 34146 |
| PRRT2 | 167371 | 572820 | 16741 | 458291 | 34147 |
| PRRT2 | 167371 | 637064 | 16742 | 490826 | 34148 |
| PRRT2 | 167371 | 636246 | 16743 | 489948 | 34149 |
| PRRT2 | 167371 | 636902 | 16744 | 489935 | 34150 |
| PRRT2 | 167371 | 637425 | 16745 | N/A | |
| PRRT4 | 224940 | 489835 | 16746 | 419296 | 34151 |
| PRRT4 | 224940 | 480290 | 16747 | 417878 | 34152 |
| PRRT4 | 224940 | 489517 | 16748 | 419282 | 34153 |
| PRRT4 | 224940 | 464607 | 16749 | 420155 | 34154 |
| PRRT4 | 224940 | 495931 | 16750 | 419221 | 34155 |
| PRRT4 | 224940 | 535159 | 16751 | 445239 | 34156 |
| PRRT4 | 224940 | 446477 | 16752 | 415026 | 34157 |
| PRRX1 | 116132 | 553786 | 16753 | N/A | |
| PRRX1 | 116132 | 367760 | 16754 | 356734 | 34158 |
| PRRX1 | 116132 | 239461 | 16755 | 239461 | 34159 |
| PRRX1 | 116132 | 497230 | 16756 | 450762 | 34160 |
| PRRX1 | 116132 | 476867 | 16757 | N/A | |
| PRRX1 | 116132 | 495280 | 16758 | N/A | |
| PRRX1 | 116132 | 485529 | 16759 | N/A | |
| PRRX1 | 116132 | 496573 | 16760 | N/A | |
| PRSS55 | 184647 | 328655 | 16761 | 333003 | 34161 |
| PRSS55 | 184647 | 522210 | 16762 | 430459 | 34162 |
| PRSS55 | 184647 | 518641 | 16763 | 429376 | 34163 |
| PSD2 | 146005 | 274710 | 16764 | 274710 | 34164 |
| PSRC1 | 134222 | 369904 | 16765 | 358920 | 34165 |
| PSRC1 | 134222 | 409267 | 16766 | 386323 | 34166 |
| PSRC1 | 134222 | 369907 | 16767 | 358923 | 34167 |
| PSRC1 | 134222 | 409138 | 16768 | 474667 | 34168 |
| PSRC1 | 134222 | 492431 | 16769 | N/A | |
| PSRC1 | 134222 | 369903 | 16770 | 358919 | 34169 |
| PSRC1 | 134222 | 474126 | 16771 | 474682 | 34170 |
| PSRC1 | 134222 | 429031 | 16772 | 387791 | 34171 |
| PSRC1 | 134222 | 418914 | 16773 | 413186 | 34172 |
| PSRC1 | 134222 | 459765 | 16774 | N/A | |
| PSRC1 | 134222 | 471740 | 16775 | N/A | |

-continued

| Symbol | ENSG | ENST | SEQ ID | ENSP | SEQ ID |
|---|---|---|---|---|---|
| PSRC1 | 134222 | 369909 | 16776 | 358925 | 34173 |
| PSTPIP2 | 152229 | 589328 | 16777 | 468622 | 34174 |
| PSTPIP2 | 152229 | 409746 | 16778 | 387261 | 34175 |
| PSTPIP2 | 152229 | 588801 | 16779 | N/A | |
| PSTPIP2 | 152229 | 593086 | 16780 | N/A | |
| PSTPIP2 | 152229 | 591729 | 16781 | N/A | |
| PSTPIP2 | 152229 | 587042 | 16782 | N/A | |
| PTCH2 | 117425 | 438067 | 16783 | 413169 | 34176 |
| PTCH2 | 117425 | 372192 | 16784 | 361266 | 34177 |
| PTCH2 | 117425 | 447098 | 16785 | 389703 | 34178 |
| PTCHD1 | 165186 | 379361 | 16786 | 368666 | 34179 |
| PTCHD1 | 165186 | 456522 | 16787 | 406663 | 34180 |
| PTCHD4 | 244694 | 339488 | 16788 | 341914 | 34181 |
| PTCHD4 | 244694 | 398738 | 16789 | 381722 | 34182 |
| PTER | 165983 | 535784 | 16790 | 439485 | 34183 |
| PTER | 165983 | 378000 | 16791 | 367239 | 34184 |
| PTER | 165983 | 485788 | 16792 | N/A | |
| PTER | 165983 | 423462 | 16793 | 389535 | 34185 |
| PTER | 165983 | 298942 | 16794 | 298942 | 34186 |
| PTGES3 | 110958 | 537473 | 16795 | N/A | |
| PTGES3 | 110958 | 262033 | 16796 | 262033 | 34187 |
| PTGES3 | 110958 | 414274 | 16797 | 405299 | 34188 |
| PTGES3 | 110958 | 436399 | 16798 | 402385 | 34189 |
| PTGES3 | 110958 | 448157 | 16799 | 414892 | 34190 |
| PTGES3 | 110958 | 456859 | 16800 | 389090 | 34191 |
| PTGES3 | 110958 | 614328 | 16801 | 482075 | 34192 |
| PTGFRN | 134247 | 393203 | 16802 | 376899 | 34193 |
| PTGFRN | 134247 | 496699 | 16803 | N/A | |
| PTGFRN | 134247 | 497385 | 16804 | N/A | |
| PTK2B | 120899 | 397501 | 16805 | 380638 | 34194 |
| PTK2B | 120899 | 519650 | 16806 | N/A | |
| PTK2B | 120899 | 522338 | 16807 | 429694 | 34195 |
| PTK2B | 120899 | 521164 | 16808 | 430404 | 34196 |
| PTK2B | 120899 | 346049 | 16809 | 332816 | 34197 |
| PTK2B | 120899 | 522517 | 16810 | 428271 | 34198 |
| PTK2B | 120899 | 412793 | 16811 | 416174 | 34199 |
| PTK2B | 120899 | 496920 | 16812 | N/A | |
| PTK2B | 120899 | 517339 | 16813 | 427931 | 34200 |
| PTK2B | 120899 | 521000 | 16814 | N/A | |
| PTK2B | 120899 | 519512 | 16815 | 428837 | 34201 |
| PTK2B | 120899 | 397497 | 16816 | N/A | |
| PTK2B | 120899 | 461615 | 16817 | N/A | |
| PTK2B | 120899 | 495097 | 16818 | N/A | |
| PTK2B | 120899 | 482543 | 16819 | N/A | |
| PTK2B | 120899 | 522245 | 16820 | N/A | |
| PTK2B | 120899 | 420218 | 16821 | 391995 | 34202 |
| PTK7 | 112655 | 230419 | 16822 | 230419 | 34203 |
| PTK7 | 112655 | 476760 | 16823 | 417607 | 34204 |
| PTK7 | 112655 | 470019 | 16824 | 420322 | 34205 |
| PTK7 | 112655 | 471863 | 16825 | 419037 | 34206 |
| PTK7 | 112655 | 349241 | 16826 | 325462 | 34207 |
| PTK7 | 112655 | 352931 | 16827 | 326029 | 34208 |
| PTK7 | 112655 | 345201 | 16828 | 325992 | 34209 |
| PTK7 | 112655 | 230418 | 16829 | 230418 | 34210 |
| PTK7 | 112655 | 487673 | 16830 | N/A | |
| PTK7 | 112655 | 481273 | 16831 | 418754 | 34211 |
| PTK7 | 112655 | 481946 | 16832 | 420165 | 34212 |
| PTK7 | 112655 | 490710 | 16833 | N/A | |
| PTK7 | 112655 | 489707 | 16834 | 420765 | 34213 |
| PTK7 | 112655 | 470471 | 16835 | N/A | |
| PTK7 | 112655 | 493339 | 16836 | N/A | |
| PTK7 | 112655 | 461100 | 16837 | 418545 | 34214 |
| PTK7 | 112655 | 494146 | 16838 | 419096 | 34215 |
| PTK7 | 112655 | 497957 | 16839 | 418462 | 34216 |
| PTK7 | 112655 | 473339 | 16840 | 420186 | 34217 |
| PTK7 | 112655 | 461389 | 16841 | 418386 | 34218 |
| PTMS | 159335 | 540667 | 16842 | N/A | |
| PTMS | 159335 | 389462 | 16843 | 374113 | 34219 |
| PTMS | 159335 | 540874 | 16844 | 442325 | 34220 |
| PTMS | 159335 | 309043 | 16845 | 310088 | 34221 |
| PTMS | 159335 | 540828 | 16846 | N/A | |
| PTMS | 159335 | 538057 | 16847 | N/A | |
| PTMS | 159335 | 619580 | 16848 | 478828 | 34222 |
| PTN | 105894 | 348225 | 16849 | 341170 | 34223 |
| PTN | 105894 | 393083 | 16850 | 376798 | 34224 |
| PTP4A1 | 112245 | 639568 | 16851 | N/A | |

| Symbol | ENSG | ENST | SEQ ID | ENSP | SEQ ID |
|---|---|---|---|---|---|
| PTP4A1 | 112245 | 470661 | 16852 | N/A | |
| PTP4A1 | 112245 | 370651 | 16853 | 359685 | 34225 |
| PTP4A1 | 112245 | 578299 | 16854 | 462406 | 34226 |
| PTP4A1 | 112245 | 473334 | 16855 | N/A | |
| PTP4A1 | 112245 | 626021 | 16856 | 485687 | 34227 |
| PTP4A1 | 112245 | 627002 | 16857 | 487586 | 34228 |
| PTP4A3 | 275575 | 633518 | 16858 | 487595 | 34229 |
| PTP4A3 | 275575 | 633621 | 16859 | 487610 | 34230 |
| PTP4A3 | 275575 | 633262 | 16860 | 487861 | 34231 |
| PTP4A3 | 275575 | 633366 | 16861 | N/A | |
| PTP4A3 | 275575 | 634147 | 16862 | N/A | |
| PTP4A3 | 275575 | 632997 | 16863 | N/A | |
| PTP4A3 | 275575 | 633470 | 16864 | N/A | |
| PTP4A3 | 275575 | 632834 | 16865 | N/A | |
| PTP4A3 | 275575 | 633677 | 16866 | N/A | |
| PTP4A3 | 275575 | 614325 | 16867 | 481205 | 34232 |
| PTP4A3 | 275575 | 622569 | 16868 | 484500 | 34233 |
| PTP4A3 | 184489 | 521578 | 16869 | 428976 | 34234 |
| PTP4A3 | 184489 | 520105 | 16870 | 428758 | 34235 |
| PTP4A3 | 184489 | 523147 | 16871 | 428725 | 34236 |
| PTP4A3 | 184489 | 524028 | 16872 | 430332 | 34237 |
| PTP4A3 | 184489 | 329397 | 16873 | 332274 | 34238 |
| PTP4A3 | 184489 | 349124 | 16874 | 331730 | 34239 |
| PTPN14 | 152104 | 366956 | 16875 | 355923 | 34240 |
| PTPN14 | 152104 | 473261 | 16876 | N/A | |
| PTPN14 | 152104 | 486173 | 16877 | N/A | |
| PTPN14 | 152104 | 491277 | 16878 | N/A | |
| PTPN14 | 152104 | 543945 | 16879 | 443330 | 34241 |
| PTPN22 | 134242 | 460620 | 16880 | 433141 | 34242 |
| PTPN22 | 134242 | 359785 | 16881 | 352833 | 34243 |
| PTPN22 | 134242 | 528414 | 16882 | 435176 | 34244 |
| PTPN22 | 134242 | 469077 | 16883 | N/A | |
| PTPN22 | 134242 | 532224 | 16884 | 431249 | 34245 |
| PTPN22 | 134242 | 420377 | 16885 | 388229 | 34246 |
| PTPN22 | 134242 | 525799 | 16886 | 432674 | 34247 |
| PTPN22 | 134242 | 484147 | 16887 | N/A | |
| PTPN22 | 134242 | 534519 | 16888 | N/A | |
| PTPN22 | 134242 | 529045 | 16889 | 434932 | 34248 |
| PTPN22 | 134242 | 538253 | 16890 | 439372 | 34249 |
| PTPN3 | 070159 | 447271 | 16891 | N/A | |
| PTPN3 | 070159 | 374541 | 16892 | 363667 | 34250 |
| PTPN3 | 070159 | 497739 | 16893 | N/A | |
| PTPN3 | 070159 | 412145 | 16894 | 416654 | 34251 |
| PTPN3 | 070159 | 446349 | 16895 | 395384 | 34252 |
| PTPN3 | 070159 | 262539 | 16896 | 262539 | 34253 |
| PTPN5 | 110786 | 477854 | 16897 | 435056 | 34254 |
| PTPN5 | 110786 | 358540 | 16898 | 351342 | 34255 |
| PTPN5 | 110786 | 396166 | 16899 | 379469 | 34256 |
| PTPN5 | 110786 | 396170 | 16900 | 379473 | 34257 |
| PTPN5 | 110786 | 396168 | 16901 | 379471 | 34258 |
| PTPN5 | 110786 | 496201 | 16902 | N/A | |
| PTPRB | 127329 | 334414 | 16903 | 334928 | 34259 |
| PTPRB | 127329 | 550358 | 16904 | 448058 | 34260 |
| PTPRB | 127329 | 538708 | 16905 | 438927 | 34261 |
| PTPRB | 127329 | 550857 | 16906 | 447302 | 34262 |
| PTPRB | 127329 | 261266 | 16907 | 261266 | 34263 |
| PTPRB | 127329 | 549400 | 16908 | N/A | |
| PTPRB | 127329 | 551525 | 16909 | 448349 | 34264 |
| PTPRB | 127329 | 548122 | 16910 | 446982 | 34265 |
| PTPRB | 127329 | 538174 | 16911 | N/A | |
| PTPRB | 127329 | 552253 | 16912 | N/A | |
| PTPRB | 127329 | 547715 | 16913 | 446934 | 34266 |
| PTPRE | 132334 | 254667 | 16914 | 254667 | 34267 |
| PTPRE | 132334 | 442830 | 16915 | 410540 | 34268 |
| PTPRE | 132334 | 471218 | 16916 | 474102 | 34269 |
| PTPRE | 132334 | 455661 | 16917 | 416939 | 34270 |
| PTPRE | 132334 | 467366 | 16918 | 474830 | 34271 |
| PTPRE | 132334 | 306042 | 16919 | 303350 | 34272 |
| PTPRE | 132334 | 487428 | 16920 | N/A | |
| PTPRE | 132334 | 495530 | 16921 | 475063 | 34273 |
| PTPRE | 132334 | 479896 | 16922 | 473761 | 34274 |
| PTPRE | 132334 | 492479 | 16923 | N/A | |
| PTPRE | 132334 | 463727 | 16924 | N/A | |
| PTPRJ | 149177 | 418331 | 16925 | 400010 | 34275 |
| PTPRJ | 149177 | 440289 | 16926 | 409733 | 34276 |
| PTPRJ | 149177 | 534219 | 16927 | 432686 | 34277 |

| Symbol | ENSG | ENST | SEQ ID | ENSP | SEQ ID |
|---|---|---|---|---|---|
| PTPRJ | 149177 | 527952 | 16928 | 435618 | 34278 |
| PTPRJ | 149177 | 526550 | 16929 | N/A | |
| PTPRJ | 149177 | 527026 | 16930 | N/A | |
| PTPRJ | 149177 | 613246 | 16931 | 477933 | 34279 |
| PTPRJ | 149177 | 615445 | 16932 | 479342 | 34280 |
| PTPRK | 152894 | 368230 | 16933 | 357209 | 34281 |
| PTPRK | 152894 | 532331 | 16934 | 432973 | 34282 |
| PTPRK | 152894 | 368213 | 16935 | 357196 | 34283 |
| PTPRK | 152894 | 368210 | 16936 | 357193 | 34284 |
| PTPRK | 152894 | 368215 | 16937 | 357198 | 34285 |
| PTPRK | 152894 | 368207 | 16938 | 357190 | 34286 |
| PTPRK | 152894 | 415046 | 16939 | 406825 | 34287 |
| PTPRK | 152894 | 415055 | 16940 | 408180 | 34288 |
| PTPRK | 152894 | 531050 | 16941 | 432960 | 34289 |
| PTPRK | 152894 | 524481 | 16942 | N/A | |
| PTPRK | 152894 | 531466 | 16943 | N/A | |
| PTPRK | 152894 | 434424 | 16944 | N/A | |
| PTPRK | 152894 | 524534 | 16945 | N/A | |
| PTPRK | 152894 | 368205 | 16946 | N/A | |
| PTPRK | 152894 | 490332 | 16947 | 434058 | 34290 |
| PTPRK | 152894 | 498284 | 16948 | N/A | |
| PTPRK | 152894 | 495748 | 16949 | N/A | |
| PTPRK | 152894 | 429595 | 16950 | N/A | |
| PTPRK | 152894 | 525459 | 16951 | 434116 | 34291 |
| PTPRK | 152894 | 392449 | 16952 | 376243 | 34292 |
| PTPRK | 152894 | 532751 | 16953 | 437299 | 34293 |
| PTPRK | 152894 | 368202 | 16954 | N/A | |
| PTPRK | 273993 | 618924 | 16955 | 483766 | 34294 |
| PTPRK | 273993 | 619256 | 16956 | 477791 | 34295 |
| PTPRK | 273993 | 618215 | 16957 | 484742 | 34296 |
| PTPRK | 273993 | 625760 | 16958 | 487066 | 34297 |
| PTPRK | 273993 | 628183 | 16959 | 486442 | 34298 |
| PTPRK | 273993 | 626594 | 16960 | 487005 | 34299 |
| PTPRK | 273993 | 625615 | 16961 | 485812 | 34300 |
| PTPRK | 273993 | 625418 | 16962 | 487578 | 34301 |
| PTPRK | 273993 | 628245 | 16963 | 486036 | 34302 |
| PTPRK | 273993 | 626859 | 16964 | N/A | |
| PTPRK | 273993 | 628763 | 16965 | N/A | |
| PTPRK | 273993 | 631016 | 16966 | N/A | |
| PTPRK | 273993 | 629317 | 16967 | N/A | |
| PTPRK | 273993 | 627900 | 16968 | N/A | |
| PTPRK | 273993 | 628824 | 16969 | 487445 | 34303 |
| PTPRK | 273993 | 627390 | 16970 | N/A | |
| PTPRK | 273993 | 627786 | 16971 | N/A | |
| PTPRK | 273993 | 629834 | 16972 | N/A | |
| PTPRK | 273993 | 628472 | 16973 | 486448 | 34304 |
| PTPRK | 273993 | 621720 | 16974 | 482183 | 34305 |
| PTPRK | 273993 | 627768 | 16975 | 485893 | 34306 |
| PTPRK | 273993 | 625700 | 16976 | N/A | |
| PTPRM | 173482 | 580170 | 16977 | 463325 | 34307 |
| PTPRM | 173482 | 332175 | 16978 | 331418 | 34308 |
| PTPRM | 173482 | 400053 | 16979 | 382927 | 34309 |
| PTPRM | 173482 | 578916 | 16980 | 463558 | 34310 |
| PTPRM | 173482 | 578600 | 16981 | N/A | |
| PTPRM | 173482 | 578571 | 16982 | N/A | |
| PTPRM | 173482 | 578698 | 16983 | N/A | |
| PTPRM | 173482 | 583289 | 16984 | 462176 | 34311 |
| PTPRM | 173482 | 577468 | 16985 | 464128 | 34312 |
| PTPRM | 173482 | 577827 | 16986 | N/A | |
| PTPRM | 173482 | 578093 | 16987 | N/A | |
| PTPRM | 173482 | 580838 | 16988 | N/A | |
| PTPRM | 173482 | 583153 | 16989 | 462809 | 34313 |
| PTPRM | 173482 | 580949 | 16990 | N/A | |
| PTPRM | 173482 | 400060 | 16991 | 382933 | 34314 |
| PTPRN | 054356 | 409251 | 16992 | 386638 | 34315 |
| PTPRN | 054356 | 295718 | 16993 | 295718 | 34316 |
| PTPRN | 054356 | 460801 | 16994 | N/A | |
| PTPRN | 054356 | 462351 | 16995 | N/A | |
| PTPRN | 054356 | 443981 | 16996 | 396842 | 34317 |
| PTPRN | 054356 | 423636 | 16997 | 392598 | 34318 |
| PTPRN | 054356 | 497977 | 16998 | N/A | |
| PTPRN | 054356 | 486480 | 16999 | N/A | |
| PTPRN | 054356 | 489650 | 17000 | N/A | |
| PTPRN | 054356 | 412847 | 17001 | 388429 | 34319 |
| PTPRN | 054356 | 446182 | 17002 | 395379 | 34320 |
| PTPRN | 054356 | 440552 | 17003 | 408036 | 34321 |

| Symbol | ENSG | ENST | SEQ ID | ENSP | SEQ ID |
|---|---|---|---|---|---|
| PTPRN | 054356 | 476930 | 17004 | N/A | |
| PTPRN | 054356 | 442029 | 17005 | 396464 | 34322 |
| PTPRN | 054356 | 451506 | 17006 | 397105 | 34323 |
| PTPRN | 054356 | 606213 | 17007 | 475591 | 34324 |
| PTPRN | 054356 | 468454 | 17008 | N/A | |
| PTPRN | 054356 | 484986 | 17009 | N/A | |
| PTPRN | 054356 | 477819 | 17010 | N/A | |
| PTPRO | 151490 | 281171 | 17011 | 281171 | 34325 |
| PTPRO | 151490 | 543886 | 17012 | 444173 | 34326 |
| PTPRO | 151490 | 348962 | 17013 | 343434 | 34327 |
| PTPRO | 151490 | 545023 | 17014 | N/A | |
| PTPRO | 151490 | 442921 | 17015 | 404188 | 34328 |
| PTPRO | 151490 | 542557 | 17016 | 437571 | 34329 |
| PTPRO | 151490 | 445537 | 17017 | 393449 | 34330 |
| PTPRO | 151490 | 544244 | 17018 | 439234 | 34331 |
| PTPRO | 151490 | 535311 | 17019 | 445621 | 34332 |
| PTPRO | 151490 | 538907 | 17020 | N/A | |
| PTPRO | 151490 | 535322 | 17021 | 446201 | 34333 |
| PTPRO | 151490 | 544706 | 17022 | N/A | |
| PTPRR | 153233 | 440835 | 17023 | 391750 | 34334 |
| PTPRR | 153233 | 537619 | 17024 | N/A | |
| PTPRR | 153233 | 551219 | 17025 | 448049 | 34335 |
| PTPRR | 153233 | 547752 | 17026 | N/A | |
| PTPRR | 153233 | 283228 | 17027 | 283228 | 34336 |
| PTPRR | 153233 | 342084 | 17028 | 339605 | 34337 |
| PTPRR | 153233 | 549308 | 17029 | 446943 | 34338 |
| PTPRR | 153233 | 549107 | 17030 | N/A | |
| PTPRR | 153233 | 548220 | 17031 | N/A | |
| PTPRR | 153233 | 550661 | 17032 | 449616 | 34339 |
| PTPRR | 153233 | 378778 | 17033 | 368054 | 34340 |
| PTPRT | 196090 | 373187 | 17034 | 362283 | 34341 |
| PTPRT | 196090 | 356100 | 17035 | 348408 | 34342 |
| PTPRT | 196090 | 373184 | 17036 | 362280 | 34343 |
| PTPRT | 196090 | 373190 | 17037 | 362286 | 34344 |
| PTPRT | 196090 | 373198 | 17038 | 362294 | 34345 |
| PTPRT | 196090 | 373201 | 17039 | 362297 | 34346 |
| PTPRT | 196090 | 373193 | 17040 | 362289 | 34347 |
| PTPRT | 196090 | 617474 | 17041 | 484248 | 34348 |
| PTPRT | 196090 | 485499 | 17042 | N/A | |
| PTPRT | 196090 | 620410 | 17043 | 480136 | 34349 |
| PTPRT | 196090 | 618610 | 17044 | 484524 | 34350 |
| PTPRT | 196090 | 612229 | 17045 | 481466 | 34351 |
| PTPRZ1 | 106278 | 393386 | 17046 | 377047 | 34352 |
| PTPRZ1 | 106278 | 471837 | 17047 | N/A | |
| PTPRZ1 | 106278 | 449182 | 17048 | 410000 | 34353 |
| PTPRZ1 | 106278 | 483028 | 17049 | N/A | |
| PTPRZ1 | 106278 | 489114 | 17050 | N/A | |
| PTPRZ1 | 106278 | 483995 | 17051 | N/A | |
| PTPRZ1 | 106278 | 468641 | 17052 | N/A | |
| PTPRZ1 | 106278 | 470504 | 17053 | N/A | |
| PTPRZ1 | 106278 | 474500 | 17054 | N/A | |
| PTTG1 | 164611 | 393964 | 17055 | 377536 | 34354 |
| PTTG1 | 164611 | 519287 | 17056 | N/A | |
| PTTG1 | 164611 | 520452 | 17057 | 430642 | 34355 |
| PTTG1 | 164611 | 523659 | 17058 | N/A | |
| PTTG1 | 164611 | 517480 | 17059 | 431068 | 34356 |
| PTTG1 | 164611 | 352433 | 17060 | 344936 | 34357 |
| PTTG1 | 164611 | 524244 | 17061 | N/A | |
| PUDP | 130021 | 381077 | 17062 | 370467 | 34358 |
| PUDP | 130021 | 412827 | 17063 | 406260 | 34359 |
| PUDP | 130021 | 424830 | 17064 | 396452 | 34360 |
| PUDP | 130021 | 486446 | 17065 | 430995 | 34361 |
| PUDP | 130021 | 498474 | 17066 | N/A | |
| PUDP | 130021 | 540122 | 17067 | 441208 | 34362 |
| PURB | 146676 | 395699 | 17068 | 379051 | 34363 |
| PVALB | 274665 | 630974 | 17069 | 485850 | 34364 |
| PVALB | 274665 | 628536 | 17070 | N/A | |
| PVALB | 274665 | 628345 | 17071 | 487336 | 34365 |
| PVALB | 274665 | 625893 | 17072 | 486144 | 34366 |
| PVALB | 274665 | 620986 | 17073 | 480913 | 34367 |
| PVALB | 274665 | 627445 | 17074 | 487426 | 34368 |
| PVALB | 100362 | 417718 | 17075 | 400247 | 34369 |
| PVALB | 100362 | 216200 | 17076 | 216200 | 34370 |
| PVALB | 100362 | 406910 | 17077 | 384735 | 34371 |
| PVALB | 100362 | 404171 | 17078 | 386089 | 34372 |
| PVALB | 100362 | 467935 | 17079 | N/A | |

| Symbol | ENSG | ENST | SEQ ID | ENSP | SEQ ID |
|---|---|---|---|---|---|
| PVALB | 100362 | 443735 | 17080 | 406977 | 34373 |
| PXDC1 | 168994 | 477592 | 17081 | N/A | |
| PXDC1 | 168994 | 380277 | 17082 | 369630 | 34374 |
| PXDC1 | 168994 | 380283 | 17083 | 369636 | 34375 |
| PXDC1 | 168994 | 485986 | 17084 | N/A | |
| PXDN | 130508 | 252804 | 17085 | 252804 | 34376 |
| PXDN | 130508 | 493654 | 17086 | N/A | |
| PXDN | 130508 | 478155 | 17087 | N/A | |
| PXDN | 130508 | 453308 | 17088 | 414098 | 34377 |
| PXDN | 130508 | 477093 | 17089 | N/A | |
| PXDN | 130508 | 493779 | 17090 | N/A | |
| PXDN | 130508 | 465809 | 17091 | N/A | |
| PXDN | 130508 | 433670 | 17092 | 402738 | 34378 |
| PXDN | 130508 | 467191 | 17093 | N/A | |
| PXDN | 130508 | 483018 | 17094 | N/A | |
| PXDN | 130508 | 477810 | 17095 | N/A | |
| PXDN | 130508 | 447941 | 17096 | 408701 | 34379 |
| PXDN | 130508 | 425171 | 17097 | 398363 | 34380 |
| PXDN | 130508 | 485177 | 17098 | N/A | |
| PXDNL | 147485 | 522628 | 17099 | 429855 | 34381 |
| PXDNL | 147485 | 522933 | 17100 | 428114 | 34382 |
| PXDNL | 147485 | 356297 | 17101 | 348645 | 34383 |
| PXDNL | 147485 | 519183 | 17102 | N/A | |
| PXK | 168297 | 356151 | 17103 | 348472 | 34384 |
| PXK | 168297 | 468776 | 17104 | 417167 | 34385 |
| PXK | 168297 | 463280 | 17105 | 417903 | 34386 |
| PXK | 168297 | 383715 | 17106 | 373221 | 34387 |
| PXK | 168297 | 484288 | 17107 | 417915 | 34388 |
| PXK | 168297 | 479241 | 17108 | 419049 | 34389 |
| PXK | 168297 | 477308 | 17109 | 420103 | 34390 |
| PXK | 168297 | 491164 | 17110 | 418831 | 34391 |
| PXK | 168297 | 479134 | 17111 | 418202 | 34392 |
| PXK | 168297 | 459676 | 17112 | 476179 | 34393 |
| PXK | 168297 | 495557 | 17113 | 418376 | 34394 |
| PXK | 168297 | 493474 | 17114 | 418836 | 34395 |
| PXK | 168297 | 383716 | 17115 | 373222 | 34396 |
| PXK | 168297 | 302779 | 17116 | 305045 | 34397 |
| PXN | 089159 | 458477 | 17117 | 395536 | 34398 |
| PXN | 089159 | 228307 | 17118 | 228307 | 34399 |
| PXN | 089159 | 424649 | 17119 | 391283 | 34400 |
| PXN | 089159 | 637624 | 17120 | 490896 | 34401 |
| PXN | 089159 | 536957 | 17121 | 443887 | 34402 |
| PXN | 089159 | 323871 | 17122 | 489977 | 34403 |
| PXN | 089159 | 538144 | 17123 | N/A | |
| PXN | 089159 | 637617 | 17124 | 489840 | 34404 |
| PXN | 089159 | 550795 | 17125 | N/A | |
| PXN | 089159 | 637386 | 17126 | 490352 | 34405 |
| PXN | 089159 | 547983 | 17127 | 446893 | 34406 |
| PXN | 089159 | 551327 | 17128 | N/A | |
| PXN | 089159 | 543331 | 17129 | 443745 | 34407 |
| PXN | 089159 | 546532 | 17130 | 447180 | 34408 |
| PXN | 089159 | 548912 | 17131 | 446607 | 34409 |
| PXN | 089159 | 552550 | 17132 | 446650 | 34410 |
| PXN | 089159 | 440827 | 17133 | N/A | |
| PXN | 089159 | 547746 | 17134 | N/A | |
| PXN | 089159 | 540221 | 17135 | N/A | |
| PXN | 089159 | 550205 | 17136 | N/A | |
| PXN | 089159 | 547772 | 17137 | N/A | |
| PXN | 089159 | 267257 | 17138 | 267257 | 34411 |
| PXYLP1 | 155893 | 505013 | 17139 | 421271 | 34412 |
| PXYLP1 | 155893 | 636601 | 17140 | 490861 | 34413 |
| PXYLP1 | 155893 | 514880 | 17141 | 425264 | 34414 |
| PXYLP1 | 155893 | 286353 | 17142 | 286353 | 34415 |
| PXYLP1 | 155893 | 637751 | 17143 | 490743 | 34416 |
| PXYLP1 | 155893 | 502783 | 17144 | 422558 | 34417 |
| PXYLP1 | 155893 | 393010 | 17145 | 376733 | 34418 |
| PXYLP1 | 155893 | 511968 | 17146 | N/A | |
| PXYLP1 | 155893 | 514680 | 17147 | 426956 | 34419 |
| PXYLP1 | 155893 | 513528 | 17148 | 426348 | 34420 |
| PXYLP1 | 155893 | 505502 | 17149 | N/A | |
| PXYLP1 | 155893 | 513007 | 17150 | N/A | |
| PXYLP1 | 155893 | 637579 | 17151 | 490114 | 34421 |
| PXYLP1 | 155893 | 512457 | 17152 | 423702 | 34422 |
| PXYLP1 | 155893 | 504264 | 17153 | 426877 | 34423 |
| PXYLP1 | 155893 | 508812 | 17154 | 422901 | 34424 |
| PXYLP1 | 155893 | 514263 | 17155 | N/A | |

-continued

-continued

| Symbol | ENSG | ENST | SEQ ID | ENSP | SEQ ID |
|---|---|---|---|---|---|
| PYGM | 068976 | 483742 | 17156 | N/A | |
| PYGM | 068976 | 377432 | 17157 | 366650 | 34425 |
| PYGM | 068976 | 164139 | 17158 | 164139 | 34426 |
| PYGM | 068976 | 462303 | 17159 | N/A | |
| PYGM | 068976 | 460413 | 17160 | N/A | |
| PYROXD2 | 119943 | 483923 | 17161 | N/A | |
| PYROXD2 | 119943 | 370575 | 17162 | 359607 | 34427 |
| PYROXD2 | 119943 | 464808 | 17163 | N/A | |
| PYROXD2 | 119943 | 494941 | 17164 | N/A | |
| PYROXD2 | 119943 | 462874 | 17165 | N/A | |
| QDPR | 151552 | 511609 | 17166 | N/A | |
| QDPR | 151552 | 514300 | 17167 | 426039 | 34428 |
| QDPR | 151552 | 505710 | 17168 | 420873 | 34429 |
| QDPR | 151552 | 501943 | 17169 | N/A | |
| QDPR | 151552 | 508623 | 17170 | 426377 | 34430 |
| QDPR | 151552 | 281243 | 17171 | 281243 | 34431 |
| QDPR | 151552 | 428702 | 17172 | 390944 | 34432 |
| QDPR | 151552 | 507439 | 17173 | 423227 | 34433 |
| QDPR | 151552 | 513615 | 17174 | 422759 | 34434 |
| QKI | 112531 | 361758 | 17175 | 354951 | 34435 |
| QKI | 112531 | 453779 | 17176 | 408775 | 34436 |
| QKI | 112531 | 275262 | 17177 | 275262 | 34437 |
| QKI | 112531 | 392127 | 17178 | 375973 | 34438 |
| QKI | 112531 | 361752 | 17179 | 355094 | 34439 |
| QKI | 112531 | 361195 | 17180 | 354867 | 34440 |
| QKI | 112531 | 424802 | 17181 | 408382 | 34441 |
| QKI | 112531 | 545607 | 17182 | 437867 | 34442 |
| QKI | 112531 | 544436 | 17183 | 443690 | 34443 |
| QKI | 112531 | 537041 | 17184 | 440991 | 34444 |
| QKI | 112531 | 537124 | 17185 | 443106 | 34445 |
| QKI | 112531 | 545346 | 17186 | 441252 | 34446 |
| QKI | 112531 | 544823 | 17187 | 440599 | 34447 |
| QKI | 112531 | 537883 | 17188 | 441773 | 34448 |
| QKI | 112531 | 540719 | 17189 | N/A | |
| QKI | 112531 | 544361 | 17190 | 442848 | 34449 |
| QKI | 112531 | 541696 | 17191 | N/A | |
| QKI | 112531 | 361758 | 17192 | 354951 | 34450 |
| QKI | 112531 | 453779 | 17193 | 408775 | 34451 |
| QKI | 112531 | 275262 | 17194 | 275262 | 34452 |
| QKI | 112531 | 392127 | 17195 | 375973 | 34453 |
| QKI | 112531 | 361752 | 17196 | 355094 | 34454 |
| QKI | 112531 | 361195 | 17197 | 354867 | 34455 |
| QKI | 112531 | 424802 | 17198 | 408382 | 34456 |
| QKI | 112531 | 545607 | 17199 | 437867 | 34457 |
| QKI | 112531 | 544436 | 17200 | 443690 | 34458 |
| QKI | 112531 | 537041 | 17201 | 440991 | 34459 |
| QKI | 112531 | 537124 | 17202 | 443106 | 34460 |
| QKI | 112531 | 545346 | 17203 | 441252 | 34461 |
| QKI | 112531 | 544823 | 17204 | 440599 | 34462 |
| QKI | 112531 | 537883 | 17205 | 441773 | 34463 |
| QKI | 112531 | 540719 | 17206 | N/A | |
| QKI | 112531 | 544361 | 17207 | 442848 | 34464 |
| QKI | 112531 | 541696 | 17208 | N/A | |
| QPRT | 103485 | 219771 | 17209 | N/A | |
| QPRT | 103485 | 395384 | 17210 | 378782 | 34465 |
| QPRT | 103485 | 562473 | 17211 | 455183 | 34466 |
| QPRT | 103485 | 564967 | 17212 | N/A | |
| RAB11FIP1 | 156675 | 287263 | 17213 | 287263 | 34467 |
| RAB11FIP1 | 156675 | 330843 | 17214 | 331342 | 34468 |
| RAB11FIP1 | 156675 | 522727 | 17215 | 430009 | 34469 |
| RAB11FIP1 | 156675 | 523182 | 17216 | N/A | |
| RAB11FIP1 | 156675 | 522774 | 17217 | N/A | |
| RAB11FIP1 | 156675 | 524118 | 17218 | 430680 | 34470 |
| RAB15 | 139998 | 267512 | 17219 | 267512 | 34471 |
| RAB15 | 139998 | 533601 | 17220 | 434103 | 34472 |
| RAB15 | 139998 | 585059 | 17221 | 464662 | 34473 |
| RAB15 | 139998 | 426039 | 17222 | 433485 | 34474 |
| RAB15 | 139998 | 554593 | 17223 | 452195 | 34475 |
| RAB15 | 139998 | 555256 | 17224 | N/A | |
| RAB27A | 069974 | 396307 | 17225 | 379601 | 34476 |
| RAB27A | 069974 | 561609 | 17226 | 455012 | 34477 |
| RAB27A | 069974 | 569493 | 17227 | 456059 | 34478 |
| RAB27A | 069974 | 566877 | 17228 | 454695 | 34479 |
| RAB27A | 069974 | 567380 | 17229 | 458127 | 34480 |
| RAB27A | 069974 | 565972 | 17230 | 456536 | 34481 |
| RAB27A | 069974 | 563262 | 17231 | 457595 | 34482 |

| Symbol | ENSG | ENST | SEQ ID | ENSP | SEQ ID |
|---|---|---|---|---|---|
| RAB27A | 069974 | 568803 | 17232 | 457517 | 34483 |
| RAB27A | 069974 | 567639 | 17233 | N/A | |
| RAB27A | 069974 | 565776 | 17234 | N/A | |
| RAB27A | 069974 | 561545 | 17235 | N/A | |
| RAB27A | 069974 | 336787 | 17236 | 337761 | 34484 |
| RAB27B | 041353 | 586570 | 17237 | 468542 | 34485 |
| RAB27B | 041353 | 262094 | 17238 | 262094 | 34486 |
| RAB27B | 041353 | 586594 | 17239 | N/A | |
| RAB27B | 041353 | 592334 | 17240 | 465009 | 34487 |
| RAB31 | 168461 | 578921 | 17241 | 461945 | 34488 |
| RAB31 | 168461 | 578734 | 17242 | 462164 | 34489 |
| RAB31 | 168461 | 581109 | 17243 | 464046 | 34490 |
| RAB31 | 168461 | 583137 | 17244 | 462561 | 34491 |
| RAB31 | 168461 | 435762 | 17245 | N/A | |
| RAB31 | 168461 | 578737 | 17246 | N/A | |
| RAB31 | 168461 | 583921 | 17247 | N/A | |
| RAB31 | 168461 | 580361 | 17248 | N/A | |
| RAB31 | 168461 | 577796 | 17249 | N/A | |
| RAB31 | 168461 | 577371 | 17250 | N/A | |
| RAB31 | 168461 | 580795 | 17251 | N/A | |
| RAB31 | 168461 | 577284 | 17252 | N/A | |
| RAB33A | 134594 | 257017 | 17253 | 257017 | 34492 |
| RAB34 | 109113 | 395243 | 17254 | 378664 | 34493 |
| RAB34 | 109113 | 625712 | 17255 | 487160 | 34494 |
| RAB34 | 109113 | 301043 | 17256 | 301043 | 34495 |
| RAB34 | 109113 | 450529 | 17257 | 391048 | 34496 |
| RAB34 | 109113 | 415040 | 17258 | 410279 | 34497 |
| RAB34 | 109113 | 484161 | 17259 | N/A | |
| RAB34 | 109113 | 422279 | 17260 | 397499 | 34498 |
| RAB34 | 109113 | 474704 | 17261 | N/A | |
| RAB34 | 109113 | 436730 | 17262 | 404180 | 34499 |
| RAB34 | 109113 | 430132 | 17263 | 407953 | 34500 |
| RAB34 | 109113 | 583538 | 17264 | 463488 | 34501 |
| RAB34 | 109113 | 636772 | 17265 | 489794 | 34502 |
| RAB34 | 109113 | 353676 | 17266 | 226259 | 34503 |
| RAB34 | 109113 | 412625 | 17267 | 398706 | 34504 |
| RAB34 | 109113 | 496866 | 17268 | N/A | |
| RAB34 | 109113 | 636513 | 17269 | 490855 | 34505 |
| RAB34 | 109113 | 419712 | 17270 | 464723 | 34506 |
| RAB34 | 109113 | 481501 | 17271 | N/A | |
| RAB34 | 109113 | 636154 | 17272 | 490450 | 34507 |
| RAB34 | 109113 | 636534 | 17273 | 490529 | 34508 |
| RAB34 | 109113 | 580843 | 17274 | 465352 | 34509 |
| RAB34 | 109113 | 483554 | 17275 | N/A | |
| RAB34 | 109113 | 482688 | 17276 | N/A | |
| RAB34 | 109113 | 582934 | 17277 | 476427 | 34510 |
| RAB34 | 109113 | 453384 | 17278 | 413156 | 34511 |
| RAB34 | 109113 | 395245 | 17279 | 378666 | 34512 |
| RAB37 | 172794 | 340415 | 17280 | 341354 | 34513 |
| RAB37 | 172794 | 402449 | 17281 | 383934 | 34514 |
| RAB37 | 172794 | 392617 | 17282 | N/A | |
| RAB37 | 172794 | 528438 | 17283 | 432086 | 34515 |
| RAB37 | 172794 | 392615 | 17284 | 376391 | 34516 |
| RAB37 | 172794 | 392614 | 17285 | 376390 | 34517 |
| RAB37 | 172794 | 392613 | 17286 | 376389 | 34518 |
| RAB37 | 172794 | 533530 | 17287 | N/A | |
| RAB37 | 172794 | 527040 | 17288 | N/A | |
| RAB37 | 172794 | 577548 | 17289 | N/A | |
| RAB37 | 172794 | 392612 | 17290 | 376388 | 34519 |
| RAB37 | 172794 | 392610 | 17291 | 376387 | 34520 |
| RAB37 | 172794 | 481224 | 17292 | 436563 | 34521 |
| RAB37 | 172794 | 488977 | 17293 | N/A | |
| RAB37 | 172794 | 531420 | 17294 | N/A | |
| RAB37 | 172794 | 613645 | 17295 | 483155 | 34522 |
| RAB3A | 105649 | 222256 | 17296 | 222256 | 34523 |
| RAB3A | 105649 | 464076 | 17297 | 474603 | 34524 |
| RAB3A | 105649 | 481914 | 17298 | 472335 | 34525 |
| RAB3A | 105649 | 515410 | 17299 | N/A | |
| RAB3B | 169213 | 371655 | 17300 | 360718 | 34526 |
| RAB3C | 152932 | 513316 | 17301 | N/A | |
| RAB3C | 152932 | 282878 | 17302 | 282878 | 34527 |
| RAB3C | 152932 | 507977 | 17303 | N/A | |
| RAB3C | 152932 | 381158 | 17304 | N/A | |
| RAB6B | 154917 | 285208 | 17305 | 285208 | 34528 |
| RAB6B | 154917 | 469959 | 17306 | 418540 | 34529 |
| RAB6B | 154917 | 486858 | 17307 | 419381 | 34530 |

-continued

-continued

| Symbol | ENSG | ENST | SEQ ID | ENSP | SEQ ID |
|---|---|---|---|---|---|
| RAB6B | 154917 | 477759 | 17308 | 419941 | 34531 |
| RAB6B | 154917 | 460865 | 17309 | 419526 | 34532 |
| RAB6B | 154917 | 488969 | 17310 | 417433 | 34533 |
| RAB6B | 154917 | 543906 | 17311 | 437797 | 34534 |
| RAI2 | 131831 | 415486 | 17312 | 392578 | 34535 |
| RAI2 | 131831 | 360011 | 17313 | 353106 | 34536 |
| RAI2 | 131831 | 331511 | 17314 | 333456 | 34537 |
| RAI2 | 131831 | 509491 | 17315 | 473562 | 34538 |
| RAI2 | 131831 | 451717 | 17316 | 401323 | 34539 |
| RAI2 | 131831 | 545871 | 17317 | 444210 | 34540 |
| RALGPS2 | 116191 | 495034 | 17318 | N/A | |
| RALGPS2 | 116191 | 367635 | 17319 | 356607 | 34541 |
| RALGPS2 | 116191 | 324778 | 17320 | 313613 | 34542 |
| RALGPS2 | 116191 | 477383 | 17321 | N/A | |
| RALGPS2 | 116191 | 415888 | 17322 | 405903 | 34543 |
| RALGPS2 | 116191 | 480743 | 17323 | N/A | |
| RALGPS2 | 116191 | 367632 | 17324 | 356604 | 34544 |
| RALGPS2 | 116191 | 478871 | 17325 | N/A | |
| RALGPS2 | 116191 | 367634 | 17326 | 356606 | 34545 |
| RALYL | 184672 | 522613 | 17327 | 427787 | 34546 |
| RALYL | 184672 | 522455 | 17328 | 430394 | 34547 |
| RALYL | 184672 | 521695 | 17329 | 428667 | 34548 |
| RALYL | 184672 | 521268 | 17330 | 430367 | 34549 |
| RALYL | 184672 | 518566 | 17331 | 430065 | 34550 |
| RALYL | 184672 | 517988 | 17332 | 428711 | 34551 |
| RALYL | 184672 | 517638 | 17333 | 430128 | 34552 |
| RALYL | 184672 | 522647 | 17334 | 429284 | 34553 |
| RALYL | 184672 | 523850 | 17335 | 428807 | 34554 |
| RALYL | 184672 | 521376 | 17336 | 428310 | 34555 |
| RALYL | 184672 | 518065 | 17337 | N/A | |
| RAMP1 | 132329 | 404910 | 17338 | 384688 | 34556 |
| RAMP1 | 132329 | 254661 | 17339 | 254661 | 34557 |
| RAMP1 | 132329 | 409726 | 17340 | 386720 | 34558 |
| RAMP1 | 132329 | 403885 | 17341 | 386046 | 34559 |
| RAMP2 | 131477 | 591972 | 17342 | N/A | |
| RAMP2 | 131477 | 589683 | 17343 | 467463 | 34560 |
| RAMP2 | 131477 | 588928 | 17344 | 466980 | 34561 |
| RAMP2 | 131477 | 253796 | 17345 | 253796 | 34562 |
| RAMP2 | 131477 | 587142 | 17346 | 466455 | 34563 |
| RAMP2 | 131477 | 588576 | 17347 | 465725 | 34564 |
| RANBP2 | 153201 | 283195 | 17348 | 283195 | 34565 |
| RANBP2 | 153201 | 425282 | 17349 | 398970 | 34566 |
| RANBP2 | 153201 | 495924 | 17350 | N/A | |
| RANBP2 | 153201 | 495506 | 17351 | N/A | |
| RANBP2 | 153201 | 629728 | 17352 | 485979 | 34567 |
| RANBP3L | 164188 | 296604 | 17353 | 296604 | 34568 |
| RANBP3L | 164188 | 502994 | 17354 | 421853 | 34569 |
| RANBP3L | 164188 | 515759 | 17355 | 421149 | 34570 |
| RANBP3L | 164188 | 505865 | 17356 | 427147 | 34571 |
| RAPGEF3 | 079337 | 449771 | 17357 | 395708 | 34572 |
| RAPGEF3 | 079337 | 547856 | 17358 | 449905 | 34573 |
| RAPGEF3 | 079337 | 549151 | 17359 | 448619 | 34574 |
| RAPGEF3 | 079337 | 395360 | 17360 | N/A | |
| RAPGEF3 | 079337 | 482843 | 17361 | N/A | |
| RAPGEF3 | 079337 | 479866 | 17362 | N/A | |
| RAPGEF3 | 079337 | 488250 | 17363 | N/A | |
| RAPGEF3 | 079337 | 389212 | 17364 | 373864 | 34575 |
| RAPGEF3 | 079337 | 548919 | 17365 | 448480 | 34576 |
| RAPGEF3 | 079337 | 490387 | 17366 | N/A | |
| RAPGEF3 | 079337 | 548434 | 17367 | 447691 | 34577 |
| RAPGEF3 | 079337 | 473777 | 17368 | N/A | |
| RAPGEF3 | 079337 | 476259 | 17369 | N/A | |
| RAPGEF3 | 079337 | 395358 | 17370 | 378764 | 34578 |
| RAPGEF3 | 079337 | 494764 | 17371 | N/A | |
| RAPGEF3 | 079337 | 495465 | 17372 | 449818 | 34579 |
| RAPGEF3 | 079337 | 466322 | 17373 | 446731 | 34580 |
| RAPGEF3 | 079337 | 495953 | 17374 | 448804 | 34581 |
| RAPGEF3 | 079337 | 549347 | 17375 | N/A | |
| RAPGEF3 | 079337 | 405493 | 17376 | 384521 | 34582 |
| RAPGEF4 | 091428 | 484331 | 17377 | N/A | |
| RAPGEF4 | 091428 | 397081 | 17378 | 380271 | 34583 |
| RAPGEF4 | 091428 | 409036 | 17379 | 387104 | 34584 |
| RAPGEF4 | 091428 | 464976 | 17380 | N/A | |
| RAPGEF4 | 091428 | 397087 | 17381 | 380276 | 34585 |
| RAPGEF4 | 091428 | 473003 | 17382 | N/A | |
| RAPGEF4 | 091428 | 473043 | 17383 | N/A | |
| RAPGEF4 | 091428 | 466030 | 17384 | N/A | |
| RAPGEF4 | 091428 | 473182 | 17385 | N/A | |
| RAPGEF4 | 091428 | 459852 | 17386 | N/A | |
| RAPGEF4 | 091428 | 397085 | 17387 | 380274 | 34586 |
| RAPGEF4 | 091428 | 484645 | 17388 | N/A | |
| RAPGEF4 | 091428 | 535187 | 17389 | 438011 | 34587 |
| RAPGEF4 | 091428 | 540783 | 17390 | 440250 | 34588 |
| RAPGEF4 | 091428 | 538974 | 17391 | 440135 | 34589 |
| RARB | 077092 | 383772 | 17392 | 373282 | 34590 |
| RARB | 077092 | 437042 | 17393 | 398840 | 34591 |
| RARB | 077092 | 330688 | 17394 | 332296 | 34592 |
| RARB | 077092 | 489694 | 17395 | N/A | |
| RARB | 077092 | 480001 | 17396 | N/A | |
| RARB | 077092 | 462272 | 17397 | N/A | |
| RARB | 077092 | 479097 | 17398 | N/A | |
| RARB | 077092 | 458646 | 17399 | 391391 | 34593 |
| RASAL1 | 111344 | 546530 | 17400 | 450244 | 34594 |
| RASAL1 | 111344 | 261729 | 17401 | 261729 | 34595 |
| RASAL1 | 111344 | 446861 | 17402 | 395920 | 34596 |
| RASAL1 | 111344 | 549444 | 17403 | N/A | |
| RASAL1 | 111344 | 548055 | 17404 | 448510 | 34597 |
| RASAL1 | 111344 | 551051 | 17405 | N/A | |
| RASAL1 | 111344 | 546727 | 17406 | N/A | |
| RASAL1 | 111344 | 418411 | 17407 | N/A | |
| RASAL1 | 111344 | 548972 | 17408 | N/A | |
| RASAL1 | 111344 | 547810 | 17409 | N/A | |
| RASAL2 | 075391 | 367649 | 17410 | 356621 | 34598 |
| RASAL2 | 075391 | 465723 | 17411 | N/A | |
| RASAL2 | 075391 | 462775 | 17412 | 420558 | 34599 |
| RASAL2 | 075391 | 433130 | 17413 | 402897 | 34600 |
| RASAL2 | 075391 | 463079 | 17414 | N/A | |
| RASGEF1B | 138670 | 509081 | 17415 | 425393 | 34601 |
| RASGEF1B | 138670 | 264400 | 17416 | 264400 | 34602 |
| RASGEF1B | 138670 | 638048 | 17417 | 490436 | 34603 |
| RASGEF1B | 138670 | 335927 | 17418 | 338437 | 34604 |
| RASGEF1B | 138670 | 504863 | 17419 | 426929 | 34605 |
| RASGEF1B | 138670 | 436139 | 17420 | 398763 | 34606 |
| RASGEF1B | 138670 | 514889 | 17421 | N/A | |
| RASGEF1B | 138670 | 507538 | 17422 | N/A | |
| RASGEF1B | 138670 | 512716 | 17423 | 476065 | 34607 |
| RASGEF1B | 138670 | 514050 | 17424 | 490814 | 34608 |
| RASGEF1B | 138670 | 512343 | 17425 | 489822 | 34609 |
| RASGEF1B | 138670 | 510780 | 17426 | 490663 | 34610 |
| RASGEF1B | 138670 | 508294 | 17427 | N/A | |
| RASGEF1B | 138670 | 613784 | 17428 | 484927 | 34611 |
| RASGRF1 | 058335 | 558480 | 17429 | 452781 | 34612 |
| RASGRF1 | 058335 | 419573 | 17430 | 405963 | 34613 |
| RASGRF1 | 058335 | 394745 | 17431 | 378228 | 34614 |
| RASGRF1 | 058335 | 559926 | 17432 | N/A | |
| RASGRF1 | 058335 | 560334 | 17433 | N/A | |
| RASGRF1 | 058335 | 623620 | 17434 | N/A | |
| RASGRF1 | 058335 | 560286 | 17435 | N/A | |
| RASGRF1 | 058335 | 560943 | 17436 | N/A | |
| RASGRF1 | 058335 | 561112 | 17437 | N/A | |
| RASGRP1 | 172575 | 310803 | 17438 | 310244 | 34615 |
| RASGRP1 | 172575 | 558432 | 17439 | 453583 | 34616 |
| RASGRP1 | 172575 | 561180 | 17440 | 452859 | 34617 |
| RASGRP1 | 172575 | 450598 | 17441 | 388540 | 34618 |
| RASGRP1 | 172575 | 559830 | 17442 | 452721 | 34619 |
| RASGRP1 | 172575 | 414708 | 17443 | 413105 | 34620 |
| RASGRP1 | 172575 | 558164 | 17444 | 454164 | 34621 |
| RASGRP1 | 172575 | 557875 | 17445 | 453729 | 34622 |
| RASGRP1 | 172575 | 560425 | 17446 | 454053 | 34623 |
| RASGRP1 | 172575 | 558418 | 17447 | 453905 | 34624 |
| RASGRP1 | 172575 | 561117 | 17448 | 454005 | 34625 |
| RASGRP1 | 172575 | 560929 | 17449 | 452892 | 34626 |
| RASGRP1 | 172575 | 539159 | 17450 | 444762 | 34627 |
| RASGRP3 | 152689 | 402538 | 17451 | 385886 | 34628 |
| RASGRP3 | 152689 | 484909 | 17452 | N/A | |
| RASGRP3 | 152689 | 497723 | 17453 | N/A | |
| RASGRP3 | 152689 | 479528 | 17454 | N/A | |
| RASGRP3 | 152689 | 437184 | 17455 | 393866 | 34629 |
| RASGRP3 | 152689 | 403687 | 17456 | 384192 | 34630 |
| RASGRP3 | 152689 | 482857 | 17457 | N/A | |
| RASGRP3 | 152689 | 442390 | 17458 | 405648 | 34631 |
| RASGRP3 | 152689 | 425210 | 17459 | 401974 | 34632 |

-continued

| Symbol | ENSG | ENST | SEQ ID | ENSP | SEQ ID |
|---|---|---|---|---|---|
| RASGRP3 | 152689 | 444784 | 17460 | 400602 | 34633 |
| RASGRP3 | 152689 | 423159 | 17461 | 388139 | 34634 |
| RASGRP3 | 152689 | 494927 | 17462 | N/A | |
| RASGRP3 | 152689 | 407811 | 17463 | 383917 | 34635 |
| RASGRP3 | 152689 | 477927 | 17464 | N/A | |
| RASGRP3 | 152689 | 490150 | 17465 | N/A | |
| RASGRP3 | 152689 | 419772 | 17466 | 409593 | 34636 |
| RASGRP3 | 152689 | 468856 | 17467 | N/A | |
| RASGRP3 | 152689 | 482731 | 17468 | N/A | |
| RASIP1 | 105538 | 601530 | 17469 | N/A | |
| RASIP1 | 105538 | 222145 | 17470 | 222145 | 34637 |
| RASIP1 | 105538 | 599291 | 17471 | 471633 | 34638 |
| RASIP1 | 105538 | 594232 | 17472 | N/A | |
| RASL11B | 128045 | 248706 | 17473 | 248706 | 34639 |
| RASL11B | 128045 | 515677 | 17474 | N/A | |
| RASL11B | 128045 | 505041 | 17475 | N/A | |
| RASL12 | 103710 | 220062 | 17476 | 220062 | 34640 |
| RASL12 | 103710 | 421977 | 17477 | 390028 | 34641 |
| RASL12 | 103710 | 434605 | 17478 | 412787 | 34642 |
| RASSF2 | 101265 | 478553 | 17479 | N/A | |
| RASSF2 | 101265 | 379400 | 17480 | 368710 | 34643 |
| RASSF2 | 101265 | 379376 | 17481 | 368684 | 34644 |
| RBKS | 171174 | 302188 | 17482 | 306817 | 34645 |
| RBKS | 171174 | 449378 | 17483 | 413789 | 34646 |
| RBKS | 171174 | 458185 | 17484 | 393558 | 34647 |
| RBKS | 171174 | 453412 | 17485 | 415975 | 34648 |
| RBKS | 171174 | 612015 | 17486 | 483033 | 34649 |
| RBM22 | 086589 | 520132 | 17487 | N/A | |
| RBM22 | 086589 | 199814 | 17488 | 199814 | 34650 |
| RBM22 | 086589 | 447771 | 17489 | 412118 | 34651 |
| RBM22 | 086589 | 522469 | 17490 | N/A | |
| RBM22 | 086589 | 518917 | 17491 | 428154 | 34652 |
| RBM22 | 086589 | 521248 | 17492 | N/A | |
| RBM22 | 086589 | 521594 | 17493 | N/A | |
| RBM22 | 086589 | 521464 | 17494 | 430946 | 34653 |
| RBM24 | 112183 | 379052 | 17495 | 368341 | 34654 |
| RBM24 | 112183 | 509686 | 17496 | 426222 | 34655 |
| RBM24 | 112183 | 425446 | 17497 | 396898 | 34656 |
| RBM24 | 112183 | 503965 | 17498 | 421971 | 34657 |
| RBM24 | 112183 | 318204 | 17499 | 319551 | 34658 |
| RBM24 | 112183 | 504055 | 17500 | N/A | |
| RBM24 | 112183 | 510826 | 17501 | N/A | |
| RBM24 | 112183 | 508508 | 17502 | N/A | |
| RBM25 | 119707 | 261973 | 17503 | 261973 | 34659 |
| RBM25 | 119707 | 527432 | 17504 | 431150 | 34660 |
| RBM25 | 119707 | 531500 | 17505 | 434333 | 34661 |
| RBM25 | 119707 | 532683 | 17506 | N/A | |
| RBM25 | 119707 | 525321 | 17507 | 436868 | 34662 |
| RBM25 | 119707 | 526754 | 17508 | 436225 | 34663 |
| RBM25 | 119707 | 525161 | 17509 | 434004 | 34664 |
| RBM25 | 119707 | 528081 | 17510 | 434444 | 34665 |
| RBM25 | 119707 | 532192 | 17511 | 434950 | 34666 |
| RBM25 | 119707 | 532483 | 17512 | N/A | |
| RBM25 | 119707 | 527449 | 17513 | N/A | |
| RBM25 | 119707 | 530978 | 17514 | N/A | |
| RBM7 | 076053 | 540163 | 17515 | 439918 | 34667 |
| RBM7 | 076053 | 375490 | 17516 | 364639 | 34668 |
| RBM7 | 076053 | 541475 | 17517 | 440949 | 34669 |
| RBM7 | 076053 | 544313 | 17518 | 437847 | 34670 |
| RBM7 | 076053 | 542140 | 17519 | 437998 | 34671 |
| RBM7 | 076053 | 544582 | 17520 | 440923 | 34672 |
| RBM7 | 076053 | 545678 | 17521 | 445848 | 34673 |
| RBM7 | 076053 | 538134 | 17522 | N/A | |
| RBM7 | 076053 | 624815 | 17523 | 485655 | 34674 |
| RBMS3 | 144642 | 432518 | 17524 | N/A | |
| RBMS3 | 144642 | 443912 | 17525 | N/A | |
| RBMS3 | 144642 | 445077 | 17526 | N/A | |
| RBMS3 | 144642 | 636680 | 17527 | 490271 | 34675 |
| RBMS3 | 144642 | 636900 | 17528 | N/A | |
| RBMS3 | 144642 | 636582 | 17529 | N/A | |
| RBMS3 | 144642 | 637842 | 17530 | 489718 | 34676 |
| RBMS3 | 144642 | 434693 | 17531 | 395592 | 34677 |
| RBMS3 | 144642 | 471426 | 17532 | N/A | |
| RBMS3 | 144642 | 383767 | 17533 | 373277 | 34678 |
| RBMS3 | 144642 | 445033 | 17534 | 391934 | 34679 |
| RBMS3 | 144642 | 273139 | 17535 | 273139 | 34680 |

-continued

| Symbol | ENSG | ENST | SEQ ID | ENSP | SEQ ID |
|---|---|---|---|---|---|
| RBMS3 | 144642 | 383766 | 17536 | 373276 | 34681 |
| RBMS3 | 144642 | 452462 | 17537 | 397926 | 34682 |
| RBMS3 | 144642 | 456853 | 17538 | 400519 | 34683 |
| RBMS3 | 144642 | 497205 | 17539 | N/A | |
| RBMS3 | 144642 | 478716 | 17540 | N/A | |
| RBMS3 | 144642 | 497319 | 17541 | N/A | |
| RBMS3 | 144642 | 473799 | 17542 | N/A | |
| RBMS3 | 144642 | 497274 | 17543 | N/A | |
| RBP2 | 114113 | 232217 | 17544 | 232217 | 34684 |
| RBP2 | 114113 | 511956 | 17545 | 424333 | 34685 |
| RBP2 | 114113 | 506825 | 17546 | 421266 | 34686 |
| RBPJL | 124232 | 372743 | 17547 | 361828 | 34687 |
| RBPJL | 124232 | 372741 | 17548 | 361826 | 34688 |
| RBPJL | 124232 | 343694 | 17549 | 341243 | 34689 |
| RBPJL | 124232 | 464504 | 17550 | 483978 | 34690 |
| RBPJL | 124232 | 622729 | 17551 | N/A | |
| RBPMS2 | 166831 | 560606 | 17552 | 456720 | 34691 |
| RBPMS2 | 166831 | 300069 | 17553 | 300069 | 34692 |
| RCAN2 | 172348 | 330430 | 17554 | 329454 | 34693 |
| RCAN2 | 172348 | 371374 | 17555 | 360425 | 34694 |
| RCAN2 | 172348 | 306764 | 17556 | 305223 | 34695 |
| RCAN2 | 172348 | 405162 | 17557 | 384317 | 34696 |
| RCN1 | 049449 | 530348 | 17558 | 436482 | 34697 |
| RCN1 | 049449 | 532942 | 17559 | 436422 | 34698 |
| RCN1 | 049449 | 506388 | 17560 | N/A | |
| RCN1 | 049449 | 530146 | 17561 | N/A | |
| RCN1 | 049449 | 054950 | 17562 | 054950 | 34699 |
| RCN1 | 049449 | 532721 | 17563 | 433249 | 34700 |
| RCN1 | 049449 | 533898 | 17564 | N/A | |
| RCN1 | 049449 | 532474 | 17565 | N/A | |
| RCN1 | 049449 | 527337 | 17566 | 436427 | 34701 |
| RCN1 | 049449 | 531345 | 17567 | N/A | |
| RCN1 | 049449 | 528630 | 17568 | 433237 | 34702 |
| RCN2 | 117906 | 394885 | 17569 | 378349 | 34703 |
| RCN2 | 117906 | 320963 | 17570 | 319739 | 34704 |
| RCN2 | 117906 | 394883 | 17571 | 378347 | 34705 |
| RCN2 | 117906 | 557805 | 17572 | 453052 | 34706 |
| RCN2 | 117906 | 558598 | 17573 | N/A | |
| RCN2 | 117906 | 560833 | 17574 | N/A | |
| RECK | 122707 | 377966 | 17575 | 367202 | 34707 |
| RECK | 122707 | 475774 | 17576 | N/A | |
| RECK | 122707 | 479053 | 17577 | N/A | |
| REEP1 | 068615 | 165698 | 17578 | 165698 | 34708 |
| REEP1 | 068615 | 538924 | 17579 | 438346 | 34709 |
| REEP1 | 068615 | 535845 | 17580 | 437567 | 34710 |
| REEP1 | 068615 | 541910 | 17581 | 442681 | 34711 |
| REEP1 | 068615 | 453231 | 17582 | 392197 | 34712 |
| REEP1 | 068615 | 490915 | 17583 | N/A | |
| REEP1 | 068615 | 473407 | 17584 | N/A | |
| REEP1 | 068615 | 489855 | 17585 | 475269 | 34713 |
| REEP1 | 068615 | 475475 | 17586 | N/A | |
| RELN | 189056 | 424685 | 17587 | 388446 | 34714 |
| RELN | 189056 | 473945 | 17588 | N/A | |
| RELN | 189056 | 478148 | 17589 | N/A | |
| RELN | 189056 | 473457 | 17590 | N/A | |
| RELN | 189056 | 429186 | 17591 | 404818 | 34715 |
| RELN | 189056 | 343529 | 17592 | 345694 | 34716 |
| RELN | 189056 | 428762 | 17593 | 392423 | 34717 |
| REP15 | 174236 | 310791 | 17594 | 310335 | 34718 |
| REPIN1 | 214022 | 519397 | 17595 | 428562 | 34719 |
| REPIN1 | 214022 | 487455 | 17596 | N/A | |
| REPIN1 | 214022 | 479668 | 17597 | 420578 | 34720 |
| REPIN1 | 214022 | 466559 | 17598 | 418507 | 34721 |
| REPIN1 | 214022 | 489432 | 17599 | 417291 | 34722 |
| REPIN1 | 214022 | 475514 | 17600 | 419789 | 34723 |
| REPIN1 | 214022 | 473391 | 17601 | N/A | |
| REPIN1 | 214022 | 482680 | 17602 | 417982 | 34724 |
| REPIN1 | 214022 | 488943 | 17603 | 419872 | 34725 |
| REPIN1 | 214022 | 495535 | 17604 | N/A | |
| REPIN1 | 214022 | 467980 | 17605 | 418279 | 34726 |
| REPIN1 | 214022 | 469309 | 17606 | N/A | |
| REPIN1 | 214022 | 518514 | 17607 | 428129 | 34727 |
| REPIN1 | 214022 | 522266 | 17608 | 427721 | 34728 |
| REPIN1 | 214022 | 518462 | 17609 | N/A | |
| REPIN1 | 214022 | 486714 | 17610 | 417786 | 34729 |
| REPIN1 | 214022 | 425389 | 17611 | 388287 | 34730 |

| Symbol | ENSG | ENST | SEQ ID | ENSP | SEQ ID |
|---|---|---|---|---|---|
| REPIN1 | 214022 | 397281 | 17612 | 380451 | 34731 |
| REPIN1 | 214022 | 444957 | 17613 | 407714 | 34732 |
| RERG | 134533 | 256953 | 17614 | 256953 | 34733 |
| RERG | 134533 | 538313 | 17615 | 441505 | 34734 |
| RERG | 134533 | 536465 | 17616 | 438280 | 34735 |
| RERG | 134533 | 546331 | 17617 | 444485 | 34736 |
| RERG | 134533 | 545567 | 17618 | 439532 | 34737 |
| RERG | 134533 | 537647 | 17619 | 441860 | 34738 |
| RERG | 134533 | 393736 | 17620 | 440887 | 34739 |
| RERG | 134533 | 537717 | 17621 | N/A | |
| RERG | 134533 | 437578 | 17622 | N/A | |
| RET | 165731 | 355710 | 17623 | 347942 | 34740 |
| RET | 165731 | 498820 | 17624 | 419080 | 34741 |
| RET | 165731 | 340058 | 17625 | 344798 | 34742 |
| RET | 165731 | 638465 | 17626 | 491505 | 34743 |
| RET | 165731 | 640619 | 17627 | 492728 | 34744 |
| RET | 165731 | 479913 | 17628 | N/A | |
| RET | 165731 | 615310 | 17629 | 480088 | 34745 |
| RFTN1 | 131378 | 607320 | 17630 | 475367 | 34746 |
| RFTN1 | 131378 | 432519 | 17631 | 403926 | 34747 |
| RFTN1 | 131378 | 334133 | 17632 | 334153 | 34748 |
| RFTN1 | 131378 | 483671 | 17633 | N/A | |
| RFTN1 | 131378 | 451036 | 17634 | 403997 | 34749 |
| RFTN1 | 131378 | 495666 | 17635 | N/A | |
| RFTN1 | 131378 | 484752 | 17636 | N/A | |
| RFTN1 | 131378 | 470458 | 17637 | N/A | |
| RFTN1 | 131378 | 449415 | 17638 | 409427 | 34750 |
| RFTN1 | 131378 | 441460 | 17639 | 388718 | 34751 |
| RFTN1 | 131378 | 453536 | 17640 | 410493 | 34752 |
| RFTN1 | 131378 | 431547 | 17641 | 393216 | 34753 |
| RFX4 | 111783 | 392842 | 17642 | 376585 | 34754 |
| RFX4 | 111783 | 546882 | 17643 | 447423 | 34755 |
| RFX4 | 111783 | 549040 | 17644 | 447735 | 34756 |
| RFX4 | 111783 | 539967 | 17645 | 473326 | 34757 |
| RFX4 | 111783 | 357881 | 17646 | 350552 | 34758 |
| RFX4 | 111783 | 536722 | 17647 | 444163 | 34759 |
| RFX4 | 111783 | 536688 | 17648 | N/A | |
| RFX4 | 111783 | 552773 | 17649 | N/A | |
| RFX4 | 111783 | 551640 | 17650 | 448694 | 34760 |
| RFX4 | 111783 | 552866 | 17651 | N/A | |
| RFX4 | 111783 | 229387 | 17652 | 229387 | 34761 |
| RFX4 | 111783 | 552917 | 17653 | 449732 | 34762 |
| RGCC | 102760 | 379359 | 17654 | 368664 | 34763 |
| RGCC | 102760 | 487837 | 17655 | N/A | |
| KIAA0513 | 135709 | 566428 | 17656 | 457408 | 34764 |
| KIAA0513 | 135709 | 567328 | 17657 | 455544 | 34765 |
| KIAA0513 | 135709 | 562580 | 17658 | 454547 | 34766 |
| KIAA0513 | 135709 | 562564 | 17659 | 454758 | 34767 |
| KIAA0513 | 135709 | 562388 | 17660 | N/A | |
| KIAA0513 | 135709 | 258180 | 17661 | 258180 | 34768 |
| KIAA0513 | 135709 | 538274 | 17662 | 446439 | 34769 |
| RGL3 | 205517 | 562663 | 17663 | 454920 | 34770 |
| RGL3 | 205517 | 563726 | 17664 | 455922 | 34771 |
| RGL3 | 205517 | 566153 | 17665 | N/A | |
| RGL3 | 205517 | 380456 | 17666 | 369823 | 34772 |
| RGL3 | 205517 | 568628 | 17667 | N/A | |
| RGL3 | 205517 | 393423 | 17668 | 377075 | 34773 |
| RGL3 | 205517 | 566919 | 17669 | N/A | |
| RGL3 | 205517 | 589032 | 17670 | 466669 | 34774 |
| RGL3 | 205517 | 453604 | 17671 | N/A | |
| RGL3 | 205517 | 565895 | 17672 | N/A | |
| RGL3 | 205517 | 569439 | 17673 | N/A | |
| RGL3 | 205517 | 561687 | 17674 | N/A | |
| RGL3 | 205517 | 567431 | 17675 | 464876 | 34775 |
| RGL3 | 205517 | 563436 | 17676 | N/A | |
| RGL3 | 205517 | 567080 | 17677 | 456429 | 34776 |
| RGL3 | 205517 | 568420 | 17678 | N/A | |
| RGL3 | 205517 | 561570 | 17679 | N/A | |
| RGMA | 182175 | 329082 | 17680 | 330005 | 34777 |
| RGMA | 182175 | 542321 | 17681 | 440025 | 34778 |
| RGMA | 182175 | 554387 | 17682 | 451505 | 34779 |
| RGMA | 182175 | 557301 | 17683 | 452126 | 34780 |
| RGMA | 182175 | 557420 | 17684 | 452170 | 34781 |
| RGMA | 182175 | 556658 | 17685 | 456290 | 34782 |
| RGMA | 182175 | 555584 | 17686 | N/A | |
| RGMA | 182175 | 555598 | 17687 | 451709 | 34783 |

| Symbol | ENSG | ENST | SEQ ID | ENSP | SEQ ID |
|---|---|---|---|---|---|
| RGMA | 182175 | 557608 | 17688 | N/A | |
| RGMA | 182175 | 556950 | 17689 | 452350 | 34784 |
| RGMA | 182175 | 425933 | 17690 | 404442 | 34785 |
| RGMA | 182175 | 543599 | 17691 | 442498 | 34786 |
| RGMB | 174136 | 504776 | 17692 | N/A | |
| RGMB | 174136 | 505265 | 17693 | N/A | |
| RGMB | 174136 | 434027 | 17694 | N/A | |
| RGMB | 174136 | 308234 | 17695 | 308219 | 34787 |
| RGMB | 174136 | 507054 | 17696 | N/A | |
| RGMB | 174136 | 513185 | 17697 | 423256 | 34788 |
| RGMB | 174136 | 508978 | 17698 | N/A | |
| RGS16 | 143333 | 367558 | 17699 | 356529 | 34789 |
| RGS2 | 116741 | 483295 | 17700 | N/A | |
| RGS2 | 116741 | 235382 | 17701 | 235382 | 34790 |
| RGS2 | 116741 | 464302 | 17702 | N/A | |
| RGS2 | 116741 | 487236 | 17703 | N/A | |
| RGS20 | 147509 | 297313 | 17704 | 297313 | 34791 |
| RGS20 | 147509 | 517659 | 17705 | 428795 | 34792 |
| RGS20 | 147509 | 344277 | 17706 | 344630 | 34793 |
| RGS20 | 147509 | 523280 | 17707 | 429897 | 34794 |
| RGS20 | 147509 | 518286 | 17708 | N/A | |
| RGS20 | 147509 | 523414 | 17709 | N/A | |
| RGS20 | 147509 | 522225 | 17710 | 430627 | 34795 |
| RGS20 | 147509 | 276500 | 17711 | 276500 | 34796 |
| RGS20 | 147509 | 523064 | 17712 | N/A | |
| RGS20 | 147509 | 517405 | 17713 | N/A | |
| RGS4 | 117152 | 421743 | 17714 | 397181 | 34797 |
| RGS4 | 117152 | 527393 | 17715 | N/A | |
| RGS4 | 117152 | 367909 | 17716 | 356885 | 34798 |
| RGS4 | 117152 | 531057 | 17717 | 436106 | 34799 |
| RGS4 | 117152 | 527809 | 17718 | 433261 | 34800 |
| RGS4 | 117152 | 367908 | 17719 | 356884 | 34801 |
| RGS4 | 117152 | 491263 | 17720 | N/A | |
| RGS4 | 117152 | 533019 | 17721 | N/A | |
| RGS4 | 117152 | 367906 | 17722 | 356882 | 34802 |
| RGS4 | 117152 | 528938 | 17723 | 432194 | 34803 |
| RGS6 | 182732 | 553525 | 17724 | 451030 | 34804 |
| RGS6 | 182732 | 555571 | 17725 | 450936 | 34805 |
| RGS6 | 182732 | 553530 | 17726 | 452331 | 34806 |
| RGS6 | 182732 | 554474 | 17727 | 450858 | 34807 |
| RGS6 | 182732 | 556437 | 17728 | 451855 | 34808 |
| RGS6 | 182732 | 355512 | 17729 | 347699 | 34809 |
| RGS6 | 182732 | 404301 | 17730 | 385243 | 34810 |
| RGS6 | 182732 | 406236 | 17731 | 384218 | 34811 |
| RGS6 | 182732 | 407322 | 17732 | 384612 | 34812 |
| RGS6 | 182732 | 553690 | 17733 | N/A | |
| RGS6 | 182732 | 555368 | 17734 | N/A | |
| RGS6 | 182732 | 434263 | 17735 | 412144 | 34813 |
| RGS6 | 182732 | 554782 | 17736 | 451912 | 34814 |
| RGS6 | 182732 | 554734 | 17737 | N/A | |
| RGS6 | 182732 | 553519 | 17738 | N/A | |
| RGS6 | 182732 | 554300 | 17739 | N/A | |
| RGS6 | 182732 | 402788 | 17740 | 383953 | 34815 |
| RGS6 | 182732 | 622468 | 17741 | 478186 | 34816 |
| RGS6 | 182732 | 343854 | 17742 | 341199 | 34817 |
| RGS7BP | 186479 | 508162 | 17743 | N/A | |
| RGS7BP | 186479 | 334025 | 17744 | 334851 | 34818 |
| RGS7BP | 186479 | 505263 | 17745 | N/A | |
| RGS8 | 135824 | 258302 | 17746 | 258302 | 34819 |
| RGS8 | 135824 | 483095 | 17747 | 426289 | 34820 |
| RGS8 | 135824 | 367557 | 17748 | 356528 | 34821 |
| RGS8 | 135824 | 367556 | 17749 | 356527 | 34822 |
| RGS8 | 135824 | 491420 | 17750 | N/A | |
| RGS8 | 135824 | 508450 | 17751 | 427076 | 34823 |
| RGS8 | 135824 | 515211 | 17752 | N/A | |
| RGS9 | 108370 | 638125 | 17753 | N/A | |
| RGS9 | 108370 | 637818 | 17754 | N/A | |
| RGS9 | 108370 | 582940 | 17755 | N/A | |
| RGS9 | 108370 | 635833 | 17756 | 490658 | 34824 |
| RGS9 | 108370 | 583473 | 17757 | N/A | |
| RGS9 | 108370 | 443584 | 17758 | 405814 | 34825 |
| RGS9 | 108370 | 584234 | 17759 | 463410 | 34826 |
| RGS9 | 108370 | 449996 | 17760 | 396329 | 34827 |
| RGS9 | 108370 | 262406 | 17761 | 262406 | 34828 |
| RGS9 | 108370 | 581175 | 17762 | N/A | |
| RGS9 | 108370 | 577186 | 17763 | N/A | |

-continued

| Symbol | ENSG | ENST | SEQ ID | ENSP | SEQ ID |
|---|---|---|---|---|---|
| RGS9 | 108370 | 577595 | 17764 | N/A | |
| RHBG | 132677 | 467375 | 17765 | N/A | |
| RHBG | 132677 | 451864 | 17766 | 389836 | 34829 |
| RHBG | 132677 | 537040 | 17767 | 441197 | 34830 |
| RHBG | 132677 | 613460 | 17768 | 483178 | 34831 |
| RHBG | 132677 | 612897 | 17769 | 477836 | 34832 |
| RHBG | 132677 | 618120 | 17770 | N/A | |
| RHBG | 132677 | 620376 | 17771 | 478851 | 34833 |
| RHBG | 132677 | 494874 | 17772 | N/A | |
| RHBG | 132677 | 622297 | 17773 | N/A | |
| RHCG | 140519 | 560081 | 17774 | 453588 | 34834 |
| RHCG | 140519 | 268122 | 17775 | 268122 | 34835 |
| RHCG | 140519 | 558360 | 17776 | 453496 | 34836 |
| RHCG | 140519 | 558030 | 17777 | 452899 | 34837 |
| RHCG | 140519 | 558184 | 17778 | 453716 | 34838 |
| RHCG | 140519 | 559638 | 17779 | N/A | |
| RHEB | 106615 | 262187 | 17780 | 262187 | 34839 |
| RHEB | 106615 | 472642 | 17781 | 420726 | 34840 |
| RHEB | 106615 | 478470 | 17782 | 417802 | 34841 |
| RHEB | 106615 | 496004 | 17783 | 418161 | 34842 |
| RHEB | 106615 | 470072 | 17784 | N/A | |
| RHEB | 106615 | 470370 | 17785 | 417212 | 34843 |
| RHEB | 106615 | 482053 | 17786 | N/A | |
| RHOB | 143878 | 272233 | 17787 | 272233 | 34844 |
| RHOBTB1 | 072422 | 337910 | 17788 | 338671 | 34845 |
| RHOBTB1 | 072422 | 357917 | 17789 | 350595 | 34846 |
| RHOBTB1 | 072422 | 496237 | 17790 | N/A | |
| RHOBTB1 | 072422 | 461910 | 17791 | N/A | |
| RHOBTB1 | 072422 | 490827 | 17792 | N/A | |
| RHOBTB1 | 072422 | 483488 | 17793 | N/A | |
| RHOBTB3 | 164292 | 515852 | 17794 | N/A | |
| RHOBTB3 | 164292 | 510226 | 17795 | N/A | |
| RHOBTB3 | 164292 | 504949 | 17796 | N/A | |
| RHOBTB3 | 164292 | 506959 | 17797 | 423688 | 34847 |
| RHOBTB3 | 164292 | 506817 | 17798 | 426479 | 34848 |
| RHOBTB3 | 164292 | 379982 | 17799 | 369318 | 34849 |
| RHOBTB3 | 164292 | 512878 | 17800 | N/A | |
| RHOBTB3 | 164292 | 510623 | 17801 | 423652 | 34850 |
| RHOBTB3 | 164292 | 502541 | 17802 | 421875 | 34851 |
| RHOBTB3 | 164292 | 504179 | 17803 | 422360 | 34852 |
| RHOBTB3 | 164292 | 510313 | 17804 | 424844 | 34853 |
| RHOBTB3 | 164292 | 507186 | 17805 | N/A | |
| RHOBTB3 | 164292 | 511558 | 17806 | N/A | |
| RHOBTB3 | 164292 | 503737 | 17807 | 426390 | 34854 |
| RHOBTB3 | 164292 | 513091 | 17808 | 425342 | 34855 |
| RHOBTB3 | 164292 | 514198 | 17809 | 424700 | 34856 |
| RHOD | 173156 | 308831 | 17810 | 308576 | 34857 |
| RHOD | 173156 | 533360 | 17811 | N/A | |
| RHOD | 173156 | 532559 | 17812 | 432003 | 34858 |
| RHOJ | 126785 | 557447 | 17813 | 451796 | 34859 |
| RHOJ | 126785 | 316754 | 17814 | 316729 | 34860 |
| RHOJ | 126785 | 557133 | 17815 | N/A | |
| RHOJ | 126785 | 555125 | 17816 | 451643 | 34861 |
| RHOU | 116574 | 366691 | 17817 | 355652 | 34862 |
| RHPN2 | 131941 | 544458 | 17818 | N/A | |
| RHPN2 | 131941 | 254260 | 17819 | 254260 | 34863 |
| RHPN2 | 131941 | 588388 | 17820 | 465898 | 34864 |
| RHPN2 | 131941 | 588683 | 17821 | N/A | |
| RHPN2 | 131941 | 592247 | 17822 | N/A | |
| RHPN2 | 131941 | 591502 | 17823 | N/A | |
| RHPN2 | 131941 | 585641 | 17824 | N/A | |
| RIMBP2 | 060709 | 261655 | 17825 | 261655 | 34865 |
| RIMBP2 | 060709 | 540658 | 17826 | 439437 | 34866 |
| RIMBP2 | 060709 | 536632 | 17827 | 439030 | 34867 |
| RIMBP2 | 060709 | 535703 | 17828 | 440347 | 34868 |
| RIMBP2 | 060709 | 544568 | 17829 | N/A | |
| RIMS1 | 079841 | 491071 | 17830 | 430101 | 34869 |
| RIMS1 | 079841 | 517960 | 17831 | 429959 | 34870 |
| RIMS1 | 079841 | 518273 | 17832 | 430408 | 34871 |
| RIMS1 | 079841 | 522291 | 17833 | 430932 | 34872 |
| RIMS1 | 079841 | 521978 | 17834 | 428417 | 34873 |
| RIMS1 | 079841 | 520567 | 17835 | 430502 | 34874 |
| RIMS1 | 079841 | 264839 | 17836 | 264839 | 34875 |
| RIMS1 | 079841 | 517433 | 17837 | 430359 | 34876 |
| RIMS1 | 079841 | 401910 | 17838 | 385649 | 34877 |
| RIMS1 | 079841 | 523963 | 17839 | 428328 | 34878 |

-continued

| Symbol | ENSG | ENST | SEQ ID | ENSP | SEQ ID |
|---|---|---|---|---|---|
| RIMS1 | 079841 | 425662 | 17840 | 411235 | 34879 |
| RIMS1 | 079841 | 453976 | 17841 | 389503 | 34880 |
| RIMS1 | 079841 | 524197 | 17842 | N/A | |
| RIMS1 | 079841 | 517827 | 17843 | 428367 | 34881 |
| RIMS1 | 079841 | 370420 | 17844 | 359448 | 34882 |
| RIMS1 | 079841 | 522211 | 17845 | 429338 | 34883 |
| RIMS1 | 079841 | 463023 | 17846 | N/A | |
| RIMS1 | 079841 | 431478 | 17847 | N/A | |
| RIMS1 | 079841 | 414192 | 17848 | 402273 | 34884 |
| RIMS1 | 079841 | 370419 | 17849 | N/A | |
| RIMS3 | 117016 | 372684 | 17850 | 361769 | 34885 |
| RIMS3 | 117016 | 372683 | 17851 | 361768 | 34886 |
| RIMS4 | 101098 | 372851 | 17852 | 361942 | 34887 |
| RIMS4 | 101098 | 541604 | 17853 | 439287 | 34888 |
| RIN2 | 132669 | 255006 | 17854 | 255006 | 34889 |
| RIN2 | 132669 | 459721 | 17855 | N/A | |
| RIN2 | 132669 | 467569 | 17856 | N/A | |
| RIN2 | 132669 | 488077 | 17857 | N/A | |
| RIN2 | 132669 | 465815 | 17858 | N/A | |
| RIN2 | 132669 | 484638 | 17859 | N/A | |
| RIN2 | 132669 | 440354 | 17860 | 391239 | 34890 |
| RIT2 | 152214 | 326695 | 17861 | 321805 | 34891 |
| RIT2 | 152214 | 589109 | 17862 | 467217 | 34892 |
| RIT2 | 152214 | 590910 | 17863 | 466620 | 34893 |
| RIT2 | 152214 | 594852 | 17864 | N/A | |
| RLBP1 | 140522 | 268125 | 17865 | 268125 | 34894 |
| RLBP1 | 140522 | 563254 | 17866 | 454740 | 34895 |
| RLBP1 | 140522 | 567787 | 17867 | 457251 | 34896 |
| RLBP1 | 140522 | 564388 | 17868 | N/A | |
| RLF | 117000 | 372771 | 17869 | 361857 | 34897 |
| RNF112 | 128482 | 575165 | 17870 | 464134 | 34898 |
| RNF112 | 128482 | 574149 | 17871 | N/A | |
| RNF112 | 128482 | 461366 | 17872 | 454919 | 34899 |
| RNF112 | 128482 | 580109 | 17873 | N/A | |
| RNF112 | 128482 | 574782 | 17874 | N/A | |
| RNF122 | 133874 | 256257 | 17875 | 256257 | 34900 |
| RNF139 | 170881 | 303545 | 17876 | 304051 | 34901 |
| RNF139 | 170881 | 517684 | 17877 | 429836 | 34902 |
| RNF152 | 176641 | 312828 | 17878 | 316628 | 34903 |
| RNF152 | 176641 | 591306 | 17879 | 466492 | 34904 |
| RNF152 | 176641 | 588064 | 17880 | N/A | |
| RNF152 | 176641 | 619552 | 17881 | N/A | |
| RNF152 | 176641 | 588396 | 17882 | N/A | |
| RNF17 | 132972 | 255324 | 17883 | 255324 | 34905 |
| RNF17 | 132972 | 255326 | 17884 | N/A | |
| RNF17 | 132972 | 255325 | 17885 | 255325 | 34906 |
| RNF17 | 132972 | 418120 | 17886 | 388892 | 34907 |
| RNF17 | 132972 | 339524 | 17887 | 344776 | 34908 |
| RNF182 | 180537 | 488763 | 17888 | 417500 | 34909 |
| RNF182 | 180537 | 488300 | 17889 | 420465 | 34910 |
| RNF182 | 180537 | 420478 | 17890 | 419329 | 34911 |
| RNF182 | 180537 | 471906 | 17891 | 417514 | 34912 |
| RNF182 | 180537 | 423553 | 17892 | 418717 | 34913 |
| RNF182 | 180537 | 537663 | 17893 | 443228 | 34914 |
| RNF182 | 180537 | 544682 | 17894 | 442021 | 34915 |
| RNF182 | 180537 | 537388 | 17895 | 441271 | 34916 |
| RNF207 | 158286 | 466994 | 17896 | N/A | |
| RNF207 | 158286 | 484435 | 17897 | N/A | |
| RNF207 | 158286 | 377939 | 17898 | 367173 | 34917 |
| RNF207 | 158286 | 485539 | 17899 | N/A | |
| RNF207 | 158286 | 496676 | 17900 | N/A | |
| RNF207 | 158286 | 463453 | 17901 | N/A | |
| RNF207 | 158286 | 496329 | 17902 | N/A | |
| RNF207 | 158286 | 492476 | 17903 | N/A | |
| RNF207 | 158286 | 483336 | 17904 | N/A | |
| RNF212 | 178222 | 514024 | 17905 | N/A | |
| RNF212 | 178222 | 503206 | 17906 | N/A | |
| RNF212 | 178222 | 514757 | 17907 | N/A | |
| RNF212 | 178222 | 505693 | 17908 | N/A | |
| RNF212 | 178222 | 508633 | 17909 | N/A | |
| RNF212 | 178222 | 506730 | 17910 | 425843 | 34918 |
| RNF212 | 178222 | 382968 | 17911 | 372428 | 34919 |
| RNF212 | 178222 | 433731 | 17912 | 389709 | 34920 |
| RNF212 | 178222 | 511620 | 17913 | 426115 | 34921 |
| RNF212 | 178222 | 508428 | 17914 | 423030 | 34922 |
| RNF212 | 178222 | 510715 | 17915 | 423560 | 34923 |

-continued

| Symbol | ENSG | ENST | SEQ ID | ENSP | SEQ ID |
|--------|------|------|--------|------|--------|
| RNF212 | 178222 | 512552 | 17916 | N/A | |
| RNF212 | 178222 | 333673 | 17917 | 327481 | 34924 |
| RNF212 | 178222 | 454487 | 17918 | N/A | |
| RNF212 | 178222 | 505730 | 17919 | N/A | |
| RNF215 | 099999 | 332468 | 17920 | 487588 | 34925 |
| RNF215 | 099999 | 631046 | 17921 | 485721 | 34926 |
| RNF215 | 099999 | 630264 | 17922 | 486757 | 34927 |
| RNF215 | 099999 | 421022 | 17923 | 396278 | 34928 |
| RNF215 | 099999 | 382363 | 17924 | 371800 | 34929 |
| RNF215 | 099999 | 215798 | 17925 | 215798 | 34930 |
| RNF215 | 099999 | 463319 | 17926 | N/A | |
| RNF215 | 099999 | 473077 | 17927 | N/A | |
| RNF215 | 099999 | 431544 | 17928 | 404738 | 34931 |
| RNF215 | 099999 | 619645 | 17929 | 486180 | 34932 |
| RNF217 | 146373 | 521654 | 17930 | 428698 | 34933 |
| RNF217 | 146373 | 519971 | 17931 | N/A | |
| RNF217 | 146373 | 519565 | 17932 | 429012 | 34934 |
| RNF217 | 146373 | 454842 | 17933 | N/A | |
| RNF217 | 146373 | 519799 | 17934 | 427711 | 34935 |
| RNF217 | 146373 | 368414 | 17935 | 357399 | 34936 |
| RNF217 | 146373 | 359704 | 17936 | 352734 | 34937 |
| RNF217 | 146373 | 431104 | 17937 | N/A | |
| RNF217 | 146373 | 432158 | 17938 | 404282 | 34938 |
| RNF217 | 146373 | 368415 | 17939 | N/A | |
| RNF217 | 146373 | 560949 | 17940 | 452812 | 34939 |
| RNF220 | 187147 | 355387 | 17941 | 347548 | 34940 |
| RNF220 | 187147 | 361799 | 17942 | 354872 | 34941 |
| RNF220 | 187147 | 487332 | 17943 | N/A | |
| RNF220 | 187147 | 470498 | 17944 | N/A | |
| RNF220 | 187147 | 496262 | 17945 | N/A | |
| RNF220 | 187147 | 453863 | 17946 | 411541 | 34942 |
| RNF220 | 187147 | 335497 | 17947 | 335580 | 34943 |
| RNF220 | 187147 | 440132 | 17948 | 388533 | 34944 |
| RNF220 | 187147 | 474064 | 17949 | N/A | |
| RNF220 | 187147 | 471494 | 17950 | N/A | |
| RNF220 | 187147 | 488865 | 17951 | 475383 | 34945 |
| RNF220 | 187147 | 497469 | 17952 | N/A | |
| RNF220 | 187147 | 475378 | 17953 | N/A | |
| RNF220 | 187147 | 484745 | 17954 | N/A | |
| RNF220 | 187147 | 474394 | 17955 | N/A | |
| RNF220 | 187147 | 480686 | 17956 | N/A | |
| RNF220 | 187147 | 474956 | 17957 | N/A | |
| RNF220 | 187147 | 372247 | 17958 | 361321 | 34946 |
| RNF39 | 230332 | 451425 | 17959 | 391822 | 34947 |
| RNF39 | 230332 | 432647 | 17960 | 398512 | 34948 |
| RNF39 | 227171 | 425956 | 17961 | 393560 | 34949 |
| RNF39 | 227171 | 442378 | 17962 | 401131 | 34950 |
| RNF39 | 236967 | 441449 | 17963 | 392508 | 34951 |
| RNF39 | 236967 | 450015 | 17964 | 407291 | 34952 |
| RNF39 | 237733 | 417541 | 17965 | 407248 | 34953 |
| RNF39 | 237733 | 449145 | 17966 | 408539 | 34954 |
| RNF39 | 206500 | 376750 | 17967 | 365941 | 34955 |
| RNF39 | 206500 | 383611 | 17968 | 373106 | 34956 |
| RNF39 | 204618 | 376751 | 17969 | 365942 | 34957 |
| RNF39 | 204618 | 244360 | 17970 | 244360 | 34958 |
| RNF39 | 235022 | 456156 | 17971 | 395696 | 34959 |
| RNF39 | 235022 | 442063 | 17972 | 415281 | 34960 |
| RNF39 | 230467 | 457092 | 17973 | 405340 | 34961 |
| RNF39 | 230467 | 420562 | 17974 | 387930 | 34962 |
| RNF43 | 108375 | 407977 | 17975 | 385328 | 34963 |
| RNF43 | 108375 | 583753 | 17976 | 462502 | 34964 |
| RNF43 | 108375 | 584437 | 17977 | 463069 | 34965 |
| RNF43 | 108375 | 577716 | 17978 | 462764 | 34966 |
| RNF43 | 108375 | 577625 | 17979 | 463716 | 34967 |
| RNF43 | 108375 | 581868 | 17980 | 462447 | 34968 |
| RNF43 | 108375 | 582293 | 17981 | N/A | |
| RNF43 | 108375 | 580014 | 17982 | N/A | |
| ROBO2 | 185008 | 487694 | 17983 | 417335 | 34969 |
| ROBO2 | 185008 | 602589 | 17984 | 473268 | 34970 |
| ROBO2 | 185008 | 475034 | 17985 | N/A | |
| ROBO2 | 185008 | 461745 | 17986 | 417164 | 34971 |
| ROBO2 | 185008 | 332191 | 17987 | 327536 | 34972 |
| ROBO2 | 185008 | 473767 | 17988 | 418117 | 34973 |
| ROBO2 | 185008 | 490991 | 17989 | 418344 | 34974 |
| ROBO2 | 185008 | 471893 | 17990 | 418190 | 34975 |
| ROBO2 | 185008 | 469233 | 17991 | N/A | |

-continued

| Symbol | ENSG | ENST | SEQ ID | ENSP | SEQ ID |
|--------|------|------|--------|------|--------|
| ROBO2 | 185008 | 475334 | 17992 | 418446 | 34976 |
| ROBO2 | 185008 | 470802 | 17993 | N/A | |
| ROBO2 | 185008 | 490534 | 17994 | 417471 | 34977 |
| ROBO2 | 185008 | 614793 | 17995 | 480344 | 34978 |
| ROBO3 | 154134 | 397801 | 17996 | 380903 | 34979 |
| ROBO3 | 154134 | 538940 | 17997 | 441797 | 34980 |
| ROBO3 | 154134 | 527196 | 17998 | N/A | |
| ROBO3 | 154134 | 527245 | 17999 | N/A | |
| ROBO3 | 154134 | 529658 | 18000 | N/A | |
| ROBO3 | 154134 | 531545 | 18001 | N/A | |
| ROBO3 | 154134 | 525448 | 18002 | N/A | |
| ROBO3 | 154134 | 528144 | 18003 | N/A | |
| ROBO3 | 154134 | 531888 | 18004 | N/A | |
| ROBO3 | 154134 | 528068 | 18005 | N/A | |
| ROBO3 | 154134 | 532472 | 18006 | N/A | |
| ROBO3 | 154134 | 531119 | 18007 | N/A | |
| ROBO3 | 154134 | 530647 | 18008 | N/A | |
| ROBO3 | 154134 | 526551 | 18009 | N/A | |
| ROBO3 | 154134 | 528820 | 18010 | N/A | |
| ROBO3 | 154134 | 525482 | 18011 | N/A | |
| ROBO3 | 154134 | 534598 | 18012 | N/A | |
| ROBO3 | 154134 | 531075 | 18013 | N/A | |
| ROBO3 | 154134 | 525304 | 18014 | N/A | |
| ROBO3 | 154134 | 524971 | 18015 | N/A | |
| ROBO3 | 154134 | 543966 | 18016 | 438799 | 34981 |
| RORA | 069667 | 335670 | 18017 | 335087 | 34982 |
| RORA | 069667 | 309157 | 18018 | 309753 | 34983 |
| RORA | 069667 | 261523 | 18019 | 261523 | 34984 |
| RORA | 069667 | 449337 | 18020 | 402971 | 34985 |
| RORA | 069667 | 559587 | 18021 | N/A | |
| RORA | 069667 | 551975 | 18022 | 449482 | 34986 |
| RORA | 069667 | 560004 | 18023 | N/A | |
| RORA | 069667 | 559343 | 18024 | 453322 | 34987 |
| RORA | 069667 | 558234 | 18025 | N/A | |
| RORA | 069667 | 557822 | 18026 | N/A | |
| RORA | 069667 | 559145 | 18027 | N/A | |
| RORA | 069667 | 561093 | 18028 | N/A | |
| RORA | 069667 | 560300 | 18029 | N/A | |
| RORA | 069667 | 558904 | 18030 | 484955 | 34988 |
| RPA1 | 132383 | 571058 | 18031 | 461733 | 34989 |
| RPA1 | 132383 | 570451 | 18032 | 459788 | 34990 |
| RPA1 | 132383 | 254719 | 18033 | 254719 | 34991 |
| RPA1 | 132383 | 571725 | 18034 | N/A | |
| RPA1 | 132383 | 573924 | 18035 | N/A | |
| RPA1 | 132383 | 574049 | 18036 | 461466 | 34992 |
| RPA1 | 132383 | 573994 | 18037 | N/A | |
| RPH3A | 089169 | 549736 | 18038 | 446789 | 34993 |
| RPH3A | 089169 | 548197 | 18039 | 446570 | 34994 |
| RPH3A | 089169 | 547686 | 18040 | 449705 | 34995 |
| RPH3A | 089169 | 543106 | 18041 | 440384 | 34996 |
| RPH3A | 089169 | 551593 | 18042 | 446780 | 34997 |
| RPH3A | 089169 | 546426 | 18043 | 447639 | 34998 |
| RPH3A | 089169 | 551748 | 18044 | 447306 | 34999 |
| RPH3A | 089169 | 546703 | 18045 | 446556 | 35000 |
| RPH3A | 089169 | 547840 | 18046 | 450382 | 35001 |
| RPH3A | 089169 | 547728 | 18047 | 449613 | 35002 |
| RPH3A | 089169 | 549769 | 18048 | 447505 | 35003 |
| RPH3A | 089169 | 552667 | 18049 | 449650 | 35004 |
| RPH3A | 089169 | 389385 | 18050 | 374036 | 35005 |
| RPH3A | 089169 | 550901 | 18051 | 448100 | 35006 |
| RPH3A | 089169 | 551198 | 18052 | 447083 | 35007 |
| RPH3A | 089169 | 551052 | 18053 | 448297 | 35008 |
| RPH3A | 089169 | 415485 | 18054 | 405357 | 35009 |
| RPH3A | 089169 | 552679 | 18055 | N/A | |
| RPH3A | 089169 | 553114 | 18056 | 450216 | 35010 |
| RPH3A | 089169 | 548866 | 18057 | 450347 | 35011 |
| RPH3A | 089169 | 547099 | 18058 | 448662 | 35012 |
| RPH3A | 089169 | 547222 | 18059 | N/A | |
| RPH3A | 089169 | 549913 | 18060 | N/A | |
| RPH3A | 089169 | 552755 | 18061 | N/A | |
| RPH3A | 089169 | 546687 | 18062 | N/A | |
| RPH3A | 089169 | 552352 | 18063 | N/A | |
| RPH3A | 089169 | 549324 | 18064 | N/A | |
| RPL10 | 147403 | 492572 | 18065 | N/A | |
| RPL10 | 147403 | 369817 | 18066 | 358832 | 35013 |
| RPL10 | 147403 | 479366 | 18067 | N/A | |

-continued

| Symbol | ENSG | ENST | SEQ ID | ENSP | SEQ ID |
|---|---|---|---|---|---|
| RPL10 | 147403 | 436473 | 18068 | 388600 | 35014 |
| RPL10 | 147403 | 344746 | 18069 | 341730 | 35015 |
| RPL10 | 147403 | 489200 | 18070 | N/A | |
| RPL10 | 147403 | 491035 | 18071 | N/A | |
| RPL10 | 147403 | 458500 | 18072 | 395025 | 35016 |
| RPL10 | 147403 | 485196 | 18073 | N/A | |
| RPL10 | 147403 | 482732 | 18074 | N/A | |
| RPL10 | 147403 | 467168 | 18075 | N/A | |
| RPL10 | 147403 | 406022 | 18076 | 385621 | 35017 |
| RPL10 | 147403 | 451365 | 18077 | 406125 | 35018 |
| RPL10 | 147403 | 449494 | 18078 | 407754 | 35019 |
| RPL10 | 147403 | 427682 | 18079 | 405064 | 35020 |
| RPL10 | 147403 | 428169 | 18080 | 398047 | 35021 |
| RPL10 | 147403 | 424325 | 18081 | 413436 | 35022 |
| RPL10 | 147403 | 618723 | 18082 | 479103 | 35023 |
| RPRM | 177519 | 325926 | 18083 | 314946 | 35024 |
| RPS4Y1 | 129824 | 250784 | 18084 | 250784 | 35025 |
| RPS4Y1 | 129824 | 430575 | 18085 | 415317 | 35026 |
| RPS4Y1 | 129824 | 477725 | 18086 | N/A | |
| RPS4Y1 | 129824 | 515575 | 18087 | N/A | |
| RPS6KA1 | 281877 | 628001 | 18088 | 485797 | 35027 |
| RPS6KA1 | 281877 | 627677 | 18089 | 486119 | 35028 |
| RPS6KA1 | 281877 | 629832 | 18090 | 486881 | 35029 |
| RPS6KA1 | 281877 | 625208 | 18091 | N/A | |
| RPS6KA1 | 281877 | 630838 | 18092 | 486031 | 35030 |
| RPS6KA1 | 281877 | 631108 | 18093 | 487166 | 35031 |
| RPS6KA1 | 281877 | 629025 | 18094 | 487239 | 35032 |
| RPS6KA1 | 281877 | 628081 | 18095 | 487553 | 35033 |
| RPS6KA1 | 281877 | 625391 | 18096 | 487154 | 35034 |
| RPS6KA1 | 281877 | 628816 | 18097 | N/A | |
| RPS6KA1 | 281877 | 626401 | 18098 | 486849 | 35035 |
| RPS6KA1 | 281877 | 627022 | 18099 | N/A | |
| RPS6KA1 | 281877 | 628256 | 18100 | 487349 | 35036 |
| RPS6KA1 | 281877 | 627890 | 18101 | N/A | |
| RPS6KA1 | 281877 | 625549 | 18102 | N/A | |
| RPS6KA1 | 281877 | 627508 | 18103 | N/A | |
| RPS6KA1 | 281877 | 625911 | 18104 | N/A | |
| RPS6KA1 | 281877 | 625863 | 18105 | 486179 | 35037 |
| RPS6KA1 | 281877 | 630873 | 18106 | N/A | |
| RPS6KA1 | 281877 | 629099 | 18107 | 487207 | 35038 |
| RPS6KA1 | 117676 | 525525 | 18108 | 434616 | 35039 |
| RPS6KA1 | 117676 | 526040 | 18109 | 436990 | 35040 |
| RPS6KA1 | 117676 | 374168 | 18110 | 363283 | 35041 |
| RPS6KA1 | 117676 | 524436 | 18111 | N/A | |
| RPS6KA1 | 117676 | 374166 | 18112 | 363281 | 35042 |
| RPS6KA1 | 117676 | 526792 | 18113 | 431651 | 35043 |
| RPS6KA1 | 117676 | 529454 | 18114 | 433039 | 35044 |
| RPS6KA1 | 117676 | 530003 | 18115 | 432281 | 35045 |
| RPS6KA1 | 117676 | 366866 | 18116 | 355831 | 35046 |
| RPS6KA1 | 117676 | 531113 | 18117 | N/A | |
| RPS6KA1 | 117676 | 374163 | 18118 | 363278 | 35047 |
| RPS6KA1 | 117676 | 530607 | 18119 | N/A | |
| RPS6KA1 | 117676 | 531382 | 18120 | 435412 | 35048 |
| RPS6KA1 | 117676 | 525582 | 18121 | N/A | |
| RPS6KA1 | 117676 | 527264 | 18122 | N/A | |
| RPS6KA1 | 117676 | 474934 | 18123 | N/A | |
| RPS6KA1 | 117676 | 488985 | 18124 | N/A | |
| RPS6KA1 | 117676 | 403732 | 18125 | 383967 | 35049 |
| RPS6KA1 | 117676 | 530305 | 18126 | N/A | |
| RPS6KA1 | 117676 | 438977 | 18127 | 403548 | 35050 |
| RPS6KA5 | 100784 | 614987 | 18128 | 479667 | 35051 |
| RPS6KA5 | 100784 | 536315 | 18129 | 442803 | 35052 |
| RPS6KA5 | 100784 | 556178 | 18130 | 451305 | 35053 |
| RPS6KA5 | 100784 | 418736 | 18131 | 402787 | 35054 |
| RPS6KA5 | 100784 | 554206 | 18132 | 450591 | 35055 |
| RPS6KA5 | 100784 | 556304 | 18133 | N/A | |
| RPS6KA5 | 100784 | 556594 | 18134 | 451736 | 35056 |
| RPUSD3 | 156990 | 423108 | 18135 | 405054 | 35057 |
| RPUSD3 | 156990 | 433535 | 18136 | 398921 | 35058 |
| RPUSD3 | 156990 | 383820 | 18137 | 373331 | 35059 |
| RPUSD3 | 156990 | 464783 | 18138 | N/A | |
| RPUSD3 | 156990 | 466141 | 18139 | N/A | |
| RPUSD3 | 156990 | 424438 | 18140 | 408693 | 35060 |
| RPUSD3 | 156990 | 427174 | 18141 | 400397 | 35061 |
| RPUSD3 | 156990 | 475470 | 18142 | N/A | |
| RPUSD3 | 156990 | 484134 | 18143 | N/A | |

-continued

| Symbol | ENSG | ENST | SEQ ID | ENSP | SEQ ID |
|---|---|---|---|---|---|
| RPUSD3 | 156990 | 418713 | 18144 | 415616 | 35062 |
| RPUSD3 | 156990 | 472381 | 18145 | N/A | |
| RPUSD3 | 156990 | 433972 | 18146 | 395446 | 35063 |
| RPUSD3 | 156990 | 433555 | 18147 | 396405 | 35064 |
| RPUSD3 | 156990 | 451405 | 18148 | 395492 | 35065 |
| RPUSD3 | 156990 | 485705 | 18149 | N/A | |
| RPUSD3 | 156990 | 473522 | 18150 | N/A | |
| RPUSD3 | 156990 | 460909 | 18151 | N/A | |
| RRNAD1 | 143303 | 368218 | 18152 | 357201 | 35066 |
| RRNAD1 | 143303 | 368216 | 18153 | 357199 | 35067 |
| RRNAD1 | 143303 | 519086 | 18154 | 429756 | 35068 |
| RRNAD1 | 143303 | 524343 | 18155 | 429389 | 35069 |
| RRNAD1 | 143303 | 484742 | 18156 | 429053 | 35070 |
| RRNAD1 | 143303 | 476229 | 18157 | 430787 | 35071 |
| RRNAD1 | 143303 | 517871 | 18158 | N/A | |
| RRNAD1 | 143303 | 522237 | 18159 | 429800 | 35072 |
| RRNAD1 | 143303 | 462397 | 18160 | N/A | |
| RRNAD1 | 143303 | 497515 | 18161 | N/A | |
| RRNAD1 | 143303 | 481920 | 18162 | N/A | |
| RSPO1 | 169218 | 615459 | 18163 | 481178 | 35073 |
| RSPO1 | 169218 | 612451 | 18164 | 479832 | 35074 |
| RSPO1 | 169218 | 356545 | 18165 | 348944 | 35075 |
| RSPO1 | 169218 | 401068 | 18166 | 383846 | 35076 |
| RSPO2 | 147655 | 517939 | 18167 | 428940 | 35077 |
| RSPO2 | 147655 | 517781 | 18168 | 427937 | 35078 |
| RSPO2 | 147655 | 276659 | 18169 | 276659 | 35079 |
| RSPO2 | 147655 | 521502 | 18170 | 428614 | 35080 |
| RSPO2 | 147655 | 521757 | 18171 | 430485 | 35081 |
| RSPO2 | 147655 | 521956 | 18172 | 430010 | 35082 |
| RSPO2 | 147655 | 520026 | 18173 | 429159 | 35083 |
| RSPO2 | 147655 | 522333 | 18174 | 430973 | 35084 |
| RSPO4 | 101282 | 217260 | 18175 | 217260 | 35085 |
| RSPO4 | 101282 | 400634 | 18176 | 383475 | 35086 |
| RTN1 | 139970 | 481205 | 18177 | N/A | |
| RTN1 | 139970 | 395090 | 18178 | 378525 | 35087 |
| RTN1 | 139970 | 342503 | 18179 | 340716 | 35088 |
| RTN1 | 139970 | 267484 | 18180 | 267484 | 35089 |
| RTN1 | 139970 | 432103 | 18181 | N/A | |
| RTN1 | 139970 | 474911 | 18182 | N/A | |
| RTN1 | 139970 | 557422 | 18183 | N/A | |
| RTN1 | 139970 | 490111 | 18184 | N/A | |
| RTN1 | 139970 | 611068 | 18185 | 483039 | 35090 |
| RTN1 | 139970 | 481205 | 18186 | N/A | |
| RTN1 | 139970 | 395090 | 18187 | 378525 | 35091 |
| RTN1 | 139970 | 342503 | 18188 | 340716 | 35092 |
| RTN1 | 139970 | 267484 | 18189 | 267484 | 35093 |
| RTN1 | 139970 | 432103 | 18190 | N/A | |
| RTN1 | 139970 | 474911 | 18191 | N/A | |
| RTN1 | 139970 | 557422 | 18192 | N/A | |
| RTN1 | 139970 | 490111 | 18193 | N/A | |
| RTN1 | 139970 | 611068 | 18194 | 483039 | 35094 |
| RTN4R | 040608 | 416372 | 18195 | 396872 | 35095 |
| RTN4R | 040608 | 043402 | 18196 | 043402 | 35096 |
| RTN4R | 040608 | 425986 | 18197 | 403535 | 35097 |
| RTN4R | 040608 | 469601 | 18198 | N/A | |
| RTN4R | 040608 | 474642 | 18199 | N/A | |
| RTN4R | 040608 | 463936 | 18200 | N/A | |
| RTN4RL1 | 185924 | 331238 | 18201 | 330631 | 35098 |
| RTN4RL2 | 186907 | 335099 | 18202 | 335397 | 35099 |
| RTN4RL2 | 186907 | 533205 | 18203 | 435606 | 35100 |
| RTN4RL2 | 186907 | 395120 | 18204 | 378552 | 35101 |
| RUBCNL | 102445 | 389908 | 18205 | 374558 | 35102 |
| RUBCNL | 102445 | 487195 | 18206 | N/A | |
| RUBCNL | 102445 | 378784 | 18207 | 368061 | 35103 |
| RUBCNL | 102445 | 441284 | 18208 | 412507 | 35104 |
| RUBCNL | 102445 | 378787 | 18209 | 368064 | 35105 |
| RUBCNL | 102445 | 409879 | 18210 | 386578 | 35106 |
| RUBCNL | 102445 | 631139 | 18211 | 485932 | 35107 |
| RUBCNL | 102445 | 417405 | 18212 | 402357 | 35108 |
| RUBCNL | 102445 | 439642 | 18213 | 414579 | 35109 |
| RUBCNL | 102445 | 378797 | 18214 | 368074 | 35110 |
| RUBCNL | 102445 | 378781 | 18215 | 368057 | 35111 |
| RUBCNL | 102445 | 429979 | 18216 | 396935 | 35112 |
| RUNX1T1 | 079102 | 523629 | 18217 | 428543 | 35113 |
| RUNX1T1 | 079102 | 396218 | 18218 | 379520 | 35114 |
| RUNX1T1 | 079102 | 360348 | 18219 | 353504 | 35115 |

-continued

-continued

| Symbol | ENSG | ENST | SEQ ID | ENSP | SEQ ID |
|---|---|---|---|---|---|
| RUNX1T1 | 079102 | 422361 | 18220 | 390137 | 35116 |
| RUNX1T1 | 079102 | 520724 | 18221 | 428742 | 35117 |
| RUNX1T1 | 079102 | 521078 | 18222 | N/A | |
| RUNX1T1 | 079102 | 518844 | 18223 | 430728 | 35118 |
| RUNX1T1 | 079102 | 521751 | 18224 | 430778 | 35119 |
| RUNX1T1 | 079102 | 520978 | 18225 | 429085 | 35120 |
| RUNX1T1 | 079102 | 518361 | 18226 | 430863 | 35121 |
| RUNX1T1 | 079102 | 520047 | 18227 | N/A | |
| RUNX1T1 | 079102 | 521553 | 18228 | 429728 | 35122 |
| RUNX1T1 | 079102 | 522316 | 18229 | N/A | |
| RUNX1T1 | 079102 | 518992 | 18230 | 431094 | 35123 |
| RUNX1T1 | 079102 | 521054 | 18231 | 427763 | 35124 |
| RUNX1T1 | 079102 | 523290 | 18232 | N/A | |
| RUNX1T1 | 079102 | 519847 | 18233 | 430204 | 35125 |
| RUNX1T1 | 079102 | 517792 | 18234 | 429940 | 35126 |
| RUNX1T1 | 079102 | 522467 | 18235 | 429532 | 35127 |
| RUNX1T1 | 079102 | 517919 | 18236 | 429506 | 35128 |
| RUNX1T1 | 079102 | 521733 | 18237 | 430637 | 35129 |
| RUNX1T1 | 079102 | 520556 | 18238 | 428100 | 35130 |
| RUNX1T1 | 079102 | 521319 | 18239 | 429137 | 35131 |
| RUNX1T1 | 079102 | 520583 | 18240 | 430070 | 35132 |
| RUNX1T1 | 079102 | 523168 | 18241 | 429118 | 35133 |
| RUNX1T1 | 079102 | 519577 | 18242 | 430084 | 35134 |
| RUNX1T1 | 079102 | 518823 | 18243 | 428475 | 35135 |
| RUNX1T1 | 079102 | 521897 | 18244 | 429653 | 35136 |
| RUNX1T1 | 079102 | 518317 | 18245 | 429062 | 35137 |
| RUNX1T1 | 079102 | 521375 | 18246 | 429666 | 35138 |
| RUNX1T1 | 079102 | 519422 | 18247 | 429587 | 35139 |
| RUNX1T1 | 079102 | 524215 | 18248 | 429034 | 35140 |
| RUNX1T1 | 079102 | 520974 | 18249 | 429375 | 35141 |
| RUNX1T1 | 079102 | 518832 | 18250 | 429864 | 35142 |
| RUNX1T1 | 079102 | 520172 | 18251 | N/A | |
| RUNX1T1 | 079102 | 517493 | 18252 | N/A | |
| RUNX1T1 | 079102 | 522065 | 18253 | N/A | |
| RUNX1T1 | 079102 | 518954 | 18254 | 430080 | 35143 |
| RUNX1T1 | 079102 | 519061 | 18255 | 430334 | 35144 |
| RUNX1T1 | 079102 | 518256 | 18256 | N/A | |
| RUNX1T1 | 079102 | 520428 | 18257 | 429857 | 35145 |
| RUNX1T1 | 079102 | 522163 | 18258 | N/A | |
| RUNX1T1 | 079102 | 521902 | 18259 | N/A | |
| RUNX1T1 | 079102 | 522860 | 18260 | N/A | |
| RUNX1T1 | 079102 | 518449 | 18261 | 428133 | 35146 |
| RUNX1T1 | 079102 | 613886 | 18262 | 478331 | 35147 |
| RUNX1T1 | 079102 | 617740 | 18263 | 481112 | 35148 |
| RUNX1T1 | 079102 | 613302 | 18264 | 481799 | 35149 |
| RUNX1T1 | 079102 | 615601 | 18265 | 480500 | 35150 |
| RUNX1T1 | 079102 | 436581 | 18266 | 402257 | 35151 |
| RUNX1T1 | 079102 | 614812 | 18267 | 481315 | 35152 |
| RUNX1T1 | 079102 | 265814 | 18268 | 265814 | 35153 |
| RUVBL2 | 183207 | 595090 | 18269 | 473172 | 35154 |
| RUVBL2 | 183207 | 601968 | 18270 | 471524 | 35155 |
| RUVBL2 | 183207 | 596837 | 18271 | 469189 | 35156 |
| RUVBL2 | 183207 | 595811 | 18272 | 469760 | 35157 |
| RUVBL2 | 183207 | 594017 | 18273 | N/A | |
| RUVBL2 | 183207 | 598768 | 18274 | N/A | |
| RUVBL2 | 183207 | 596247 | 18275 | 471538 | 35158 |
| RUVBL2 | 183207 | 221413 | 18276 | 221413 | 35159 |
| RUVBL2 | 183207 | 593570 | 18277 | 469488 | 35160 |
| RUVBL2 | 183207 | 594338 | 18278 | N/A | |
| RUVBL2 | 183207 | 595002 | 18279 | N/A | |
| RUVBL2 | 183207 | 627972 | 18280 | 486242 | 35161 |
| RUVBL2 | 183207 | 640699 | 18281 | 492610 | 35162 |
| RUVBL2 | 183207 | 639391 | 18282 | 492564 | 35163 |
| RXFP1 | 171509 | 460056 | 18283 | 423306 | 35164 |
| RXFP1 | 171509 | 472969 | 18284 | N/A | |
| RXFP1 | 171509 | 307765 | 18285 | 303248 | 35165 |
| RXFP1 | 171509 | 342048 | 18286 | 432036 | 35166 |
| RXFP1 | 171509 | 471616 | 18287 | 434475 | 35167 |
| RXFP1 | 171509 | 343542 | 18288 | 345889 | 35168 |
| RXFP1 | 171509 | 470033 | 18289 | 420712 | 35169 |
| RXFP1 | 171509 | 484785 | 18290 | N/A | |
| RXFP1 | 171509 | 613319 | 18291 | 480522 | 35170 |
| RXFP1 | 171509 | 423548 | 18292 | 405841 | 35171 |
| RXFP1 | 171509 | 448688 | 18293 | 414885 | 35172 |
| RYR1 | 196218 | 355481 | 18294 | 347667 | 35173 |
| RYR1 | 196218 | 359596 | 18295 | 352608 | 35174 |

| Symbol | ENSG | ENST | SEQ ID | ENSP | SEQ ID |
|---|---|---|---|---|---|
| RYR1 | 196218 | 594111 | 18296 | N/A | |
| RYR1 | 196218 | 594335 | 18297 | 470927 | 35175 |
| RYR1 | 196218 | 599547 | 18298 | 471601 | 35176 |
| RYR1 | 196218 | 600337 | 18299 | N/A | |
| RYR1 | 196218 | 601514 | 18300 | 472497 | 35177 |
| RYR1 | 196218 | 596431 | 18301 | 470848 | 35178 |
| RYR1 | 196218 | 593322 | 18302 | 471404 | 35179 |
| RYR1 | 196218 | 593677 | 18303 | 472126 | 35180 |
| RYR2 | 198626 | 366574 | 18304 | 355533 | 35181 |
| RYR2 | 198626 | 609119 | 18305 | N/A | |
| RYR2 | 198626 | 609253 | 18306 | N/A | |
| RYR2 | 198626 | 608590 | 18307 | N/A | |
| RYR2 | 198626 | 466626 | 18308 | N/A | |
| RYR2 | 198626 | 462585 | 18309 | N/A | |
| RYR2 | 198626 | 360064 | 18310 | 353174 | 35182 |
| RYR3 | 198838 | 634891 | 18311 | 489262 | 35183 |
| RYR3 | 198838 | 415757 | 18312 | 399610 | 35184 |
| RYR3 | 198838 | 389232 | 18313 | 373884 | 35185 |
| RYR3 | 198838 | 634418 | 18314 | 489529 | 35186 |
| RYR3 | 198838 | 634750 | 18315 | 489294 | 35187 |
| RYR3 | 198838 | 635875 | 18316 | N/A | |
| RYR3 | 198838 | 636753 | 18317 | N/A | |
| RYR3 | 198838 | 636583 | 18318 | N/A | |
| RYR3 | 198838 | 635790 | 18319 | 489672 | 35188 |
| RYR3 | 198838 | 636417 | 18320 | N/A | |
| RYR3 | 198838 | 637201 | 18321 | N/A | |
| RYR3 | 198838 | 638085 | 18322 | N/A | |
| RYR3 | 198838 | 638038 | 18323 | N/A | |
| RYR3 | 198838 | 557931 | 18324 | N/A | |
| RYR3 | 198838 | 558060 | 18325 | N/A | |
| RYR3 | 198838 | 638145 | 18326 | N/A | |
| RYR3 | 198838 | 635749 | 18327 | N/A | |
| RYR3 | 198838 | 635842 | 18328 | 490438 | 35189 |
| RYR3 | 198838 | 638032 | 18329 | 489937 | 35190 |
| RYR3 | 198838 | 637948 | 18330 | 489832 | 35191 |
| RYR3 | 198838 | 636845 | 18331 | 490033 | 35192 |
| RYR3 | 198838 | 634730 | 18332 | 489346 | 35193 |
| RYR3 | 198838 | 637984 | 18333 | N/A | |
| RYR3 | 198838 | 637615 | 18334 | N/A | |
| RYR3 | 198838 | 638052 | 18335 | N/A | |
| RYR3 | 198838 | 636656 | 18336 | N/A | |
| RYR3 | 198838 | 636568 | 18337 | 490632 | 35194 |
| RYR3 | 198838 | 637522 | 18338 | N/A | |
| RYR3 | 198838 | 559917 | 18339 | N/A | |
| RYR3 | 198838 | 559333 | 18340 | N/A | |
| RYR3 | 198838 | 637072 | 18341 | N/A | |
| RYR3 | 198838 | 560791 | 18342 | N/A | |
| RYR3 | 198838 | 636497 | 18343 | N/A | |
| RYR3 | 198838 | 636878 | 18344 | N/A | |
| RYR3 | 198838 | 622037 | 18345 | 483166 | 35195 |
| S100A4 | 196154 | 368715 | 18346 | 357704 | 35196 |
| S100A4 | 196154 | 481009 | 18347 | N/A | |
| S100A4 | 196154 | 354332 | 18348 | 346294 | 35197 |
| S100A4 | 196154 | 468373 | 18349 | N/A | |
| S100A4 | 196154 | 368716 | 18350 | 357705 | 35198 |
| S100A4 | 196154 | 368714 | 18351 | 357703 | 35199 |
| S100B | 160307 | 291700 | 18352 | 291700 | 35200 |
| S100B | 160307 | 367071 | 18353 | 356038 | 35201 |
| S100B | 160307 | 397648 | 18354 | 380769 | 35202 |
| S1PR1 | 170989 | 305352 | 18355 | 305416 | 35203 |
| S1PR1 | 170989 | 475821 | 18356 | N/A | |
| S1PR1 | 170989 | 475289 | 18357 | N/A | |
| S1PR5 | 180739 | 333430 | 18358 | 328472 | 35204 |
| S1PR5 | 180739 | 439028 | 18359 | 416915 | 35205 |
| S1PR5 | 180739 | 590601 | 18360 | 464884 | 35206 |
| S1PR5 | 180739 | 617721 | 18361 | 481239 | 35207 |
| SALL1 | 103449 | 251020 | 18362 | 251020 | 35208 |
| SALL1 | 103449 | 566102 | 18363 | 455582 | 35209 |
| SALL1 | 103449 | 570206 | 18364 | 456777 | 35210 |
| SALL1 | 103449 | 562674 | 18365 | N/A | |
| SALL1 | 103449 | 440970 | 18366 | 407914 | 35211 |
| SAMD12 | 177570 | 453675 | 18367 | 402786 | 35212 |
| SAMD12 | 177570 | 524796 | 18368 | 435927 | 35213 |
| SAMD12 | 177570 | 445741 | 18369 | 387605 | 35214 |
| SAMD12 | 177570 | 527515 | 18370 | N/A | |
| SAMD12 | 177570 | 314727 | 18371 | 314173 | 35215 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| SAMD12 | 177570 | 526328 | 18372 | 431360 | 35216 | 5 | SCGN | 079689 | 377961 | 18448 | 367197 | 35272 |
| SAMD12 | 177570 | 526765 | 18373 | 434079 | 35217 | | SCGN | 079689 | 612225 | 18449 | 484392 | 35273 |
| SAMD12 | 177570 | 409003 | 18374 | 387133 | 35218 | | SCGN | 079689 | 334979 | 18450 | 333933 | 35274 |
| SAMD9L | 177409 | 318238 | 18375 | 326247 | 35219 | | SCHLAP1 | 281131 | 629145 | 18451 | N/A | |
| SAMD9L | 177409 | 411955 | 18376 | 405760 | 35220 | | SCN1A | 144285 | 641996 | 18452 | 493054 | 35275 |
| SAMD9L | 177409 | 437805 | 18377 | 408796 | 35221 | | SCN1A | 144285 | 641575 | 18453 | 492917 | 35276 |
| SAMD9L | 177409 | 446959 | 18378 | 391699 | 35222 | 10 | SCN1A | 144285 | 641603 | 18454 | 492945 | 35277 |
| SAMD9L | 177409 | 439952 | 18379 | 391387 | 35223 | | SCN1A | 144285 | 640036 | 18455 | 491573 | 35278 |
| SAMD9L | 177409 | 414791 | 18380 | 396137 | 35224 | | SCN1A | 144285 | 637988 | 18456 | 490780 | 35279 |
| SAMD9L | 177409 | 446033 | 18381 | 410062 | 35225 | | SCN1A | 144285 | 635776 | 18457 | 490692 | 35280 |
| SAMD9L | 177409 | 477816 | 18382 | N/A | | | SCN1A | 144285 | 636194 | 18458 | 490288 | 35281 |
| SAMD9L | 177409 | 610760 | 18383 | 484397 | 35226 | | SCN1A | 144285 | 303395 | 18459 | 303540 | 35282 |
| SAPCD2 | 186193 | 409687 | 18384 | 386348 | 35227 | 15 | SCN1A | 144285 | 635750 | 18460 | 490799 | 35283 |
| SAT1 | 130066 | 379251 | 18385 | 368553 | 35228 | | SCN1A | 144285 | 375405 | 18461 | 364554 | 35284 |
| SAT1 | 130066 | 379253 | 18386 | 368555 | 35229 | | SCN1A | 144285 | 637038 | 18462 | 490184 | 35285 |
| SAT1 | 130066 | 379254 | 18387 | 368556 | 35230 | | SCN1A | 144285 | 409050 | 18463 | 386312 | 35286 |
| SAT1 | 130066 | 379270 | 18388 | 368572 | 35231 | | SCN1A | 144285 | 625916 | 18464 | N/A | |
| SAT1 | 130066 | 489394 | 18389 | N/A | | | SCN1A | 144285 | 473295 | 18465 | N/A | |
| SAT1 | 130066 | 463236 | 18390 | N/A | | 20 | SCN1A | 144285 | 491429 | 18466 | N/A | |
| SAT1 | 130066 | 487713 | 18391 | N/A | | | SCN1A | 144285 | 635893 | 18467 | 489986 | 35287 |
| SAT1 | 130066 | 474223 | 18392 | N/A | | | SCN1A | 144285 | 637968 | 18468 | N/A | |
| SAT1 | 130066 | 462639 | 18393 | N/A | | | SCN1A | 144285 | 636759 | 18469 | 490895 | 35288 |
| SBDS | 126524 | 246868 | 18394 | 246868 | 35232 | | SCN1A | 144285 | 642141 | 18470 | N/A | |
| SBDS | 126524 | 414306 | 18395 | 394586 | 35233 | | SCN1A | 144285 | 507401 | 18471 | N/A | |
| SBDS | 126524 | 490953 | 18396 | N/A | | 25 | SCN1A | 144285 | 637285 | 18472 | 490612 | 35289 |
| SBDS | 126524 | 463579 | 18397 | N/A | | | SCN1A | 144285 | 423058 | 18473 | 407030 | 35290 |
| SBDS | 126524 | 617799 | 18398 | 483040 | 35234 | | SCN2A | 136531 | 640791 | 18474 | N/A | |
| SBNO2 | 064932 | 361757 | 18399 | 354733 | 35235 | | SCN2A | 136531 | 636384 | 18475 | 490765 | 35291 |
| SBNO2 | 064932 | 438103 | 18400 | 400762 | 35236 | | SCN2A | 136531 | 424833 | 18476 | 406454 | 35292 |
| SBNO2 | 064932 | 587024 | 18401 | 468520 | 35237 | | SCN2A | 136531 | 636071 | 18477 | 490107 | 35293 |
| SBNO2 | 064932 | 587673 | 18402 | N/A | | | SCN2A | 136531 | 637367 | 18478 | 490592 | 35294 |
| SBNO2 | 064932 | 586109 | 18403 | N/A | | 30 | SCN2A | 136531 | 635945 | 18479 | N/A | |
| SBNO2 | 064932 | 592222 | 18404 | N/A | | | SCN2A | 136531 | 636985 | 18480 | 490849 | 35295 |
| SBNO2 | 064932 | 590446 | 18405 | N/A | | | SCN2A | 136531 | 631182 | 18481 | 486885 | 35296 |
| SBNO2 | 064932 | 590998 | 18406 | 468534 | 35238 | | SCN2A | 136531 | 636135 | 18482 | 489821 | 35297 |
| SBNO2 | 064932 | 590176 | 18407 | 466861 | 35239 | | SCN2A | 136531 | 638151 | 18483 | N/A | |
| SBNO2 | 064932 | 587655 | 18408 | 468302 | 35240 | | SCN2A | 136531 | 637266 | 18484 | 490866 | 35298 |
| SBNO2 | 278788 | 631948 | 18409 | 488808 | 35241 | 35 | SCN2A | 136531 | 283256 | 18485 | 283256 | 35299 |
| SBNO2 | 278788 | 622719 | 18410 | 482802 | 35242 | | SCN2A | 136531 | 636662 | 18486 | 489873 | 35300 |
| SBNO2 | 278788 | 634172 | 18411 | 488286 | 35243 | | SCN2A | 136531 | 480032 | 18487 | N/A | |
| SBNO2 | 278788 | 631689 | 18412 | N/A | | | SCN2A | 136531 | 636769 | 18488 | 490800 | 35301 |
| SBNO2 | 278788 | 632999 | 18413 | N/A | | | SCN2A | 136531 | 486878 | 18489 | 487466 | 35302 |
| SBNO2 | 278788 | 631752 | 18414 | N/A | | | SCN2A | 136531 | 375437 | 18490 | 364586 | 35303 |
| SBNO2 | 278788 | 631951 | 18415 | N/A | | 40 | SCN2A | 136531 | 375427 | 18491 | 364576 | 35304 |
| SBNO2 | 278788 | 632777 | 18416 | 488832 | 35244 | | SCN2B | 149575 | 278947 | 18492 | 278947 | 35305 |
| SBNO2 | 278788 | 633604 | 18417 | 488079 | 35245 | | SCN4B | 177098 | 415030 | 18493 | N/A | |
| SBNO2 | 278788 | 631778 | 18418 | 488056 | 35246 | | SCN4B | 177098 | 324727 | 18494 | 322460 | 35306 |
| SBNO2 | 278788 | 612198 | 18419 | 477651 | 35247 | | SCN4B | 177098 | 423160 | 18495 | N/A | |
| SCAMP5 | 198794 | 568423 | 18420 | 457520 | 35248 | | SCN4B | 177098 | 531550 | 18496 | N/A | |
| SCAMP5 | 198794 | 425597 | 18421 | 406547 | 35249 | | SCN4B | 177098 | 529878 | 18497 | 436343 | 35307 |
| SCAMP5 | 198794 | 562327 | 18422 | 456505 | 35250 | 45 | SCN4B | 177098 | 532138 | 18498 | N/A | |
| SCAMP5 | 198794 | 568018 | 18423 | 456991 | 35251 | | SCN9A | 169432 | 409672 | 18499 | 386306 | 35308 |
| SCAMP5 | 198794 | 562212 | 18424 | 455313 | 35252 | | SCN9A | 169432 | 409435 | 18500 | 386330 | 35309 |
| SCAMP5 | 198794 | 565923 | 18425 | N/A | | | SCN9A | 169432 | 454569 | 18501 | 413212 | 35310 |
| SCAMP5 | 198794 | 567920 | 18426 | 454860 | 35253 | | SCN9A | 169432 | 452182 | 18502 | 393141 | 35311 |
| SCAMP5 | 198794 | 562765 | 18427 | 455598 | 35254 | | SCN9A | 169432 | 472119 | 18503 | N/A | |
| SCAMP5 | 198794 | 567535 | 18428 | N/A | | 50 | SCN9A | 169432 | 303354 | 18504 | 304748 | 35312 |
| SCAMP5 | 198794 | 566872 | 18429 | 454766 | 35255 | | SCNN1G | 166828 | 300061 | 18505 | 300061 | 35313 |
| SCAMP5 | 198794 | 564491 | 18430 | 458072 | 35256 | | SCRT1 | 261678 | 569446 | 18506 | 455711 | 35314 |
| SCAMP5 | 198794 | 361900 | 18431 | 355387 | 35257 | | SCUBE1 | 159307 | 360835 | 18507 | 354080 | 35315 |
| SCAMP5 | 198794 | 564141 | 18432 | N/A | | | SCUBE1 | 159307 | 449304 | 18508 | 395327 | 35316 |
| SCAMP5 | 198794 | 568119 | 18433 | 457444 | 35258 | | SCUBE1 | 159307 | 290460 | 18509 | 290460 | 35317 |
| SCAMP5 | 198794 | 565989 | 18434 | 457121 | 35259 | 55 | SCUBE1 | 159307 | 477991 | 18510 | N/A | |
| SCAMP5 | 198794 | 564779 | 18435 | 455039 | 35260 | | SCUBE1 | 159307 | 470433 | 18511 | N/A | |
| SCAMP5 | 198794 | 567529 | 18436 | 455203 | 35261 | | SCUBE1 | 159307 | 461595 | 18512 | N/A | |
| SCAMP5 | 198794 | 568081 | 18437 | 454602 | 35262 | | SCUBE1 | 159307 | 480833 | 18513 | N/A | |
| SCARA3 | 168077 | 337221 | 18438 | 337985 | 35263 | | SCUBE1 | 159307 | 615096 | 18514 | 484780 | 35318 |
| SCARA3 | 168077 | 301904 | 18439 | 301904 | 35264 | | SDC1 | 115884 | 254351 | 18515 | 254351 | 35319 |
| SCEL | 136155 | 471491 | 18440 | 432840 | 35265 | 60 | SDC1 | 115884 | 403076 | 18516 | 384613 | 35320 |
| SCEL | 136155 | 377246 | 18441 | 366454 | 35266 | | SDC1 | 115884 | 429035 | 18517 | 400773 | 35321 |
| SCEL | 136155 | 349847 | 18442 | 302579 | 35267 | | SDC1 | 115884 | 482879 | 18518 | N/A | |
| SCEL | 136155 | 469982 | 18443 | N/A | | | SDC1 | 115884 | 447124 | 18519 | 390201 | 35322 |
| SCEL | 136155 | 535157 | 18444 | 437895 | 35268 | | SDC1 | 115884 | 381150 | 18520 | 370542 | 35323 |
| SCG3 | 104112 | 220478 | 18445 | 220478 | 35269 | | SDC3 | 162512 | 336798 | 18521 | 338346 | 35324 |
| SCG3 | 104112 | 542355 | 18446 | 445205 | 35270 | 65 | SDC3 | 162512 | 339394 | 18522 | 344468 | 35325 |
| SCG3 | 104112 | 558709 | 18447 | 452745 | 35271 | | SDC3 | 162512 | 471567 | 18523 | N/A | |

-continued

| Symbol | ENSG | ENST | SEQ ID | ENSP | SEQ ID |
|---|---|---|---|---|---|
| SDC3 | 162512 | 487984 | 18524 | N/A | |
| SDC4 | 124145 | 372733 | 18525 | 361818 | 35326 |
| SDK1 | 146555 | 404826 | 18526 | 385899 | 35327 |
| SDK1 | 146555 | 389531 | 18527 | 374182 | 35328 |
| SDK1 | 146555 | 426596 | 18528 | 404118 | 35329 |
| SDK1 | 146555 | 478527 | 18529 | N/A | |
| SDK1 | 146555 | 484011 | 18530 | N/A | |
| SDK1 | 146555 | 476701 | 18531 | N/A | |
| SDK1 | 146555 | 481856 | 18532 | N/A | |
| SDK1 | 146555 | 466611 | 18533 | N/A | |
| SDK1 | 146555 | 467827 | 18534 | N/A | |
| SDK1 | 146555 | 615806 | 18535 | 478062 | 35330 |
| SEC14L5 | 103184 | 251170 | 18536 | 251170 | 35331 |
| SEC14L5 | 103184 | 587469 | 18537 | 468423 | 35332 |
| SEC24D | 150961 | 280551 | 18538 | 280551 | 35333 |
| SEC24D | 150961 | 505134 | 18539 | N/A | |
| SEC24D | 150961 | 511481 | 18540 | 425491 | 35334 |
| SEC24D | 150961 | 502830 | 18541 | N/A | |
| SEC24D | 150961 | 511715 | 18542 | N/A | |
| SEC24D | 150961 | 514561 | 18543 | 422717 | 35335 |
| SEC24D | 150961 | 502526 | 18544 | N/A | |
| SEC24D | 150961 | 511033 | 18545 | N/A | |
| SEC24D | 150961 | 509818 | 18546 | 424085 | 35336 |
| SEC24D | 150961 | 514418 | 18547 | N/A | |
| SEC24D | 150961 | 506622 | 18548 | 427249 | 35337 |
| SEC24D | 150961 | 503683 | 18549 | 426309 | 35338 |
| SEC24D | 150961 | 505280 | 18550 | N/A | |
| SEC24D | 150961 | 419654 | 18551 | 388324 | 35339 |
| SEL1L3 | 091490 | 399878 | 18552 | 382767 | 35340 |
| SEL1L3 | 091490 | 264868 | 18553 | 264868 | 35341 |
| SEL1L3 | 091490 | 513416 | 18554 | N/A | |
| SEL1L3 | 091490 | 512286 | 18555 | N/A | |
| SEL1L3 | 091490 | 502949 | 18556 | 425438 | 35342 |
| SEL1L3 | 091490 | 510448 | 18557 | 421701 | 35343 |
| SEL1L3 | 091490 | 507618 | 18558 | 426050 | 35344 |
| SEL1L3 | 091490 | 509290 | 18559 | N/A | |
| SEL1L3 | 091490 | 514321 | 18560 | 424564 | 35345 |
| SEL1L3 | 091490 | 513364 | 18561 | N/A | |
| SEL1L3 | 091490 | 510880 | 18562 | 423743 | 35346 |
| SEL1L3 | 091490 | 513691 | 18563 | 421567 | 35347 |
| SEL1L3 | 091490 | 514872 | 18564 | 420951 | 35348 |
| SELENOK | 113811 | 495461 | 18565 | 418813 | 35349 |
| SELENOK | 113811 | 488746 | 18566 | 417272 | 35350 |
| SELENOK | 113811 | 487571 | 18567 | N/A | |
| SELENOK | 113811 | 485414 | 18568 | N/A | |
| SELENOK | 113811 | 541726 | 18569 | 443164 | 35351 |
| SELENOM | 198832 | 402395 | 18570 | 384564 | 35352 |
| SELENOM | 198832 | 490967 | 18571 | N/A | |
| SELENOM | 198832 | 400299 | 18572 | 383155 | 35353 |
| SELENOM | 198832 | 465536 | 18573 | N/A | |
| SELENOM | 198832 | 491958 | 18574 | N/A | |
| SELENOM | 198832 | 495533 | 18575 | N/A | |
| SELENOM | 198832 | 460642 | 18576 | N/A | |
| SELENOM | 198832 | 469262 | 18577 | N/A | |
| SELENOM | 198832 | 465447 | 18578 | N/A | |
| SELENOM | 198832 | 611680 | 18579 | 480176 | 35354 |
| SELPLG | 110876 | 550948 | 18580 | 447752 | 35355 |
| SELPLG | 110876 | 228463 | 18581 | 228463 | 35356 |
| SELPLG | 110876 | 388962 | 18582 | 373614 | 35357 |
| SEMA3B | 012171 | 621029 | 18583 | 482586 | 35358 |
| SEMA3B | 012171 | 619119 | 18584 | N/A | |
| SEMA3B | 012171 | 616701 | 18585 | 484146 | 35359 |
| SEMA3B | 012171 | 612509 | 18586 | N/A | |
| SEMA3B | 012171 | 433753 | 18587 | 485281 | 35360 |
| SEMA3B | 012171 | 611067 | 18588 | 480680 | 35361 |
| SEMA3B | 012171 | 441915 | 18589 | N/A | |
| SEMA3B | 012171 | 456560 | 18590 | 485646 | 35362 |
| SEMA3B | 012171 | 439487 | 18591 | N/A | |
| SEMA3B | 012171 | 434030 | 18592 | N/A | |
| SEMA3B | 012171 | 456210 | 18593 | N/A | |
| SEMA3B | 012171 | 418576 | 18594 | 485173 | 35363 |
| SEMA3B | 012171 | 419007 | 18595 | N/A | |
| SEMA3B | 012171 | 416295 | 18596 | N/A | |
| SEMA3B | 012171 | 618865 | 18597 | 481957 | 35364 |
| SEMA3C | 075223 | 265361 | 18598 | 265361 | 35365 |
| SEMA3C | 075223 | 419255 | 18599 | 411193 | 35366 |

-continued

| Symbol | ENSG | ENST | SEQ ID | ENSP | SEQ ID |
|---|---|---|---|---|---|
| SEMA3C | 075223 | 458729 | 18600 | 393825 | 35367 |
| SEMA3C | 075223 | 475955 | 18601 | N/A | |
| SEMA3C | 075223 | 459652 | 18602 | N/A | |
| SEMA3C | 075223 | 411788 | 18603 | 395398 | 35368 |
| SEMA3C | 075223 | 427167 | 18604 | 399891 | 35369 |
| SEMA3C | 075223 | 487621 | 18605 | N/A | |
| SEMA3C | 075223 | 470581 | 18606 | N/A | |
| SEMA3D | 153993 | 284136 | 18607 | 284136 | 35370 |
| SEMA3D | 153993 | 484038 | 18608 | N/A | |
| SEMA3D | 153993 | 463315 | 18609 | N/A | |
| SEMA3D | 153993 | 444867 | 18610 | 401366 | 35371 |
| SEMA3E | 170381 | 307792 | 18611 | 303212 | 35372 |
| SEMA3E | 170381 | 427262 | 18612 | 405052 | 35373 |
| SEMA3E | 170381 | 442159 | 18613 | 412867 | 35374 |
| SEMA3E | 170381 | 453333 | 18614 | 415184 | 35375 |
| SEMA3G | 010319 | 231721 | 18615 | 231721 | 35376 |
| SEMA3G | 010319 | 465657 | 18616 | 420291 | 35377 |
| SEMA3G | 010319 | 475739 | 18617 | 419181 | 35378 |
| SEMA4D | 187764 | 537934 | 18618 | 446394 | 35379 |
| SEMA4D | 187764 | 450295 | 18619 | 416523 | 35380 |
| SEMA4D | 187764 | 438547 | 18620 | 405102 | 35381 |
| SEMA4D | 187764 | 422704 | 18621 | 388768 | 35382 |
| SEMA4D | 187764 | 486935 | 18622 | N/A | |
| SEMA4D | 187764 | 540183 | 18623 | N/A | |
| SEMA4D | 187764 | 544513 | 18624 | N/A | |
| SEMA4D | 187764 | 474258 | 18625 | N/A | |
| SEMA4D | 187764 | 420681 | 18626 | 390754 | 35383 |
| SEMA4D | 187764 | 433650 | 18627 | 413352 | 35384 |
| SEMA4D | 187764 | 540475 | 18628 | 438389 | 35385 |
| SEMA4D | 187764 | 418828 | 18629 | 416747 | 35386 |
| SEMA4D | 187764 | 420670 | 18630 | 405652 | 35387 |
| SEMA4D | 187764 | 464051 | 18631 | N/A | |
| SEMA4D | 187764 | 482128 | 18632 | N/A | |
| SEMA4D | 187764 | 356444 | 18633 | 348822 | 35388 |
| SEMA4D | 187764 | 420987 | 18634 | 391733 | 35389 |
| SEMA4D | 187764 | 339861 | 18635 | 344923 | 35390 |
| SEMA4D | 187764 | 492386 | 18636 | N/A | |
| SEMA4D | 187764 | 420101 | 18637 | 399948 | 35391 |
| SEMA4D | 187764 | 475255 | 18638 | N/A | |
| SEMA4D | 187764 | 469653 | 18639 | N/A | |
| SEMA4D | 187764 | 455551 | 18640 | 411981 | 35392 |
| SEMA4D | 187764 | 429836 | 18641 | 395222 | 35393 |
| SEMA4G | 095539 | 519649 | 18642 | 428896 | 35394 |
| SEMA4G | 095539 | 521006 | 18643 | 430881 | 35395 |
| SEMA4G | 095539 | 518124 | 18644 | 430103 | 35396 |
| SEMA4G | 095539 | 518244 | 18645 | N/A | |
| SEMA4G | 095539 | 370250 | 18646 | 359270 | 35397 |
| SEMA4G | 095539 | 517724 | 18647 | 430175 | 35398 |
| SEMA4G | 095539 | 210633 | 18648 | 210633 | 35399 |
| SEMA4G | 095539 | 519756 | 18649 | N/A | |
| SEMA4G | 095539 | 518948 | 18650 | N/A | |
| SEMA4G | 095539 | 476171 | 18651 | 429888 | 35400 |
| SEMA4G | 095539 | 484128 | 18652 | N/A | |
| SEMA4G | 095539 | 613292 | 18653 | 479499 | 35401 |
| SEMA5A | 112902 | 382496 | 18654 | 371936 | 35402 |
| SEMA5A | 112902 | 514923 | 18655 | N/A | |
| SEMA5A | 112902 | 513968 | 18656 | 421961 | 35403 |
| SEMA5A | 112902 | 509486 | 18657 | N/A | |
| SEMA5B | 082684 | 451541 | 18658 | 400828 | 35404 |
| SEMA5B | 082684 | 357559 | 18659 | 350215 | 35405 |
| SEMA5B | 082684 | 475244 | 18660 | 417570 | 35406 |
| SEMA5B | 082684 | 393583 | 18661 | 377208 | 35407 |
| SEMA5B | 082684 | 465147 | 18662 | N/A | |
| SEMA5B | 082684 | 421053 | 18663 | 401056 | 35408 |
| SEMA5B | 082684 | 477001 | 18664 | N/A | |
| SEMA5B | 082684 | 449546 | 18665 | 401038 | 35409 |
| SEMA5B | 082684 | 451055 | 18666 | 389588 | 35410 |
| SEMA5B | 082684 | 616742 | 18667 | 479602 | 35411 |
| SEMA5B | 082684 | 195173 | 18668 | 195173 | 35412 |
| SEMA6A | 092421 | 343348 | 18669 | 345512 | 35413 |
| SEMA6A | 092421 | 257414 | 18670 | 257414 | 35414 |
| SEMA6A | 092421 | 513137 | 18671 | 422997 | 35415 |
| SEMA6A | 092421 | 515129 | 18672 | 422275 | 35416 |
| SEMA6A | 092421 | 503865 | 18673 | 425364 | 35417 |
| SEMA6A | 092421 | 510263 | 18674 | 424388 | 35418 |
| SEMA6A | 092421 | 506114 | 18675 | N/A | |

-continued

-continued

| Symbol | ENSG | ENST | SEQ ID | ENSP | SEQ ID |
|---|---|---|---|---|---|
| SEMA6A | 092421 | 514316 | 18676 | N/A | |
| SEMA6A | 092421 | 503402 | 18677 | N/A | |
| SEMA6A | 092421 | 510024 | 18678 | N/A | |
| SEMA6A | 092421 | 502996 | 18679 | N/A | |
| SEMA6A | 092421 | 503962 | 18680 | N/A | |
| SEMA6A | 092421 | 515009 | 18681 | 421935 | 35419 |
| SEMA6A | 092421 | 509665 | 18682 | 425553 | 35420 |
| SEMA6A | 092421 | 512156 | 18683 | N/A | |
| SEMA6D | 137872 | 558014 | 18684 | 452815 | 35421 |
| SEMA6D | 137872 | 559184 | 18685 | 453097 | 35422 |
| SEMA6D | 137872 | 560636 | 18686 | 453420 | 35423 |
| SEMA6D | 137872 | 561133 | 18687 | 453530 | 35424 |
| SEMA6D | 137872 | 536845 | 18688 | 446152 | 35425 |
| SEMA6D | 137872 | 561106 | 18689 | N/A | |
| SEMA6D | 137872 | 558816 | 18690 | 453661 | 35426 |
| SEMA6D | 137872 | 389425 | 18691 | 374076 | 35427 |
| SEMA6D | 137872 | 316364 | 18692 | 324857 | 35428 |
| SEMA6D | 137872 | 354744 | 18693 | 346786 | 35429 |
| SEMA6D | 137872 | 358066 | 18694 | 350770 | 35430 |
| SEMA6D | 137872 | 389428 | 18695 | 374079 | 35431 |
| SEMA6D | 137872 | 559196 | 18696 | 453755 | 35432 |
| SEMA6D | 137872 | 558431 | 18697 | N/A | |
| SEMA6D | 137872 | 559064 | 18698 | 453518 | 35433 |
| SEMA6D | 137872 | 560006 | 18699 | 453689 | 35434 |
| SEMA6D | 137872 | 355997 | 18700 | 348276 | 35435 |
| SEPSECS | 109618 | 382103 | 18701 | 371535 | 35436 |
| SEPSECS | 109618 | 358971 | 18702 | 351857 | 35437 |
| SEPSECS | 109618 | 514585 | 18703 | 421880 | 35438 |
| SEPSECS | 109618 | 503150 | 18704 | 423850 | 35439 |
| SEPSECS | 109618 | 515272 | 18705 | N/A | |
| SEPSECS | 109618 | 505513 | 18706 | N/A | |
| SEPSECS | 109618 | 513285 | 18707 | 423361 | 35440 |
| SEPSECS-AS1 | 281501 | 510415 | 18708 | N/A | |
| SEPSECS-AS1 | 281501 | 507794 | 18709 | N/A | |
| SEPT4 | 108387 | 583114 | 18710 | 463768 | 35441 |
| SEPT4 | 108387 | 426861 | 18711 | 402348 | 35442 |
| SEPT4 | 108387 | 580796 | 18712 | N/A | |
| SEPT4 | 108387 | 582270 | 18713 | N/A | |
| SEPT4 | 108387 | 579371 | 18714 | 464373 | 35443 |
| SEPT4 | 108387 | 583273 | 18715 | N/A | |
| SEPT4 | 108387 | 317268 | 18716 | 321674 | 35444 |
| SEPT4 | 108387 | 577440 | 18717 | N/A | |
| SEPT4 | 108387 | 457347 | 18718 | 402000 | 35445 |
| SEPT4 | 108387 | 580844 | 18719 | 462727 | 35446 |
| SEPT4 | 108387 | 317256 | 18720 | 321071 | 35447 |
| SEPT4 | 108387 | 412945 | 18721 | 414779 | 35448 |
| SEPT4 | 108387 | 584488 | 18722 | N/A | |
| SEPT4 | 108387 | 580809 | 18723 | 464382 | 35449 |
| SEPT4 | 108387 | 577729 | 18724 | 463671 | 35450 |
| SEPT4 | 108387 | 581615 | 18725 | 462278 | 35451 |
| SEPT4 | 108387 | 578131 | 18726 | 462362 | 35452 |
| SEPT4 | 108387 | 585170 | 18727 | N/A | |
| SEPT4 | 108387 | 583291 | 18728 | 463461 | 35453 |
| SEPT4 | 108387 | 584789 | 18729 | N/A | |
| SEPT4 | 108387 | 581921 | 18730 | N/A | |
| SEPT4 | 108387 | 584528 | 18731 | N/A | |
| SEPT4 | 108387 | 580791 | 18732 | N/A | |
| SEPT4 | 108387 | 582248 | 18733 | N/A | |
| SEPT4 | 108387 | 580740 | 18734 | N/A | |
| SEPT4 | 108387 | 578747 | 18735 | N/A | |
| SEPT4 | 108387 | 581607 | 18736 | 464360 | 35454 |
| SEPT4 | 108387 | 582976 | 18737 | N/A | |
| SEPT4 | 108387 | 393086 | 18738 | 376801 | 35455 |
| SEPT7 | 122545 | 635172 | 18739 | 489466 | 35456 |
| SEPT7 | 122545 | 635476 | 18740 | 489044 | 35457 |
| SEPT7 | 122545 | 399034 | 18741 | 381992 | 35458 |
| SEPT7 | 122545 | 435235 | 18742 | 413507 | 35459 |
| SEPT7 | 122545 | 634600 | 18743 | 489538 | 35460 |
| SEPT7 | 122545 | 635669 | 18744 | N/A | |
| SEPT7 | 122545 | 493626 | 18745 | N/A | |
| SEPT7 | 122545 | 635047 | 18746 | 489480 | 35461 |
| SEPT7 | 122545 | 475109 | 18747 | N/A | |
| SEPT7 | 122545 | 635175 | 18748 | 489192 | 35462 |
| SEPT7 | 122545 | 425198 | 18749 | N/A | |
| SEPT7 | 122545 | 634700 | 18750 | N/A | |
| SEPT7 | 122545 | 635420 | 18751 | N/A | |

| Symbol | ENSG | ENST | SEQ ID | ENSP | SEQ ID |
|---|---|---|---|---|---|
| SEPT7 | 122545 | 634591 | 18752 | N/A | |
| SEPT7 | 122545 | 473201 | 18753 | N/A | |
| SEPT7 | 122545 | 492940 | 18754 | N/A | |
| SEPT7 | 122545 | 485569 | 18755 | 489596 | 35463 |
| SEPT7 | 122545 | 350320 | 18756 | 344868 | 35464 |
| SEPT7 | 122545 | 432293 | 18757 | 444240 | 35465 |
| SEPT7 | 122545 | 399035 | 18758 | 381993 | 35466 |
| SERINC2 | 168528 | 373710 | 18759 | 362814 | 35467 |
| SERINC2 | 168528 | 487207 | 18760 | N/A | |
| SERINC2 | 168528 | 373709 | 18761 | 362813 | 35468 |
| SERINC2 | 168528 | 491976 | 18762 | N/A | |
| SERINC2 | 168528 | 536384 | 18763 | 439048 | 35469 |
| SERINC2 | 168528 | 536859 | 18764 | 444307 | 35470 |
| SERP1 | 120742 | 479209 | 18765 | 420076 | 35471 |
| SERP1 | 120742 | 487153 | 18766 | 420002 | 35472 |
| SERP1 | 120742 | 491660 | 18767 | 419472 | 35473 |
| SERP1 | 120742 | 491195 | 18768 | N/A | |
| SERP1 | 120742 | 490945 | 18769 | N/A | |
| SERP1 | 120742 | 463647 | 18770 | N/A | |
| SERP1 | 120742 | 484608 | 18771 | N/A | |
| SERP1 | 120742 | 239944 | 18772 | 239944 | 35474 |
| SERPINB1 | 021355 | 380739 | 18773 | 370115 | 35475 |
| SERPINB1 | 021355 | 468511 | 18774 | N/A | |
| SERPINB1 | 021355 | 490094 | 18775 | N/A | |
| SERPINB1 | 021355 | 476896 | 18776 | N/A | |
| SERPINB1 | 021355 | 460260 | 18777 | N/A | |
| SERPINE2 | 135919 | 409304 | 18778 | 386412 | 35476 |
| SERPINE2 | 135919 | 258405 | 18779 | 258405 | 35477 |
| SERPINE2 | 135919 | 473202 | 18780 | N/A | |
| SERPINE2 | 135919 | 409840 | 18781 | 386969 | 35478 |
| SERPINE2 | 135919 | 447280 | 18782 | 415786 | 35479 |
| SERPINE2 | 135919 | 478966 | 18783 | N/A | |
| SERPINE2 | 135919 | 432738 | 18784 | 408452 | 35480 |
| SERPINE2 | 135919 | 489065 | 18785 | N/A | |
| SERPINE2 | 135919 | 454956 | 18786 | 399655 | 35481 |
| SERPINE2 | 135919 | 423446 | 18787 | 394518 | 35482 |
| SERPINH1 | 149257 | 533603 | 18788 | 434657 | 35483 |
| SERPINH1 | 149257 | 358171 | 18789 | 350894 | 35484 |
| SERPINH1 | 149257 | 526242 | 18790 | 431384 | 35485 |
| SERPINH1 | 149257 | 526397 | 18791 | 434964 | 35486 |
| SERPINH1 | 149257 | 529643 | 18792 | 435936 | 35487 |
| SERPINH1 | 149257 | 525492 | 18793 | 434482 | 35488 |
| SERPINH1 | 149257 | 530284 | 18794 | 436305 | 35489 |
| SERPINH1 | 149257 | 532356 | 18795 | 436040 | 35490 |
| SERPINH1 | 149257 | 524558 | 18796 | 434412 | 35491 |
| SERPINH1 | 149257 | 528990 | 18797 | 432007 | 35492 |
| SERPINH1 | 149257 | 533449 | 18798 | 431827 | 35493 |
| SERPINH1 | 149257 | 525611 | 18799 | 435452 | 35494 |
| SERPINH1 | 149257 | 528760 | 18800 | 437108 | 35495 |
| SERPINH1 | 149257 | 525876 | 18801 | 433532 | 35496 |
| SERPINH1 | 149257 | 526638 | 18802 | 436306 | 35497 |
| SERPINI1 | 163536 | 472941 | 18803 | 420133 | 35498 |
| SERPINI1 | 163536 | 446050 | 18804 | 397373 | 35499 |
| SERPINI1 | 163536 | 295777 | 18805 | 295777 | 35500 |
| SERPINI1 | 163536 | 472747 | 18806 | 420561 | 35501 |
| SERPINI1 | 163536 | 488374 | 18807 | N/A | |
| SERPINI1 | 163536 | 466865 | 18808 | 420807 | 35502 |
| SERPINI1 | 163536 | 494666 | 18809 | N/A | |
| SERPINI2 | 114204 | 476257 | 18810 | 420621 | 35503 |
| SERPINI2 | 114204 | 461846 | 18811 | 417692 | 35504 |
| SERPINI2 | 114204 | 471111 | 18812 | 419407 | 35505 |
| SERPINI2 | 114204 | 495108 | 18813 | N/A | |
| SERPINI2 | 114204 | 466903 | 18814 | 417752 | 35506 |
| SERPINI2 | 114204 | 467583 | 18815 | 419255 | 35507 |
| SERPINI2 | 114204 | 465031 | 18816 | N/A | |
| SERPINI2 | 114204 | 264677 | 18817 | 264677 | 35508 |
| SERPINI2 | 114204 | 616363 | 18818 | 481699 | 35509 |
| SERTM1 | 180440 | 315190 | 18819 | 325776 | 35510 |
| SESTD1 | 187231 | 428443 | 18820 | 415332 | 35511 |
| SESTD1 | 187231 | 446758 | 18821 | 410632 | 35512 |
| SESTD1 | 187231 | 335289 | 18822 | 334183 | 35513 |
| SESTD1 | 187231 | 426988 | 18823 | 391000 | 35514 |
| SESTD1 | 187231 | 489901 | 18824 | N/A | |
| SESTD1 | 187231 | 440010 | 18825 | 416164 | 35515 |
| SESTD1 | 187231 | 435047 | 18826 | 410286 | 35516 |
| SESTD1 | 187231 | 486468 | 18827 | N/A | |

| Symbol | ENSG | ENST | SEQ ID | ENSP | SEQ ID |
|---|---|---|---|---|---|
| SESTD1 | 187231 | 452991 | 18828 | 387517 | 35517 |
| SETBP1 | 152217 | 426838 | 18829 | 390687 | 35518 |
| SETBP1 | 152217 | 282030 | 18830 | 282030 | 35519 |
| SETBP1 | 152217 | 591940 | 18831 | 468506 | 35520 |
| SEZ6L2 | 174938 | 346932 | 18832 | 319215 | 35521 |
| SEZ6L2 | 174938 | 350527 | 18833 | 310206 | 35522 |
| SEZ6L2 | 174938 | 308713 | 18834 | 312550 | 35523 |
| SEZ6L2 | 174938 | 563118 | 18835 | 454654 | 35524 |
| SEZ6L2 | 174938 | 568407 | 18836 | N/A | |
| SEZ6L2 | 174938 | 562159 | 18837 | N/A | |
| SEZ6L2 | 174938 | 568380 | 18838 | 458490 | 35525 |
| SEZ6L2 | 174938 | 537485 | 18839 | 439412 | 35526 |
| SEZ6L2 | 174938 | 617533 | 18840 | 481917 | 35527 |
| SF3B4 | 143368 | 271628 | 18841 | 271628 | 35528 |
| SF3B4 | 143368 | 457312 | 18842 | 391114 | 35529 |
| SFXN5 | 144040 | 474528 | 18843 | N/A | |
| SFXN5 | 144040 | 461352 | 18844 | N/A | |
| SFXN5 | 144040 | 272433 | 18845 | 272433 | 35530 |
| SFXN5 | 144040 | 495208 | 18846 | N/A | |
| SFXN5 | 144040 | 490056 | 18847 | N/A | |
| SFXN5 | 144040 | 482289 | 18848 | N/A | |
| SFXN5 | 144040 | 411783 | 18849 | 402141 | 35531 |
| SFXN5 | 144040 | 410065 | 18850 | 387076 | 35532 |
| SFXN5 | 144040 | 482542 | 18851 | N/A | |
| SFXN5 | 144040 | 463277 | 18852 | N/A | |
| SFXN5 | 144040 | 416579 | 18853 | N/A | |
| SFXN5 | 144040 | 464825 | 18854 | N/A | |
| SFXN5 | 144040 | 450185 | 18855 | 398580 | 35533 |
| SFXN5 | 144040 | 442582 | 18856 | 396825 | 35534 |
| SFXN5 | 144040 | 487508 | 18857 | N/A | |
| SFXN5 | 144040 | 497144 | 18858 | N/A | |
| SFXN5 | 144040 | 479293 | 18859 | N/A | |
| SFXN5 | 144040 | 485057 | 18860 | N/A | |
| SFXN5 | 144040 | 475630 | 18861 | N/A | |
| SFXN5 | 144040 | 472259 | 18862 | N/A | |
| SFXN5 | 144040 | 484123 | 18863 | N/A | |
| SFXN5 | 144040 | 488839 | 18864 | N/A | |
| SGCA | 108823 | 513942 | 18865 | N/A | |
| SGCA | 108823 | 514934 | 18866 | 423168 | 35535 |
| SGCA | 108823 | 513821 | 18867 | 426571 | 35536 |
| SGCA | 108823 | 344627 | 18868 | 345522 | 35537 |
| SGCA | 108823 | 262018 | 18869 | 262018 | 35538 |
| SGCA | 108823 | 502555 | 18870 | 422817 | 35539 |
| SGCA | 108823 | 511303 | 18871 | 426104 | 35540 |
| SGCA | 108823 | 512526 | 18872 | 426606 | 35541 |
| SGCA | 108823 | 504073 | 18873 | 422030 | 35542 |
| SGCA | 108823 | 508382 | 18874 | N/A | |
| SGCA | 108823 | 505964 | 18875 | N/A | |
| SGCD | 170624 | 517913 | 18876 | 429378 | 35543 |
| SGCD | 170624 | 435422 | 18877 | 403003 | 35544 |
| SGCD | 170624 | 337851 | 18878 | 338343 | 35545 |
| SGCD | 170624 | 524347 | 18879 | 430794 | 35546 |
| SGK2 | 101049 | 373100 | 18880 | 362192 | 35547 |
| SGK2 | 101049 | 373077 | 18881 | 362168 | 35548 |
| SGK2 | 101049 | 373092 | 18882 | 362184 | 35549 |
| SGK2 | 101049 | 496343 | 18883 | 436841 | 35550 |
| SGK2 | 101049 | 617268 | 18884 | 481432 | 35551 |
| SGK2 | 101049 | 617358 | 18885 | N/A | |
| SGK2 | 101049 | 412111 | 18886 | 396222 | 35552 |
| SGK2 | 101049 | 341458 | 18887 | 340608 | 35553 |
| SGK2 | 101049 | 426287 | 18888 | 412214 | 35554 |
| SGK2 | 101049 | 485914 | 18889 | N/A | |
| SGK2 | 101049 | 423407 | 18890 | 392795 | 35555 |
| SGMS2 | 164023 | 506462 | 18891 | N/A | |
| SGMS2 | 164023 | 394684 | 18892 | 378176 | 35556 |
| SGMS2 | 164023 | 515332 | 18893 | N/A | |
| SGMS2 | 164023 | 503862 | 18894 | 428176 | 35557 |
| SGMS2 | 164023 | 359079 | 18895 | 351981 | 35558 |
| SGMS2 | 164023 | 506993 | 18896 | 428294 | 35559 |
| SGMS2 | 164023 | 394686 | 18897 | 378178 | 35560 |
| SGMS2 | 164023 | 503385 | 18898 | 430172 | 35561 |
| SGMS2 | 164023 | 504754 | 18899 | N/A | |
| SH2B2 | 160999 | 617975 | 18900 | 483034 | 35562 |
| SH2B2 | 160999 | 536178 | 18901 | 440273 | 35563 |
| SH2B2 | 160999 | 444095 | 18902 | 401883 | 35564 |
| SH2D1A | 183918 | 635645 | 18903 | N/A | |

| Symbol | ENSG | ENST | SEQ ID | ENSP | SEQ ID |
|---|---|---|---|---|---|
| SH2D1A | 183918 | 371139 | 18904 | 360181 | 35565 |
| SH2D1A | 183918 | 360027 | 18905 | 353126 | 35566 |
| SH2D1A | 183918 | 491950 | 18906 | N/A | |
| SH2D1A | 183918 | 494073 | 18907 | N/A | |
| SH2D1A | 183918 | 477673 | 18908 | 477094 | 35567 |
| SH2D4B | 178217 | 339284 | 18909 | 345295 | 35568 |
| SH2D4B | 178217 | 313455 | 18910 | 314242 | 35569 |
| SH2D4B | 178217 | 372150 | 18911 | N/A | |
| SH2D4B | 178217 | 481537 | 18912 | N/A | |
| SH3BGRL2 | 198478 | 369838 | 18913 | 358853 | 35570 |
| SH3BP2 | 087266 | 452765 | 18914 | 409746 | 35571 |
| SH3BP2 | 087266 | 503219 | 18915 | 422796 | 35572 |
| SH3BP2 | 087266 | 512131 | 18916 | N/A | |
| SH3BP2 | 087266 | 510193 | 18917 | N/A | |
| SH3BP2 | 087266 | 511237 | 18918 | N/A | |
| SH3BP2 | 087266 | 510074 | 18919 | N/A | |
| SH3BP2 | 087266 | 504294 | 18920 | 423275 | 35573 |
| SH3BP2 | 087266 | 508385 | 18921 | 424917 | 35574 |
| SH3BP2 | 087266 | 513020 | 18922 | 424072 | 35575 |
| SH3BP2 | 087266 | 511663 | 18923 | N/A | |
| SH3BP2 | 087266 | 512014 | 18924 | 424105 | 35576 |
| SH3BP2 | 087266 | 513095 | 18925 | 423823 | 35577 |
| SH3BP2 | 087266 | 502260 | 18926 | 425537 | 35578 |
| SH3BP2 | 087266 | 511185 | 18927 | N/A | |
| SH3BP2 | 087266 | 435136 | 18928 | 403231 | 35579 |
| SH3BP2 | 087266 | 508338 | 18929 | N/A | |
| SH3BP2 | 087266 | 511747 | 18930 | 424846 | 35580 |
| SH3BP2 | 087266 | 509677 | 18931 | N/A | |
| SH3BP2 | 087266 | 515737 | 18932 | 422605 | 35581 |
| SH3BP2 | 087266 | 356331 | 18933 | 348685 | 35582 |
| SH3BP2 | 087266 | 506932 | 18934 | N/A | |
| SH3BP2 | 087266 | 515183 | 18935 | N/A | |
| SH3BP2 | 087266 | 505941 | 18936 | N/A | |
| SH3BP2 | 087266 | 510204 | 18937 | N/A | |
| SH3BP2 | 087266 | 515802 | 18938 | N/A | |
| SH3BP2 | 087266 | 504450 | 18939 | N/A | |
| SH3BP2 | 087266 | 513069 | 18940 | 426818 | 35583 |
| SH3BP2 | 087266 | 442312 | 18941 | 388152 | 35584 |
| SH3BP2 | 087266 | 503393 | 18942 | 422168 | 35585 |
| SH3BP4 | 130147 | 392011 | 18943 | 375867 | 35586 |
| SH3BP4 | 130147 | 484097 | 18944 | N/A | |
| SH3BP4 | 130147 | 416021 | 18945 | 403251 | 35587 |
| SH3BP4 | 130147 | 409212 | 18946 | 386862 | 35588 |
| SH3BP4 | 130147 | 489601 | 18947 | N/A | |
| SH3BP4 | 130147 | 344528 | 18948 | 340237 | 35589 |
| SH3BP4 | 130147 | 444916 | 18949 | 387995 | 35590 |
| SH3BP4 | 130147 | 446904 | 18950 | 415391 | 35591 |
| SH3BP4 | 130147 | 462602 | 18951 | N/A | |
| SH3BP4 | 130147 | 493436 | 18952 | N/A | |
| SH3BP4 | 130147 | 454947 | 18953 | 414740 | 35592 |
| SH3D19 | 109686 | 604922 | 18954 | N/A | |
| SH3D19 | 109686 | 409598 | 18955 | 387030 | 35593 |
| SH3D19 | 109686 | 409252 | 18956 | 386848 | 35594 |
| SH3D19 | 109686 | 478503 | 18957 | N/A | |
| SH3D19 | 109686 | 514152 | 18958 | 423449 | 35595 |
| SH3D19 | 109686 | 604030 | 18959 | 488951 | 35596 |
| SH3D19 | 109686 | 427414 | 18960 | 415694 | 35597 |
| SH3D19 | 109686 | 508492 | 18961 | N/A | |
| SH3D19 | 109686 | 462257 | 18962 | 489087 | 35598 |
| SH3D19 | 109686 | 604440 | 18963 | N/A | |
| SH3D19 | 109686 | 474743 | 18964 | N/A | |
| SH3D19 | 109686 | 514013 | 18965 | N/A | |
| SH3D19 | 109686 | 304527 | 18966 | 302913 | 35599 |
| SH3GL3 | 140600 | 492099 | 18967 | N/A | |
| SH3GL3 | 140600 | 427482 | 18968 | 391372 | 35600 |
| SH3GL3 | 140600 | 563901 | 18969 | 456249 | 35601 |
| SH3GL3 | 140600 | 324537 | 18970 | 320092 | 35602 |
| SH3GL3 | 140600 | 564054 | 18971 | N/A | |
| SH3GL3 | 140600 | 467735 | 18972 | NA | |
| SH3RF1 | 154447 | 284637 | 18973 | 284637 | 35603 |
| SH3RF1 | 154447 | 511421 | 18974 | 426418 | 35604 |
| SH3RF1 | 154447 | 508685 | 18975 | NA | |
| SH3RF1 | 154447 | 502315 | 18976 | 427585 | 35605 |
| SH3RF1 | 154447 | 510806 | 18977 | 421714 | 35606 |
| SH3RF3 | 172985 | 309415 | 18978 | 309186 | 35607 |
| SH3TC2 | 169247 | 504690 | 18979 | 425627 | 35608 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| SH3TC2 | 169247 | 510350 | 18980 | N/A | | 5 | SHROOM2 | 146950 | 452575 | 19056 | 406724 | 35666 |
| SH3TC2 | 169247 | 323829 | 18981 | 313025 | 35609 | | SHROOM2 | 146950 | 418909 | 19057 | 415229 | 35667 |
| SH3TC2 | 169247 | 515229 | 18982 | N/A | | | SHROOM3 | 138771 | 296043 | 19058 | 296043 | 35668 |
| SH3TC2 | 169247 | 504517 | 18983 | 421779 | 35610 | | SHROOM3 | 138771 | 497440 | 19059 | N/A | |
| SH3TC2 | 169247 | 502274 | 18984 | 421092 | 35611 | | SHROOM3 | 138771 | 466541 | 19060 | N/A | |
| SH3TC2 | 169247 | 510779 | 18985 | 423940 | 35612 | | SHROOM3 | 138771 | 469923 | 19061 | N/A | |
| SH3TC2 | 169247 | 515425 | 18986 | 423660 | 35613 | 10 | SHROOM3 | 138771 | 490690 | 19062 | N/A | |
| SH3TC2 | 169247 | 512049 | 18987 | 421860 | 35614 | | SHROOM3 | 138771 | 481002 | 19063 | N/A | |
| SH3TC2 | 169247 | 513604 | 18988 | 423111 | 35615 | | SHROOM3 | 138771 | 485780 | 19064 | N/A | |
| SH3TC2 | 169247 | 511307 | 18989 | 421420 | 35616 | | SHROOM3 | 138771 | 484236 | 19065 | N/A | |
| SH3TC2 | 169247 | 513340 | 18990 | N/A | | | SHROOM3 | 138771 | 486758 | 19066 | N/A | |
| SH3TC2 | 169247 | 503071 | 18991 | N/A | | | SHROOM3 | 138771 | 473602 | 19067 | N/A | |
| SH3TC2 | 169247 | 511949 | 18992 | N/A | | 15 | SHROOM4 | 158352 | 289292 | 19068 | 289292 | 35669 |
| SH3TC2 | 169247 | 504091 | 18993 | N/A | | | SHROOM4 | 158352 | 483955 | 19069 | N/A | |
| SHANK1 | 161681 | 391813 | 18994 | 375689 | 35617 | | SHROOM4 | 158352 | 460112 | 19070 | 421450 | 35670 |
| SHANK1 | 161681 | 293441 | 18995 | 293441 | 35618 | | SHROOM4 | 158352 | 484922 | 19071 | N/A | |
| SHANK1 | 161681 | 391814 | 18996 | 375690 | 35619 | | SHROOM4 | 158352 | 376020 | 19072 | 365188 | 35671 |
| SHANK1 | 161681 | 359082 | 18997 | 351984 | 35620 | | SHTN1 | 187164 | 615301 | 19073 | 480109 | 35672 |
| SHANK1 | 161681 | 483981 | 18998 | N/A | | 20 | SHTN1 | 187164 | 497044 | 19074 | N/A | |
| SHANK1 | 161681 | 468654 | 18999 | 469719 | 35621 | | SHTN1 | 187164 | 392901 | 19075 | 376635 | 35673 |
| SHANK1 | 161681 | 461154 | 19000 | N/A | | | SHTN1 | 187164 | 490615 | 19076 | N/A | |
| SHANK1 | 161681 | 483128 | 19001 | N/A | | | SHTN1 | 187164 | 260777 | 19077 | 260777 | 35674 |
| SHANK2 | 162105 | 608988 | 19002 | 476264 | 35622 | | SHTN1 | 187164 | 392903 | 19078 | 376636 | 35675 |
| SHANK2 | 162105 | 618363 | 19003 | 482553 | 35623 | | SHTN1 | 187164 | 355371 | 19079 | 347532 | 35676 |
| SHANK2 | 162105 | 425049 | 19004 | 392674 | 35624 | 25 | SIAH2 | 181788 | 312960 | 19080 | 322457 | 35677 |
| SHANK2 | 162105 | 498519 | 19005 | N/A | | | SIAH2 | 181788 | 482706 | 19081 | 417619 | 35678 |
| SHANK2 | 162105 | 468619 | 19006 | 483920 | 35625 | | SIAH2 | 181788 | 472885 | 19082 | N/A | |
| SHANK2 | 162105 | 470759 | 19007 | N/A | | | SIAH3 | 215475 | 400405 | 19083 | 383256 | 35679 |
| SHANK2 | 162105 | 409530 | 19008 | 387324 | 35626 | | SIDT1 | 072858 | 264852 | 19084 | 264852 | 35680 |
| SHANK2 | 162105 | 412252 | 19009 | 414876 | 35627 | | SIDT1 | 072858 | 491730 | 19085 | N/A | |
| SHANK2 | 162105 | 606715 | 19010 | N/A | | | SIDT1 | 072858 | 483946 | 19086 | N/A | |
| SHANK2 | 162105 | 449833 | 19011 | 399423 | 35628 | 30 | SIDT1 | 072858 | 488390 | 19087 | N/A | |
| SHANK2 | 162105 | 357171 | 19012 | 349694 | 35629 | | SIDT1 | 072858 | 480746 | 19088 | N/A | |
| SHANK2 | 162105 | 482659 | 19013 | N/A | | | SIDT1 | 072858 | 468728 | 19089 | N/A | |
| SHANK2 | 162105 | 458632 | 19014 | 390636 | 35630 | | SIDT1 | 072858 | 463226 | 19090 | N/A | |
| SHANK2 | 162105 | 460048 | 19015 | N/A | | | SIDT1 | 072858 | 465803 | 19091 | N/A | |
| SHANK2 | 162105 | 445654 | 19016 | N/A | | | SIDT1 | 072858 | 492863 | 19092 | N/A | |
| SHANK2 | 162105 | 426687 | 19017 | 391570 | 35631 | 35 | SIDT1 | 072858 | 481891 | 19093 | N/A | |
| SHANK2 | 162105 | 449116 | 19018 | 394939 | 35632 | | SIDT1 | 072858 | 498152 | 19094 | N/A | |
| SHANK2 | 162105 | 601538 | 19019 | 469689 | 35633 | | SIDT1 | 072858 | 393830 | 19095 | 377416 | 35681 |
| SHANK2 | 162105 | 338508 | 19020 | 345193 | 35634 | | SIK3 | 160584 | 488337 | 19096 | N/A | |
| SHANK2 | 162105 | 424924 | 19021 | 402944 | 35635 | | SIK3 | 160584 | 445177 | 19097 | 391295 | 35682 |
| SHANK2 | 162105 | 409161 | 19022 | 386491 | 35636 | | SIK3 | 160584 | 375300 | 19098 | 364449 | 35683 |
| SHANK3 | 251322 | 414786 | 19023 | N/A | | 40 | SIK3 | 160584 | 454905 | 19099 | 392849 | 35684 |
| SHANK3 | 251322 | 445220 | 19024 | 489407 | 35637 | | SIK3 | 160584 | 465421 | 19100 | N/A | |
| SHANK3 | 251322 | 262795 | 19025 | 489147 | 35638 | | SIK3 | 160584 | 415541 | 19101 | 392761 | 35685 |
| SHANK3 | 283243 | 635818 | 19026 | 490818 | 35639 | | SIK3 | 160584 | 446921 | 19102 | 390442 | 35686 |
| SHC3 | 148082 | 375835 | 19027 | 364995 | 35640 | | SIK3 | 160584 | 480468 | 19103 | N/A | |
| SHC3 | 148082 | 375831 | 19028 | 364991 | 35641 | | SIK3 | 160584 | 480222 | 19104 | N/A | |
| SHC4 | 185634 | 332408 | 19029 | 329668 | 35642 | | SIK3 | 160584 | 413553 | 19105 | 414347 | 35687 |
| SHC4 | 185634 | 396535 | 19030 | 379786 | 35643 | 45 | SIK3 | 160584 | 472648 | 19106 | N/A | |
| SHC4 | 185634 | 537958 | 19031 | 443300 | 35644 | | SIK3 | 160584 | 497049 | 19107 | N/A | |
| SHC4 | 185634 | 557797 | 19032 | 453344 | 35645 | | SIK3 | 160584 | 485363 | 19108 | N/A | |
| SHC4 | 185634 | 558220 | 19033 | 453397 | 35646 | | SIPA1L1 | 197555 | 553453 | 19109 | N/A | |
| SHC4 | 185634 | 559289 | 19034 | N/A | | | SIPA1L1 | 197555 | 555989 | 19110 | N/A | |
| SHF | 138606 | 560540 | 19035 | 453370 | 35647 | | SIPA1L1 | 197555 | 556408 | 19111 | N/A | |
| SHF | 138606 | 290894 | 19036 | 290894 | 35648 | 50 | SIPA1L1 | 197555 | 554126 | 19112 | N/A | |
| SHF | 138606 | 560734 | 19037 | 453168 | 35649 | | SIPA1L1 | 197555 | 556780 | 19113 | N/A | |
| SHF | 138606 | 458022 | 19038 | 411530 | 35650 | | SIPA1L1 | 197555 | 554362 | 19114 | N/A | |
| SHF | 138606 | 558294 | 19039 | 454034 | 35651 | | SIPA1L1 | 197555 | 555652 | 19115 | N/A | |
| SHF | 138606 | 561239 | 19040 | 453676 | 35652 | | SIPA1L1 | 197555 | 557151 | 19116 | 452080 | 35688 |
| SHF | 138606 | 560471 | 19041 | 453260 | 35653 | | SIPA1L1 | 197555 | 557469 | 19117 | N/A | |
| SHF | 138606 | 559566 | 19042 | 452726 | 35654 | 55 | SIPA1L1 | 197555 | 557712 | 19118 | N/A | |
| SHF | 138606 | 558685 | 19043 | 453827 | 35655 | | SIPA1L1 | 197555 | 381232 | 19119 | 370630 | 35689 |
| SHF | 138606 | 561091 | 19044 | N/A | | | SIPA1L1 | 197555 | 555818 | 19120 | 450832 | 35690 |
| SHF | 138606 | 561278 | 19045 | 453986 | 35656 | | SIPA1L1 | 197555 | 358550 | 19121 | 351352 | 35691 |
| SHISA6 | 188803 | 441885 | 19016 | 390084 | 35657 | | SIPA1L1 | 197555 | 537413 | 19122 | 440682 | 35692 |
| SHISA6 | 188803 | 432116 | 19047 | 388659 | 35658 | | SIPA1L1 | 197555 | 555066 | 19123 | 452450 | 35693 |
| SHISA6 | 188803 | 409168 | 19048 | 387157 | 35659 | 60 | SIPA1L1 | 197555 | 554960 | 19124 | N/A | |
| SHISA6 | 188803 | 343478 | 19049 | 477331 | 35660 | | SIPA1L1 | 197555 | 554874 | 19125 | N/A | |
| SHISA7 | 187902 | 376325 | 19050 | 365503 | 35661 | | SIPA1L1 | 197555 | 556959 | 19126 | N/A | |
| SHISA7 | 187902 | 416792 | 19051 | 401307 | 35662 | | SIPA1L2 | 116991 | 366630 | 19127 | 355589 | 35694 |
| SHISA8 | 234965 | 457093 | 19052 | 389964 | 35663 | | SIPA1L2 | 116991 | 308942 | 19128 | 309102 | 35695 |
| SHISA8 | 234965 | 621082 | 19053 | 481203 | 35664 | | SIPA1L2 | 116991 | 486472 | 19129 | N/A | |
| SHROOM2 | 146950 | 380913 | 19054 | 370299 | 35665 | 65 | SIPA1L2 | 116991 | 495863 | 19130 | N/A | |
| SHROOM2 | 146950 | 493668 | 19055 | N/A | | | SIPA1L2 | 116991 | 494056 | 19131 | N/A | |

-continued

| Symbol | ENSG | ENST | SEQ ID | ENSP | SEQ ID |
|---|---|---|---|---|---|
| SIPA1L2 | 116991 | 262861 | 19132 | 262861 | 35696 |
| SIPA1L3 | 105738 | 222345 | 19133 | 222345 | 35697 |
| SIPA1L3 | 105738 | 599644 | 19134 | N/A | |
| SIPA1L3 | 105738 | 476317 | 19135 | N/A | |
| SIPA1L3 | 105738 | 595982 | 19136 | N/A | |
| SIPA1L3 | 105738 | 595384 | 19137 | 468981 | 35698 |
| SIPA1L3 | 105738 | 601222 | 19138 | N/A | |
| SIPA1L3 | 105738 | 594553 | 19139 | N/A | |
| SIPA1L3 | 105738 | 601881 | 19140 | N/A | |
| SIPA1L3 | 105738 | 600919 | 19141 | N/A | |
| SIPA1L3 | 105738 | 595495 | 19142 | N/A | |
| SIPA1L3 | 105738 | 601054 | 19143 | 472734 | 35699 |
| SIPA1L3 | 105738 | 596403 | 19144 | N/A | |
| SIRPA | 198053 | 622179 | 19145 | 478763 | 35700 |
| SIRPA | 198053 | 356025 | 19146 | 348307 | 35701 |
| SIRPA | 198053 | 358771 | 19147 | 351621 | 35702 |
| SIRPA | 198053 | 400068 | 19148 | 382941 | 35703 |
| SIX4 | 100625 | 216513 | 19149 | 216513 | 35704 |
| SIX4 | 100625 | 554079 | 19150 | N/A | |
| SIX4 | 100625 | 556952 | 19151 | 450761 | 35705 |
| SKAP2 | 005020 | 345317 | 19152 | 005587 | 35706 |
| SKAP2 | 005020 | 489977 | 19153 | N/A | |
| SKAP2 | 005020 | 468712 | 19154 | N/A | |
| SKAP2 | 005020 | 495802 | 19155 | N/A | |
| SKAP2 | 005020 | 432747 | 19156 | 408163 | 35707 |
| SKAP2 | 005020 | 490456 | 19157 | N/A | |
| SKAP2 | 005020 | 497511 | 19158 | N/A | |
| SKAP2 | 005020 | 481204 | 19159 | N/A | |
| SKAP2 | 005020 | 487720 | 19160 | N/A | |
| SKOR1 | 188779 | 341418 | 19161 | 343200 | 35708 |
| SKOR1 | 188779 | 554240 | 19162 | 451193 | 35709 |
| SKOR1 | 188779 | 554054 | 19163 | 452361 | 35710 |
| SKOR1 | 188779 | 380035 | 19164 | 369374 | 35711 |
| SKOR2 | 215474 | 425639 | 19165 | 414750 | 35712 |
| SKOR2 | 215474 | 400404 | 19166 | 383255 | 35713 |
| SKOR2 | 215474 | 620245 | 19167 | 483333 | 35714 |
| SLC12A2 | 064651 | 262461 | 19168 | 262461 | 35715 |
| SLC12A2 | 064651 | 509205 | 19169 | 427109 | 35716 |
| SLC12A2 | 064651 | 343225 | 19170 | 340878 | 35717 |
| SLC12A2 | 064651 | 504416 | 19171 | N/A | |
| SLC12A2 | 064651 | 509616 | 19172 | N/A | |
| SLC12A2 | 064651 | 507791 | 19173 | N/A | |
| SLC12A2 | 064651 | 502849 | 19174 | N/A | |
| SLC12A2 | 064651 | 628403 | 19175 | 486323 | 35718 |
| SLC12A3 | 070915 | 566786 | 19176 | 457552 | 35719 |
| SLC12A3 | 070915 | 438926 | 19177 | 402152 | 35720 |
| SLC12A3 | 070915 | 563236 | 19178 | 456149 | 35721 |
| SLC12A3 | 070915 | 262502 | 19179 | 262502 | 35722 |
| SLC12A3 | 070915 | 569002 | 19180 | N/A | |
| SLC12A3 | 070915 | 563352 | 19181 | N/A | |
| SLC12A4 | 124067 | 316341 | 19182 | 318557 | 35723 |
| SLC12A4 | 124067 | 572037 | 19183 | 461403 | 35724 |
| SLC12A4 | 124067 | 541864 | 19184 | 438334 | 35725 |
| SLC12A4 | 124067 | 576616 | 19185 | 458902 | 35726 |
| SLC12A4 | 124067 | 570802 | 19186 | N/A | |
| SLC12A4 | 124067 | 537830 | 19187 | 445962 | 35727 |
| SLC12A4 | 124067 | 570616 | 19188 | 463148 | 35728 |
| SLC12A4 | 124067 | 575857 | 19189 | 464660 | 35729 |
| SLC12A4 | 124067 | 573023 | 19190 | N/A | |
| SLC12A4 | 124067 | 576513 | 19191 | N/A | |
| SLC12A4 | 124067 | 572476 | 19192 | N/A | |
| SLC12A4 | 124067 | 574665 | 19193 | N/A | |
| SLC12A4 | 124067 | 572766 | 19194 | N/A | |
| SLC12A4 | 124067 | 573702 | 19195 | N/A | |
| SLC12A4 | 124067 | 576377 | 19196 | 458975 | 35730 |
| SLC12A4 | 124067 | 571299 | 19197 | 464168 | 35731 |
| SLC12A4 | 124067 | 572010 | 19198 | N/A | |
| SLC12A4 | 124067 | 576462 | 19199 | N/A | |
| SLC12A4 | 124067 | 422611 | 19200 | 395983 | 35732 |
| SLC12A5 | 124140 | 454036 | 19201 | 387694 | 35733 |
| SLC12A5 | 124140 | 628272 | 19202 | 486382 | 35734 |
| SLC12A5 | 124140 | 626701 | 19203 | 487372 | 35735 |
| SLC12A5 | 124140 | 428198 | 19204 | N/A | |
| SLC12A5 | 124140 | 413737 | 19205 | 487291 | 35736 |
| SLC12A5 | 124140 | 626695 | 19206 | N/A | |
| SLC12A5 | 124140 | 608944 | 19207 | 476885 | 35737 |

-continued

| Symbol | ENSG | ENST | SEQ ID | ENSP | SEQ ID |
|---|---|---|---|---|---|
| SLC12A5 | 124140 | 622711 | 19208 | N/A | |
| SLC12A5 | 124140 | 629054 | 19209 | N/A | |
| SLC12A5 | 124140 | 625683 | 19210 | N/A | |
| SLC12A5 | 124140 | 626937 | 19211 | 485953 | 35738 |
| SLC12A5 | 124140 | 616202 | 19212 | 478369 | 35739 |
| SLC12A5 | 124140 | 243964 | 19213 | 243964 | 35740 |
| SLC12A5 | 124140 | 627290 | 19214 | 487449 | 35741 |
| SLC12A5 | 124140 | 372315 | 19215 | N/A | |
| SLC12A5 | 124140 | 539566 | 19216 | 446091 | 35742 |
| SLC12A5 | 124140 | 636324 | 19217 | N/A | |
| SLC12A5 | 124140 | 637831 | 19218 | N/A | |
| SLC12A5 | 124140 | 637863 | 19219 | N/A | |
| SLC12A5 | 124140 | 608594 | 19220 | N/A | |
| SLC12A5 | 124140 | 626144 | 19221 | N/A | |
| SLC12A5 | 124140 | 628413 | 19222 | N/A | |
| SLC12A5 | 124140 | 637437 | 19223 | 490442 | 35743 |
| SLC12A5 | 124140 | 616933 | 19224 | 477569 | 35744 |
| SLC12A5 | 124140 | 616201 | 19225 | 484585 | 35745 |
| SLC12A8 | 221955 | 430155 | 19226 | 415713 | 35746 |
| SLC12A8 | 221955 | 393469 | 19227 | 377112 | 35747 |
| SLC12A8 | 221955 | 473262 | 19228 | 419424 | 35748 |
| SLC12A8 | 221955 | 465475 | 19229 | N/A | |
| SLC12A8 | 221955 | 469902 | 19230 | 418783 | 35749 |
| SLC12A8 | 221955 | 479352 | 19231 | N/A | |
| SLC12A8 | 221955 | 483944 | 19232 | N/A | |
| SLC12A8 | 221955 | 461616 | 19233 | N/A | |
| SLC12A8 | 221955 | 485954 | 19234 | N/A | |
| SLC12A8 | 221955 | 479231 | 19235 | N/A | |
| SLC12A8 | 221955 | 465777 | 19236 | N/A | |
| SLC12A8 | 221955 | 495105 | 19237 | N/A | |
| SLC12A8 | 221955 | 485849 | 19238 | N/A | |
| SLC12A8 | 221955 | 479826 | 19239 | 420197 | 35750 |
| SLC12A8 | 221955 | 462437 | 19240 | 418636 | 35751 |
| SLC12A8 | 221955 | 481760 | 19241 | N/A | |
| SLC13A5 | 141485 | 433363 | 19242 | 406220 | 35752 |
| SLC13A5 | 141485 | 574580 | 19243 | N/A | |
| SLC13A5 | 141485 | 293800 | 19244 | 293800 | 35753 |
| SLC13A5 | 141485 | 381074 | 19245 | 370464 | 35754 |
| SLC13A5 | 141485 | 573648 | 19246 | 459372 | 35755 |
| SLC13A5 | 141485 | 570687 | 19247 | 460037 | 35756 |
| SLC13A5 | 141485 | 572727 | 19248 | N/A | |
| SLC13A5 | 141485 | 574824 | 19249 | N/A | |
| SLC13A5 | 141485 | 572094 | 19250 | 461495 | 35757 |
| SLC13A5 | 141485 | 572352 | 19251 | 461622 | 35758 |
| SLC13A5 | 141485 | 576323 | 19252 | N/A | |
| SLC13A5 | 141485 | 575230 | 19253 | 460903 | 35759 |
| SLC14A1 | 141469 | 321925 | 19254 | 318546 | 35760 |
| SLC14A1 | 141469 | 587601 | 19255 | 465029 | 35761 |
| SLC14A1 | 141469 | 502059 | 19256 | 442180 | 35762 |
| SLC14A1 | 141469 | 586951 | 19257 | 465702 | 35763 |
| SLC14A1 | 141469 | 589322 | 19258 | 466273 | 35764 |
| SLC14A1 | 141469 | 415427 | 19259 | 412309 | 35765 |
| SLC14A1 | 141469 | 535474 | 19260 | 441998 | 35766 |
| SLC14A1 | 141469 | 402943 | 19261 | 385320 | 35767 |
| SLC14A1 | 141469 | 588179 | 19262 | 467898 | 35768 |
| SLC14A1 | 141469 | 586056 | 19263 | 470055 | 35769 |
| SLC14A1 | 141469 | 436407 | 19264 | 390637 | 35770 |
| SLC14A1 | 141469 | 589891 | 19265 | 466093 | 35771 |
| SLC14A1 | 141469 | 590246 | 19266 | 468763 | 35772 |
| SLC14A1 | 141469 | 591943 | 19267 | N/A | |
| SLC14A1 | 141469 | 586142 | 19268 | 470476 | 35773 |
| SLC14A1 | 141469 | 589700 | 19269 | 465044 | 35774 |
| SLC14A1 | 141469 | 590377 | 19270 | 465150 | 35775 |
| SLC14A1 | 141469 | 591642 | 19271 | N/A | |
| SLC14A1 | 141469 | 586854 | 19272 | N/A | |
| SLC14A1 | 141469 | 591541 | 19273 | N/A | |
| SLC14A1 | 141469 | 619403 | 19274 | 479595 | 35776 |
| SLC14A2 | 132874 | 586448 | 19275 | 465953 | 35777 |
| SLC14A2 | 132874 | 255226 | 19276 | 255226 | 35778 |
| SLC14A2 | 132874 | 323329 | 19277 | 320689 | 35779 |
| SLC15A2 | 163406 | 489711 | 19278 | 417085 | 35780 |
| SLC15A2 | 163406 | 295605 | 19279 | 295605 | 35781 |
| SLC15A2 | 163406 | 469013 | 19280 | 418704 | 35782 |
| SLC15A2 | 163406 | 489886 | 19281 | N/A | |
| SLC15A2 | 163406 | 489957 | 19282 | N/A | |
| SLC15A2 | 163406 | 465060 | 19283 | N/A | |

-continued

| Symbol | ENSG | ENST | SEQ ID | ENSP | SEQ ID |
|---|---|---|---|---|---|
| SLC15A2 | 163406 | 469422 | 19284 | N/A | |
| SLC16A10 | 112394 | 368851 | 19285 | 357844 | 35783 |
| SLC16A10 | 112394 | 439288 | 19286 | 387501 | 35784 |
| SLC16A10 | 112394 | 465319 | 19287 | N/A | |
| SLC16A10 | 112394 | 419619 | 19288 | 399601 | 35785 |
| SLC16A10 | 112394 | 368850 | 19289 | 357843 | 35786 |
| SLC16A10 | 112394 | 612036 | 19290 | 483868 | 35787 |
| SLC17A4 | 146039 | 377905 | 19291 | 367137 | 35788 |
| SLC17A4 | 146039 | 439485 | 19292 | 391345 | 35789 |
| SLC17A4 | 146039 | 397076 | 19293 | 380266 | 35790 |
| SLC17A7 | 104888 | 221485 | 19294 | 221485 | 35791 |
| SLC17A7 | 104888 | 600601 | 19295 | 470338 | 35792 |
| SLC17A7 | 104888 | 600672 | 19296 | N/A | |
| SLC17A7 | 104888 | 596689 | 19297 | 472086 | 35793 |
| SLC17A7 | 104888 | 598018 | 19298 | N/A | |
| SLC19A1 | 173638 | 417954 | 19299 | 393988 | 35794 |
| SLC19A1 | 173638 | 567670 | 19300 | 457278 | 35795 |
| SLC19A1 | 173638 | 461785 | 19301 | N/A | |
| SLC19A1 | 173638 | 468508 | 19302 | N/A | |
| SLC19A1 | 173638 | 460174 | 19303 | N/A | |
| SLC19A1 | 173638 | 311124 | 19304 | 308895 | 35796 |
| SLC19A1 | 173638 | 380010 | 19305 | 369347 | 35797 |
| SLC19A1 | 173638 | 485649 | 19306 | 441772 | 35798 |
| SLC19A1 | 173638 | 427839 | 19307 | 401850 | 35799 |
| SLC19A1 | 173638 | 443742 | 19308 | 411345 | 35800 |
| SLC19A1 | 173638 | 486303 | 19309 | N/A | |
| SLC19A1 | 173638 | 528477 | 19310 | 435780 | 35801 |
| SLC19A2 | 117479 | 236137 | 19311 | 236137 | 35802 |
| SLC19A2 | 117479 | 367804 | 19312 | 356778 | 35803 |
| SLC1A1 | 106688 | 262352 | 19313 | 262352 | 35804 |
| SLC1A1 | 106688 | 490167 | 19314 | N/A | |
| SLC1A1 | 106688 | 422398 | 19315 | 414620 | 35805 |
| SLC1A4 | 115902 | 493121 | 19316 | N/A | |
| SLC1A4 | 115902 | 471551 | 19317 | N/A | |
| SLC1A4 | 115902 | 531327 | 19318 | 431942 | 35806 |
| SLC1A4 | 115902 | 234256 | 19319 | 234256 | 35807 |
| SLC1A4 | 115902 | 480594 | 19320 | N/A | |
| SLC1A6 | 105143 | 430939 | 19321 | 409386 | 35808 |
| SLC1A6 | 105143 | 221742 | 19322 | 221742 | 35809 |
| SLC1A6 | 105143 | 600144 | 19323 | 471038 | 35810 |
| SLC1A6 | 105143 | 598504 | 19324 | 471781 | 35811 |
| SLC1A6 | 105143 | 544886 | 19325 | 446175 | 35812 |
| SLC1A6 | 105143 | 596697 | 19326 | N/A | |
| SLC1A6 | 105143 | 597262 | 19327 | 471562 | 35813 |
| SLC1A6 | 105143 | 599636 | 19328 | 472837 | 35814 |
| SLC1A6 | 105143 | 595863 | 19329 | 469551 | 35815 |
| SLC1A6 | 105143 | 601761 | 19330 | 471129 | 35816 |
| SLC1A6 | 105143 | 594383 | 19331 | 472133 | 35817 |
| SLC20A1 | 144136 | 272542 | 19332 | 272542 | 35818 |
| SLC20A1 | 144136 | 423633 | 19333 | 392050 | 35819 |
| SLC20A1 | 144136 | 498224 | 19334 | N/A | |
| SLC20A1 | 144136 | 433924 | 19335 | 390021 | 35820 |
| SLC20A1 | 144136 | 456264 | 19336 | 403763 | 35821 |
| SLC20A1 | 144136 | 413135 | 19337 | 413393 | 35822 |
| SLC20A1 | 144136 | 480984 | 19338 | N/A | |
| SLC20A1 | 144136 | 492076 | 19339 | N/A | |
| SLC20A1 | 144136 | 490674 | 19340 | N/A | |
| SLC22A15 | 163393 | 369503 | 19341 | 358515 | 35823 |
| SLC22A15 | 163393 | 369502 | 19342 | 358514 | 35824 |
| SLC22A15 | 163393 | 481127 | 19343 | N/A | |
| SLC22A23 | 137266 | 436008 | 19344 | 410245 | 35825 |
| SLC22A23 | 137266 | 406686 | 19345 | 385028 | 35826 |
| SLC22A23 | 137266 | 497691 | 19346 | 417737 | 35827 |
| SLC22A23 | 137266 | 380302 | 19347 | 369657 | 35828 |
| SLC22A23 | 137266 | 490273 | 19348 | 419463 | 35829 |
| SLC22A23 | 137266 | 482874 | 19349 | N/A | |
| SLC22A23 | 137266 | 485307 | 19350 | 418134 | 35830 |
| SLC22A23 | 137266 | 467177 | 19351 | 418985 | 35831 |
| SLC22A23 | 137266 | 467144 | 19352 | N/A | |
| SLC22A23 | 137266 | 496753 | 19353 | N/A | |
| SLC22A23 | 137266 | 433689 | 19354 | N/A | |
| SLC22A23 | 137266 | 380298 | 19355 | 369653 | 35832 |
| SLC22A4 | 197208 | 200652 | 19356 | 200652 | 35833 |
| SLC22A4 | 197208 | 491257 | 19357 | N/A | |
| SLC22A4 | 197208 | 425923 | 19358 | N/A | |
| SLC22A6 | 197901 | 540654 | 19359 | 445946 | 35834 |

-continued

| Symbol | ENSG | ENST | SEQ ID | ENSP | SEQ ID |
|---|---|---|---|---|---|
| SLC22A6 | 197901 | 360421 | 19360 | 353597 | 35835 |
| SLC22A6 | 197901 | 377871 | 19361 | 367102 | 35836 |
| SLC22A6 | 197901 | 458333 | 19362 | 396401 | 35837 |
| SLC22A6 | 197901 | 421062 | 19363 | 404441 | 35838 |
| SLC22A6 | 197901 | 537349 | 19364 | N/A | |
| SLC22A8 | 149452 | 539841 | 19365 | N/A | |
| SLC22A8 | 149452 | 336232 | 19366 | 337335 | 35839 |
| SLC22A8 | 149452 | 451262 | 19367 | N/A | |
| SLC22A8 | 149452 | 545207 | 19368 | 441658 | 35840 |
| SLC22A8 | 149452 | 535878 | 19369 | 443368 | 35841 |
| SLC22A8 | 149452 | 311438 | 19370 | 311463 | 35842 |
| SLC22A8 | 149452 | 430500 | 19371 | 398548 | 35843 |
| SLC22A8 | 149452 | 542795 | 19372 | N/A | |
| SLC22A8 | 149452 | 542904 | 19373 | N/A | |
| SLC22A8 | 149452 | 544707 | 19374 | N/A | |
| SLC24A3 | 185052 | 328041 | 19375 | 333519 | 35844 |
| SLC24A3 | 185052 | 613834 | 19376 | 482967 | 35845 |
| SLC24A4 | 140090 | 393265 | 19377 | 376948 | 35846 |
| SLC24A4 | 140090 | 531433 | 19378 | 433302 | 35847 |
| SLC24A4 | 140090 | 532405 | 19379 | 431840 | 35848 |
| SLC24A4 | 140090 | 554461 | 19380 | 452099 | 35849 |
| SLC24A4 | 140090 | 525557 | 19381 | 432464 | 35850 |
| SLC24A4 | 140090 | 554925 | 19382 | N/A | |
| SLC24A4 | 140090 | 556739 | 19383 | N/A | |
| SLC24A4 | 140090 | 526482 | 19384 | N/A | |
| SLC25A18 | 182902 | 327451 | 19385 | 329033 | 35851 |
| SLC25A18 | 182902 | 399813 | 19386 | 382710 | 35852 |
| SLC25A18 | 182902 | 496051 | 19387 | N/A | |
| SLC25A18 | 182902 | 467228 | 19388 | N/A | |
| SLC25A18 | 182902 | 497401 | 19389 | N/A | |
| SLC25A18 | 182902 | 469889 | 19390 | N/A | |
| SLC25A29 | 197119 | 359232 | 19391 | 352167 | 35853 |
| SLC25A29 | 197119 | 554912 | 19392 | 450913 | 35854 |
| SLC25A29 | 197119 | 392908 | 19393 | 376640 | 35855 |
| SLC25A29 | 197119 | 556505 | 19394 | 452446 | 35856 |
| SLC25A29 | 197119 | 555927 | 19395 | 452078 | 35857 |
| SLC25A29 | 197119 | 554224 | 19396 | 451573 | 35858 |
| SLC25A29 | 197119 | 556715 | 19397 | 451952 | 35859 |
| SLC25A29 | 197119 | 554291 | 19398 | 452324 | 35860 |
| SLC25A29 | 197119 | 554060 | 19399 | 451644 | 35861 |
| SLC25A29 | 197119 | 556868 | 19400 | 451808 | 35862 |
| SLC25A29 | 197119 | 555475 | 19401 | N/A | |
| SLC25A29 | 197119 | 553359 | 19402 | N/A | |
| SLC25A29 | 197119 | 556873 | 19403 | N/A | |
| SLC25A29 | 197119 | 553574 | 19404 | N/A | |
| SLC25A29 | 197119 | 555051 | 19405 | N/A | |
| SLC25A29 | 197119 | 555949 | 19406 | N/A | |
| SLC25A29 | 197119 | 557438 | 19407 | N/A | |
| SLC25A29 | 197119 | 555888 | 19408 | N/A | |
| SLC25A29 | 197119 | 556201 | 19409 | N/A | |
| SLC25A29 | 197119 | 556844 | 19410 | N/A | |
| SLC25A3 | 075415 | 401722 | 19411 | 383898 | 35863 |
| SLC25A3 | 075415 | 188376 | 19412 | 188376 | 35864 |
| SLC25A3 | 075415 | 551917 | 19413 | 447310 | 35865 |
| SLC25A3 | 075415 | 546766 | 19414 | N/A | |
| SLC25A3 | 075415 | 548046 | 19415 | 447339 | 35866 |
| SLC25A3 | 075415 | 552981 | 19416 | 448708 | 35867 |
| SLC25A3 | 075415 | 551265 | 19417 | 448969 | 35868 |
| SLC25A3 | 075415 | 550695 | 19418 | 449479 | 35869 |
| SLC25A3 | 075415 | 547534 | 19419 | 449793 | 35870 |
| SLC25A3 | 075415 | 549338 | 19420 | 447740 | 35871 |
| SLC25A3 | 075415 | 551123 | 19421 | 449009 | 35872 |
| SLC25A3 | 075415 | 548847 | 19422 | 449166 | 35873 |
| SLC25A3 | 075415 | 547908 | 19423 | N/A | |
| SLC25A3 | 075415 | 547444 | 19424 | N/A | |
| SLC25A3 | 075415 | 548480 | 19425 | N/A | |
| SLC25A3 | 075415 | 547869 | 19426 | N/A | |
| SLC25A3 | 075415 | 228318 | 19427 | 228318 | 35874 |
| SLC25A33 | 171612 | 302692 | 19428 | 306328 | 35875 |
| SLC25A6 | 169100 | 381401 | 19429 | 370808 | 35876 |
| SLC25A6 | 169100 | 475167 | 19430 | N/A | |
| SLC25A6 | 169100 | 484026 | 19431 | N/A | |
| SLC26A3 | 091138 | 379083 | 19432 | 368375 | 35877 |
| SLC26A3 | 091138 | 340010 | 19433 | 345873 | 358/8 |
| SLC26A3 | 091138 | 469651 | 19434 | N/A | |
| SLC26A3 | 091138 | 468551 | 19435 | N/A | |

-continued

| Symbol | ENSG | ENST | SEQ ID | ENSP | SEQ ID |
|---|---|---|---|---|---|
| SLC26A3 | 091138 | 453332 | 19436 | 395955 | 35879 |
| SLC26A5 | 170615 | 339444 | 19437 | 342396 | 35880 |
| SLC26A5 | 170615 | 356767 | 19438 | 349210 | 35881 |
| SLC26A5 | 170615 | 393735 | 19439 | 377336 | 35882 |
| SLC26A5 | 170615 | 445809 | 19440 | 396833 | 35883 |
| SLC26A5 | 170615 | 454864 | 19441 | 416502 | 35884 |
| SLC26A5 | 170615 | 393730 | 19442 | 377331 | 35885 |
| SLC26A5 | 170615 | 306312 | 19443 | 304783 | 35886 |
| SLC26A5 | 170615 | 423416 | 19444 | 389018 | 3588/ |
| SLC26A5 | 170615 | 456463 | 19445 | 395568 | 35888 |
| SLC26A5 | 170615 | 393729 | 19446 | 377330 | 35889 |
| SLC26A5 | 170615 | 393727 | 19447 | 377328 | 35890 |
| SLC26A5 | 170615 | 393723 | 19448 | 377324 | 35891 |
| SLC26A5 | 170615 | 487407 | 19449 | N/A | |
| SLC26A5 | 170615 | 432958 | 19450 | 389733 | 35892 |
| SLC26A5 | 170615 | 354356 | 19451 | 346325 | 35893 |
| SLC26A8 | 112053 | 490799 | 19452 | 417638 | 35894 |
| SLC26A8 | 112053 | 466805 | 19453 | N/A | |
| SLC26A8 | 112053 | 394602 | 19454 | 378100 | 35895 |
| SLC26A8 | 112053 | 355574 | 19455 | 347778 | 35896 |
| SLC26A8 | 112053 | 465492 | 19456 | 418107 | 35897 |
| SLC26A8 | 112053 | 486155 | 19457 | N/A | |
| SLC26A8 | 112053 | 469847 | 19458 | 419700 | 35898 |
| SLC26A8 | 112053 | 480663 | 19459 | 420488 | 35899 |
| SLC27A6 | 113396 | 508645 | 19460 | 421759 | 35900 |
| SLC27A6 | 113396 | 262462 | 19461 | 262462 | 35901 |
| SLC27A6 | 113396 | 395266 | 19462 | 378684 | 35902 |
| SLC27A6 | 113396 | 506176 | 19463 | 421024 | 35903 |
| SLC2A10 | 197496 | 359271 | 19464 | 352216 | 35904 |
| SLC2A10 | 197496 | 486000 | 19465 | 478679 | 35905 |
| SLC2A10 | 197496 | 611837 | 19466 | N/A | |
| SLC2A13 | 151229 | 280871 | 19467 | 280871 | 35906 |
| SLC2A13 | 151229 | 465517 | 19468 | N/A | |
| SLC2A13 | 151229 | 505338 | 19469 | N/A | |
| SLC2A13 | 151229 | 380858 | 19470 | 370239 | 35907 |
| SLC2A3 | 059804 | 075120 | 19471 | 075120 | 35908 |
| SLC2A3 | 059804 | 543435 | 19472 | N/A | |
| SLC2A3 | 059804 | 486749 | 19473 | N/A | |
| SLC2A3 | 059804 | 469295 | 19474 | N/A | |
| SLC2A3 | 059804 | 479059 | 19475 | N/A | |
| SLC2A3 | 059804 | 490763 | 19476 | N/A | |
| SLC2A3 | 059804 | 495813 | 19477 | N/A | |
| SLC2A3 | 059804 | 544291 | 19478 | 440750 | 35909 |
| SLC2A3 | 059804 | 544936 | 19479 | 441496 | 35910 |
| SLC2A3 | 059804 | 476634 | 19480 | N/A | |
| SLC2A3 | 059804 | 541671 | 19481 | N/A | |
| SLC2A4 | 181856 | 317370 | 19482 | 320935 | 35911 |
| SLC2A4 | 181856 | 572485 | 19483 | 461086 | 35912 |
| SLC2A4 | 181856 | 571308 | 19484 | 459864 | 35913 |
| SLC2A4 | 181856 | 570783 | 19485 | 459056 | 35914 |
| SLC2A4 | 181856 | 424875 | 19486 | 396887 | 35915 |
| SLC30A3 | 115194 | 497341 | 19487 | N/A | |
| SLC30A3 | 115194 | 482990 | 19488 | N/A | |
| SLC30A3 | 115194 | 233535 | 19489 | 233535 | 35916 |
| SLC30A3 | 115194 | 445870 | 19490 | 388219 | 35917 |
| SLC30A3 | 115194 | 432351 | 19491 | 414320 | 35918 |
| SLC30A3 | 115194 | 426924 | 19492 | 393545 | 35919 |
| SLC30A3 | 115194 | 424577 | 19493 | 403959 | 35920 |
| SLC30A3 | 115194 | 486309 | 19494 | N/A | |
| SLC30A3 | 115194 | 450118 | 19495 | 403912 | 35921 |
| SLC30A3 | 115194 | 426569 | 19496 | 392673 | 35922 |
| SLC31A2 | 136867 | 259392 | 19497 | 259392 | 35923 |
| SLC31A2 | 136867 | 490809 | 19498 | N/A | |
| SLC31A2 | 136867 | 374220 | 19499 | 363337 | 35924 |
| SLC32A1 | 101438 | 217420 | 19500 | 217420 | 35925 |
| SLC35D1 | 116704 | 235345 | 19501 | 235345 | 35926 |
| SLC35F1 | 196376 | 360388 | 19502 | 353557 | 35927 |
| SLC35F1 | 196376 | 621341 | 19503 | 484738 | 35928 |
| SLC35F4 | 151812 | 556826 | 19504 | 452086 | 35929 |
| SLC35F4 | 151812 | 554729 | 19505 | 451990 | 35930 |
| SLC35F4 | 151812 | 557254 | 19506 | 450836 | 35931 |
| SLC35F4 | 151812 | 556306 | 19507 | 452196 | 35932 |
| SLC35F4 | 151812 | 557430 | 19508 | N/A | |
| SLC35F4 | 151812 | 556568 | 19509 | N/A | |
| SLC35F4 | 151812 | 554648 | 19510 | N/A | |
| SLC35F4 | 151812 | 339762 | 19511 | 342518 | 35933 |
| SLC38A1 | 111371 | 398637 | 19512 | 381634 | 35934 |
| SLC38A1 | 111371 | 549049 | 19513 | 449607 | 35935 |
| SLC38A1 | 111371 | 439706 | 19514 | 398142 | 35936 |
| SLC38A1 | 111371 | 546893 | 19515 | 447853 | 35937 |
| SLC38A1 | 111371 | 552197 | 19516 | 449756 | 35938 |
| SLC38A1 | 111371 | 548979 | 19517 | N/A | |
| SLC38A1 | 111371 | 549633 | 19518 | N/A | |
| SLC38A1 | 111371 | 551506 | 19519 | N/A | |
| SLC38A1 | 111371 | 550173 | 19520 | 449744 | 35939 |
| SLC38A1 | 111371 | 546519 | 19521 | N/A | |
| SLC38A1 | 111371 | 612161 | 19522 | 478907 | 35940 |
| SLC38A10 | 157637 | 374759 | 19523 | 363891 | 35941 |
| SLC38A10 | 157637 | 539643 | 19524 | N/A | |
| SLC38A10 | 157637 | 540966 | 19525 | 437601 | 35942 |
| SLC38A10 | 157637 | 576151 | 19526 | 458273 | 35943 |
| SLC38A10 | 157637 | 542075 | 19527 | N/A | |
| SLC38A10 | 157637 | 573058 | 19528 | N/A | |
| SLC38A10 | 157637 | 288439 | 19529 | 288439 | 35944 |
| SLC38A10 | 157637 | 546352 | 19530 | N/A | |
| SLC38A10 | 157637 | 543204 | 19531 | 444523 | 35945 |
| SLC38A10 | 157637 | 539748 | 19532 | 439115 | 35946 |
| SLC38A10 | 157637 | 540233 | 19533 | N/A | |
| SLC38A5 | 017483 | 595796 | 19534 | 471683 | 35947 |
| SLC38A5 | 017483 | 619100 | 19535 | 478807 | 35948 |
| SLC38A5 | 017483 | 497336 | 19536 | N/A | |
| SLC38A5 | 017483 | 615300 | 19537 | N/A | |
| SLC38A5 | 017483 | 480105 | 19538 | N/A | |
| SLC38A5 | 017483 | 494034 | 19539 | 482638 | 35949 |
| SLC38A5 | 017483 | 440085 | 19540 | 402988 | 35950 |
| SLC38A5 | 017483 | 441948 | 19541 | 407258 | 35951 |
| SLC38A5 | 017483 | 413668 | 19542 | 403976 | 35952 |
| SLC38A5 | 017483 | 416711 | 19543 | 389644 | 35953 |
| SLC38A5 | 017483 | 488083 | 19544 | 483716 | 35954 |
| SLC38A5 | 017483 | 429543 | 19545 | 416948 | 35955 |
| SLC38A5 | 017483 | 620913 | 19546 | 481291 | 35956 |
| SLC38A5 | 017483 | 622196 | 19547 | 484236 | 35957 |
| SLC38A7 | 103042 | 570101 | 19548 | 454646 | 35958 |
| SLC38A7 | 103042 | 219320 | 19549 | 219320 | 35959 |
| SLC38A7 | 103042 | 564100 | 19550 | 454325 | 35960 |
| SLC38A7 | 103042 | 566598 | 19551 | 455119 | 35961 |
| SLC38A7 | 103042 | 564010 | 19552 | 455362 | 35962 |
| SLC38A7 | 103042 | 566953 | 19553 | N/A | |
| SLC38A7 | 103042 | 562149 | 19554 | N/A | |
| SLC38A7 | 103042 | 569209 | 19555 | N/A | |
| SLC38A7 | 103042 | 565785 | 19556 | 457988 | 35963 |
| SLC38A7 | 103042 | 570214 | 19557 | 456464 | 35964 |
| SLC38A7 | 103042 | 562397 | 19558 | 455490 | 35965 |
| SLC38A7 | 103042 | 563196 | 19559 | 454734 | 35966 |
| SLC38A7 | 103042 | 564391 | 19560 | 457462 | 35967 |
| SLC38A7 | 103042 | 564720 | 19561 | N/A | |
| SLC38A7 | 103042 | 567930 | 19562 | N/A | |
| SLC38A7 | 103042 | 564964 | 19563 | N/A | |
| SLC39A12 | 148482 | 377374 | 19564 | 366591 | 35968 |
| SLC39A12 | 148482 | 377371 | 19565 | 366588 | 35969 |
| SLC39A12 | 148482 | 539911 | 19566 | 440445 | 35970 |
| SLC39A12 | 148482 | 377369 | 19567 | 366586 | 35971 |
| SLC41A1 | 133065 | 367137 | 19568 | 356105 | 35972 |
| SLC41A1 | 133065 | 468057 | 19569 | N/A | |
| SLC41A1 | 133065 | 484228 | 19570 | N/A | |
| SLC41A1 | 133065 | 484000 | 19571 | N/A | |
| SLC43A2 | 278550 | 634102 | 19572 | 488355 | 35973 |
| SLC43A2 | 278550 | 612931 | 19573 | 483848 | 35974 |
| SLC43A2 | 278550 | 382147 | 19574 | 371582 | 35975 |
| SLC43A2 | 278550 | 632441 | 19575 | N/A | |
| SLC43A2 | 278550 | 633495 | 19576 | N/A | |
| SLC43A2 | 278550 | 616586 | 19577 | N/A | |
| SLC43A2 | 278550 | 632428 | 19578 | N/A | |
| SLC43A2 | 278550 | 633994 | 19579 | 488706 | 35976 |
| SLC43A2 | 278550 | 634196 | 19580 | N/A | |
| SLC43A2 | 278550 | 633255 | 19581 | 487944 | 35977 |
| SLC43A2 | 278550 | 631603 | 19582 | 487841 | 35978 |
| SLC43A2 | 278550 | 632084 | 19583 | N/A | |
| SLC43A2 | 278550 | 613070 | 19584 | 484291 | 35979 |
| SLC43A2 | 167703 | 301335 | 19585 | 301335 | 35980 |
| SLC43A2 | 167703 | 571650 | 19586 | 461382 | 35981 |
| SLC43A2 | 167703 | 412517 | 19587 | 408284 | 35982 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| SLC43A2 | 167703 | 576537 | 19588 | N/A | | | SLC5A11 | 158865 | 567758 | 19664 | 454401 | 36039 |
| SLC43A2 | 167703 | 576769 | 19589 | N/A | | | SLC5A11 | 158865 | 569071 | 19665 | 456376 | 36040 |
| SLC43A2 | 167703 | 572135 | 19590 | N/A | | | SLC5A11 | 158865 | 565586 | 19666 | N/A | |
| SLC43A2 | 167703 | 574743 | 19591 | N/A | | | SLC5A11 | 158865 | 545376 | 19667 | 441384 | 36041 |
| SLC43A2 | 167703 | 572801 | 19592 | 461298 | 35983 | | SLC5A11 | 158865 | 449109 | 19668 | 389606 | 36042 |
| SLC43A2 | 167703 | 574274 | 19593 | N/A | | | SLC5A11 | 158865 | 424767 | 19669 | 416782 | 36043 |
| SLC43A2 | 167703 | 576721 | 19594 | 460388 | 35984 | 10 | SLC5A4 | 100191 | 266086 | 19670 | 266086 | 36044 |
| SLC43A2 | 167703 | 571376 | 19595 | 461553 | 35985 | | SLC5A7 | 115665 | 409059 | 19671 | 387346 | 36045 |
| SLC43A2 | 167703 | 575944 | 19596 | N/A | | | SLC5A7 | 115665 | 264047 | 19672 | 264047 | 36046 |
| SLC43A3 | 134802 | 625097 | 19597 | N/A | | | SLC5A8 | 256870 | 536262 | 19673 | 445340 | 36047 |
| SLC43A3 | 134802 | 395123 | 19598 | 378555 | 35986 | | SLC5A8 | 262217 | 572861 | 19674 | 461697 | 36048 |
| SLC43A3 | 134802 | 395124 | 19599 | 378556 | 35987 | | SLC6A12 | 111181 | 359674 | 19675 | 352702 | 36049 |
| SLC43A3 | 134802 | 352187 | 19600 | 337561 | 35988 | 15 | SLC6A12 | 111181 | 545058 | 19676 | N/A | |
| SLC43A3 | 134802 | 529554 | 19601 | 436254 | 35989 | | SLC6A12 | 111181 | 424061 | 19677 | 399136 | 36050 |
| SLC43A3 | 134802 | 525205 | 19602 | 433078 | 35990 | | SLC6A12 | 111181 | 536824 | 19678 | 444268 | 36051 |
| SLC43A3 | 134802 | 533524 | 19603 | 434515 | 35991 | | SLC6A12 | 111181 | 542825 | 19679 | N/A | |
| SLC43A3 | 134802 | 530005 | 19604 | 435893 | 35992 | | SLC6A12 | 111181 | 535498 | 19680 | N/A | |
| SLC43A3 | 134802 | 528098 | 19605 | N/A | | | SLC6A12 | 111181 | 544782 | 19681 | N/A | |
| SLC43A3 | 134802 | 529113 | 19606 | 434293 | 35993 | 20 | SLC6A12 | 111181 | 538272 | 19682 | N/A | |
| SLC43A3 | 134802 | 525474 | 19607 | 436055 | 35994 | | SLC6A12 | 111181 | 540094 | 19683 | N/A | |
| SLC43A3 | 134802 | 529112 | 19608 | 434913 | 35995 | | SLC6A12 | 111181 | 538580 | 19684 | N/A | |
| SLC43A3 | 134802 | 526125 | 19609 | N/A | | | SLC6A12 | 111181 | 536116 | 19685 | N/A | |
| SLC43A3 | 134802 | 530232 | 19610 | N/A | | | SLC6A12 | 111181 | 537793 | 19686 | 439351 | 36052 |
| SLC43A3 | 134802 | 528187 | 19611 | 435273 | 35996 | | SLC6A12 | 111181 | 535347 | 19687 | 446082 | 36053 |
| SLC43A3 | 134802 | 529494 | 19612 | 433974 | 35997 | | SLC6A12 | 111181 | 537826 | 19688 | N/A | |
| SLC43A3 | 134802 | 533245 | 19613 | 431762 | 35998 | 25 | SLC6A12 | 111181 | 538424 | 19689 | N/A | |
| SLC43A3 | 134802 | 533235 | 19614 | 435156 | 35999 | | SLC6A12 | 111181 | 397296 | 19690 | 380464 | 36054 |
| SLC43A3 | 134802 | 524863 | 19615 | 434569 | 36000 | | SLC6A13 | 010379 | 343164 | 19691 | 339260 | 36055 |
| SLC43A3 | 134802 | 532795 | 19616 | 435109 | 36001 | | SLC6A13 | 010379 | 539668 | 19692 | N/A | |
| SLC43A3 | 134802 | 533051 | 19617 | 435490 | 36002 | | SLC6A13 | 010379 | 542379 | 19693 | N/A | |
| SLC43A3 | 134802 | 529896 | 19618 | 431367 | 36003 | | SLC6A13 | 010379 | 543722 | 19694 | N/A | |
| SLC43A3 | 134802 | 526621 | 19619 | 434710 | 36004 | 30 | SLC6A13 | 010379 | 542947 | 19695 | N/A | |
| SLC43A3 | 134802 | 530316 | 19620 | 431765 | 36005 | | SLC6A13 | 010379 | 546319 | 19696 | 444606 | 36056 |
| SLC43A3 | 134802 | 529748 | 19621 | 433393 | 36006 | | SLC6A13 | 010379 | 536842 | 19697 | N/A | |
| SLC43A3 | 134802 | 532278 | 19622 | 434371 | 36007 | | SLC6A13 | 010379 | 534887 | 19698 | N/A | |
| SLC44A5 | 137968 | 370859 | 19623 | 359896 | 36008 | | SLC6A13 | 010379 | 539260 | 19699 | 437386 | 36057 |
| SLC44A5 | 137968 | 370855 | 19624 | 359892 | 36009 | | SLC6A13 | 010379 | 542272 | 19700 | 443466 | 36058 |
| SLC44A5 | 137968 | 469525 | 19625 | N/A | | 35 | SLC6A13 | 010379 | 436453 | 19701 | 389316 | 36059 |
| SLC45A1 | 162426 | 471889 | 19626 | 418096 | 36010 | | SLC6A13 | 010379 | 445055 | 19702 | 407104 | 36060 |
| SLC45A1 | 162426 | 497660 | 19627 | N/A | | | SLC6A7 | 011083 | 230671 | 19703 | 230671 | 36061 |
| SLC45A1 | 162426 | 481265 | 19628 | N/A | | | SLC6A7 | 011083 | 524041 | 19704 | 428200 | 36062 |
| SLC45A1 | 162426 | 289877 | 19629 | 289877 | 36011 | | SLC6A7 | 011083 | 513403 | 19705 | N/A | |
| SLC45A3 | 158715 | 460934 | 19630 | N/A | | | SLC7A1 | 139514 | 380752 | 19706 | 370128 | 36063 |
| SLC45A3 | 158715 | 367145 | 19631 | 356113 | 36012 | 40 | SLC7A1 | 139514 | 473577 | 19707 | N/A | |
| SLC4A4 | 080493 | 264485 | 19632 | 264485 | 36013 | | SLC7A1 | 139514 | 450494 | 19708 | 390092 | 36064 |
| SLC4A4 | 080493 | 351898 | 19633 | 307349 | 36014 | | SLC7A10 | 130876 | 253188 | 19709 | 253188 | 36065 |
| SLC4A4 | 080493 | 639096 | 19634 | 491107 | 36015 | | SLC7A10 | 130876 | 590490 | 19710 | N/A | |
| SLC4A4 | 080493 | 638464 | 19635 | 492496 | 36016 | | SLC7A10 | 130876 | 590036 | 19711 | 465421 | 36066 |
| SLC4A4 | 080493 | 514331 | 19636 | N/A | | | SLC7A10 | 130876 | 587064 | 19712 | 466876 | 36067 |
| SLC4A4 | 080493 | 512686 | 19637 | 422400 | 36017 | | SLC7A10 | 130876 | 592596 | 19713 | 466410 | 36068 |
| SLC4A4 | 080493 | 340595 | 19638 | 344272 | 36018 | 45 | SLC7A11 | 151012 | 509248 | 19714 | 424046 | 36069 |
| SLC4A4 | 080493 | 425175 | 19639 | 393557 | 36019 | | SLC7A11 | 151012 | 280612 | 19715 | 280612 | 36070 |
| SLC4A7 | 033867 | 419036 | 19640 | 411031 | 36020 | | SLC7A14 | 013293 | 231706 | 19716 | 231706 | 36071 |
| SLC4A7 | 033867 | 295736 | 19641 | 295736 | 36021 | | SLC7A14 | 013293 | 466168 | 19717 | N/A | |
| SLC4A7 | 033867 | 428386 | 19642 | 416368 | 36022 | | SLC7A3 | 165349 | 374299 | 19718 | 363417 | 36072 |
| SLC4A7 | 033867 | 454389 | 19643 | 390394 | 36023 | | SLC7A3 | 165349 | 298085 | 19719 | 298085 | 36073 |
| SLC4A7 | 033867 | 440156 | 19644 | 414797 | 36024 | 50 | SLC7A5 | 103257 | 565644 | 19720 | 454323 | 36074 |
| SLC4A7 | 033867 | 457377 | 19645 | 408323 | 36025 | | SLC7A5 | 103257 | 261622 | 19721 | 261622 | 36075 |
| SLC4A7 | 033867 | 438530 | 19646 | 407304 | 36026 | | SLC7A5 | 103257 | 563489 | 19722 | N/A | |
| SLC4A7 | 033867 | 437179 | 19647 | 394252 | 36027 | | SLC8A1 | 183023 | 406785 | 19723 | 383886 | 36076 |
| SLC4A7 | 033867 | 446700 | 19648 | 406605 | 36028 | | SLC8A1 | 183023 | 407929 | 19724 | 386116 | 36077 |
| SLC4A7 | 033867 | 455077 | 19649 | 407382 | 36029 | | SLC8A1 | 183023 | 403092 | 19725 | 384763 | 36078 |
| SLC4A7 | 033867 | 445684 | 19650 | 406804 | 36030 | 55 | SLC8A1 | 183023 | 405901 | 19726 | 385678 | 36079 |
| SLC4A7 | 033867 | 465487 | 19651 | N/A | | | SLC8A1 | 183023 | 402441 | 19727 | 385188 | 36080 |
| SLC4A7 | 033867 | 437266 | 19652 | 409418 | 36031 | | SLC8A1 | 183023 | 405269 | 19728 | 385535 | 36081 |
| SLC4A7 | 033867 | 428179 | 19653 | 388703 | 36032 | | SLC8A1 | 183023 | 408028 | 19729 | 384908 | 36082 |
| SLC4A7 | 033867 | 475120 | 19654 | N/A | | | SLC8A1 | 183023 | 455476 | 19730 | 389330 | 36083 |
| SLC4A7 | 033867 | 491211 | 19655 | N/A | | | SLC8A1 | 183023 | 448531 | 19731 | 398575 | 36084 |
| SLC4A7 | 033867 | 428005 | 19656 | N/A | | 60 | SLC8A1 | 183023 | 417271 | 19732 | 412560 | 36085 |
| SLC4A7 | 033867 | 425128 | 19657 | 401949 | 36033 | | SLC8A1 | 183023 | 332839 | 19733 | 332931 | 36086 |
| SLC5A11 | 158865 | 347898 | 19658 | 289932 | 36034 | | SLC8A1 | 183023 | 406391 | 19734 | 385811 | 36087 |
| SLC5A11 | 158865 | 488922 | 19659 | 458806 | 36035 | | SLC8A1-AS1 | 227028 | 599740 | 19735 | N/A | |
| SLC5A11 | 158865 | 564125 | 19660 | N/A | | | SLC8A1-AS1 | 227028 | 628471 | 19736 | N/A | |
| SLC5A11 | 158865 | 565769 | 19661 | 457179 | 36036 | | SLC8A1-AS1 | 227028 | 631142 | 19737 | N/A | |
| SLC5A11 | 158865 | 569520 | 19662 | 454732 | 36037 | 65 | SLC8A1-AS1 | 227028 | 627210 | 19738 | N/A | |
| SLC5A11 | 158865 | 568579 | 19663 | 456234 | 36038 | | SLC8A1-AS1 | 227028 | 631330 | 19739 | N/A | |

-continued

| Symbol | ENSG | ENST | SEQ ID | ENSP | SEQ ID |
|---|---|---|---|---|---|
| SLC8A1-AS1 | 227028 | 627538 | 19740 | N/A | |
| SLC8A1-AS1 | 227028 | 630783 | 19741 | N/A | |
| SLC8A1-AS1 | 227028 | 626098 | 19742 | N/A | |
| SLC8A1-AS1 | 227028 | 630006 | 19743 | N/A | |
| SLC8A1-AS1 | 227028 | 418854 | 19744 | N/A | |
| SLC8A1-AS1 | 227028 | 439606 | 19745 | N/A | |
| SLC8A1-AS1 | 227028 | 629157 | 19746 | N/A | |
| SLC8A1-AS1 | 227028 | 599268 | 19747 | N/A | |
| SLC8A1-AS1 | 227028 | 597385 | 19748 | N/A | |
| SLC8A1-AS1 | 227028 | 625234 | 19749 | N/A | |
| SLC8A1-AS1 | 227028 | 631204 | 19750 | N/A | |
| SLC8A1-AS1 | 227028 | 629180 | 19751 | N/A | |
| SLC8A1-AS1 | 227028 | 625324 | 19752 | N/A | |
| SLC8A1-AS1 | 227028 | 627108 | 19753 | N/A | |
| SLC8A1-AS1 | 227028 | 601679 | 19754 | N/A | |
| SLC8A1-AS1 | 227028 | 627219 | 19755 | N/A | |
| SLC8A1-AS1 | 227028 | 593878 | 19756 | N/A | |
| SLC8A1-AS1 | 227028 | 596532 | 19757 | N/A | |
| SLC8A1-AS1 | 227028 | 599956 | 19758 | N/A | |
| SLC8A1-AS1 | 227028 | 597170 | 19759 | N/A | |
| SLC8A1-AS1 | 227028 | 629329 | 19760 | N/A | |
| SLC8A1-AS1 | 227028 | 631137 | 19761 | N/A | |
| SLC8A1-AS1 | 227028 | 625381 | 19762 | N/A | |
| SLC8A1-AS1 | 227028 | 631022 | 19763 | N/A | |
| SLC8A1-AS1 | 227028 | 444629 | 19764 | N/A | |
| SLC8A1-AS1 | 227028 | 610721 | 19765 | N/A | |
| SLC8A1-AS1 | 227028 | 598247 | 19766 | N/A | |
| SLC8A1-AS1 | 227028 | 593848 | 19767 | N/A | |
| SLC8A1-AS1 | 227028 | 435515 | 19768 | N/A | |
| SLC8A1-AS1 | 227028 | 625780 | 19769 | N/A | |
| SLC8A1-AS1 | 227028 | 620276 | 19770 | N/A | |
| SLC8A1-AS1 | 227028 | 611583 | 19771 | N/A | |
| SLC8A1-AS1 | 227028 | 427354 | 19772 | N/A | |
| SLC8A1-AS1 | 227028 | 413479 | 19773 | N/A | |
| SLC8A1-AS1 | 227028 | 619351 | 19774 | N/A | |
| SLC8A1-AS1 | 227028 | 417875 | 19775 | N/A | |
| SLC8A2 | 118160 | 236877 | 19776 | 236877 | 36088 |
| SLC8A2 | 118160 | 542837 | 19777 | 437536 | 36089 |
| SLC8A2 | 118160 | 539381 | 19778 | N/A | |
| SLC8A2 | 118160 | 600576 | 19779 | N/A | |
| SLC8A2 | 118160 | 601757 | 19780 | N/A | |
| SLC8A2 | 118160 | 594353 | 19781 | 472233 | 36090 |
| SLC8A2 | 118160 | 597014 | 19782 | 472208 | 36091 |
| SLC8A3 | 100678 | 356921 | 19783 | 349392 | 36092 |
| SLC8A3 | 100678 | 494208 | 19784 | 436332 | 36093 |
| SLC8A3 | 100678 | 381269 | 19785 | 370669 | 36094 |
| SLC8A3 | 100678 | 216568 | 19786 | 216568 | 36095 |
| SLC8A3 | 100678 | 394330 | 19787 | 377863 | 36096 |
| SLC8A3 | 100678 | 534137 | 19788 | 436688 | 36097 |
| SLC8A3 | 100678 | 528359 | 19789 | 433531 | 36098 |
| SLC8A3 | 100678 | 533541 | 19790 | 437103 | 36099 |
| SLC8A3 | 100678 | 533899 | 19791 | N/A | |
| SLC8A3 | 100678 | 357887 | 19792 | 350560 | 36100 |
| SLC8B1 | 089060 | 552014 | 19793 | 447091 | 36101 |
| SLC8B1 | 089060 | 552565 | 19794 | N/A | |
| SLC8B1 | 089060 | 550672 | 19795 | 448758 | 36102 |
| SLC8B1 | 089060 | 550047 | 19796 | 447585 | 36103 |
| SLC8B1 | 089060 | 549069 | 19797 | 449519 | 36104 |
| SLC8B1 | 089060 | 546737 | 19798 | 450081 | 36105 |
| SLC8B1 | 089060 | 553238 | 19799 | N/A | |
| SLC8B1 | 089060 | 551230 | 19800 | N/A | |
| SLC8B1 | 089060 | 548477 | 19801 | N/A | |
| SLC8B1 | 089060 | 549181 | 19802 | 448703 | 36106 |
| SLC8B1 | 089060 | 549605 | 19803 | 448749 | 36107 |
| SLC8B1 | 089060 | 552613 | 19804 | 447502 | 36108 |
| SLC8B1 | 089060 | 548186 | 19805 | 449448 | 36109 |
| SLC8B1 | 089060 | 549372 | 19806 | 447972 | 36110 |
| SLC8B1 | 089060 | 548518 | 19807 | N/A | |
| SLC8B1 | 089060 | 202831 | 19808 | 202831 | 36111 |
| SLC9A3 | 066230 | 264938 | 19809 | 264938 | 36112 |
| SLC9A3 | 066230 | 514375 | 19810 | 422983 | 36113 |
| SLC9A3 | 066230 | 507407 | 19811 | N/A | |
| SLC9A3 | 281861 | 628307 | 19812 | 486364 | 36114 |
| SLC9A3 | 281861 | 626862 | 19813 | 486297 | 36115 |
| SLC9A9 | 181804 | 316549 | 19814 | 320246 | 36116 |
| SLC9A9 | 181804 | 483124 | 19815 | N/A | |

-continued

| Symbol | ENSG | ENST | SEQ ID | ENSP | SEQ ID |
|---|---|---|---|---|---|
| SLC9A9 | 181804 | 474727 | 19816 | 419090 | 36117 |
| SLC9A9 | 181804 | 474151 | 19817 | 418627 | 36118 |
| SLC9A9 | 181804 | 498717 | 19818 | N/A | |
| SLCO2B1 | 137491 | 526660 | 19819 | N/A | |
| SLCO2B1 | 137491 | 531713 | 19820 | 432889 | 36119 |
| SLCO2B1 | 137491 | 289575 | 19821 | 289575 | 36120 |
| SLCO2B1 | 137491 | 532236 | 19822 | 434112 | 36121 |
| SLCO2B1 | 137491 | 531756 | 19823 | N/A | |
| SLCO2B1 | 137491 | 531457 | 19824 | N/A | |
| SLCO2B1 | 137491 | 525650 | 19825 | 436324 | 36122 |
| SLCO2B1 | 137491 | 454962 | 19826 | 389653 | 36123 |
| SLCO2B1 | 137491 | 530556 | 19827 | 435384 | 36124 |
| SLCO2B1 | 137491 | 534004 | 19828 | 431192 | 36125 |
| SLCO2B1 | 137491 | 527180 | 19829 | 436513 | 36126 |
| SLCO2B1 | 137491 | 525845 | 19830 | 431324 | 36127 |
| SLCO2B1 | 137491 | 534186 | 19831 | 433872 | 36128 |
| SLCO2B1 | 137491 | 428359 | 19832 | 388912 | 36129 |
| SLCO2B1 | 137491 | 526839 | 19833 | 434742 | 36130 |
| SLCO2B1 | 137491 | 530012 | 19834 | N/A | |
| SLCO2B1 | 137491 | 528108 | 19835 | N/A | |
| SLCO2B1 | 137491 | 530015 | 19836 | N/A | |
| SLCO2B1 | 137491 | 341411 | 19837 | N/A | |
| SLCO4A1 | 101187 | 497209 | 19838 | 434245 | 36131 |
| SLCO4A1 | 101187 | 370507 | 19839 | 359538 | 36132 |
| SLCO4A1 | 101187 | 470412 | 19840 | N/A | |
| SLCO4A1 | 101187 | 495889 | 19841 | N/A | |
| SLCO4A1 | 101187 | 466961 | 19842 | N/A | |
| SLCO4A1 | 101187 | 451793 | 19843 | 414855 | 36133 |
| SLCO4A1 | 101187 | 497919 | 19844 | N/A | |
| SLCO4A1 | 101187 | 466818 | 19845 | N/A | |
| SLCO4A1 | 101187 | 217159 | 19846 | 217159 | 36134 |
| SLCO4C1 | 173930 | 310954 | 19847 | 309741 | 36135 |
| SLFN11 | 172716 | 589562 | 19848 | N/A | |
| SLFN11 | 172716 | 588579 | 19849 | 468602 | 36136 |
| SLFN11 | 172716 | 427966 | 19850 | 395140 | 36137 |
| SLFN11 | 172716 | 430814 | 19851 | 397454 | 36138 |
| SLFN11 | 172716 | 589811 | 19852 | 468095 | 36139 |
| SLFN11 | 172716 | 441608 | 19853 | 393615 | 36140 |
| SLFN11 | 172716 | 591682 | 19854 | 464806 | 36141 |
| SLFN11 | 172716 | 394566 | 19855 | 378067 | 36142 |
| SLFN11 | 172716 | 592108 | 19856 | 465198 | 36143 |
| SLFN11 | 172716 | 586099 | 19857 | N/A | |
| SLFN11 | 172716 | 308377 | 19858 | 312402 | 36144 |
| SLFN11 | 172716 | 498396 | 19859 | N/A | |
| SLFN11 | 172716 | 592122 | 19860 | 465777 | 36145 |
| SLIT2 | 145147 | 503823 | 19861 | 427548 | 36146 |
| SLIT2 | 145147 | 504154 | 19862 | 422591 | 36147 |
| SLIT2 | 145147 | 273739 | 19863 | 273739 | 36148 |
| SLIT2 | 145147 | 503837 | 19864 | 422261 | 36149 |
| SLIT2 | 145147 | 508824 | 19865 | 426356 | 36150 |
| SLIT2 | 145147 | 509099 | 19866 | N/A | |
| SLIT2 | 145147 | 509394 | 19867 | N/A | |
| SLIT2 | 145147 | 511508 | 19868 | 421975 | 36151 |
| SLIT2 | 145147 | 509941 | 19869 | 425609 | 36152 |
| SLIT2 | 145147 | 512993 | 19870 | 423179 | 36153 |
| SLIT2 | 145147 | 508541 | 19871 | N/A | |
| SLIT2 | 145147 | 622093 | 19872 | 482129 | 36154 |
| SLIT3 | 184347 | 519560 | 19873 | 430333 | 36155 |
| SLIT3 | 184347 | 332966 | 19874 | 332164 | 36156 |
| SLIT3 | 184347 | 518092 | 19875 | N/A | |
| SLIT3 | 184347 | 519486 | 19876 | N/A | |
| SLIT3 | 184347 | 518140 | 19877 | N/A | |
| SLIT3 | 184347 | 521150 | 19878 | N/A | |
| SLIT3 | 184347 | 521130 | 19879 | N/A | |
| SLIT3 | 184347 | 404867 | 19880 | 384890 | 36157 |
| SLITRK1 | 178235 | 377084 | 19881 | 366288 | 36158 |
| SLITRK6 | 184564 | 400286 | 19882 | 383143 | 36159 |
| SMAD3 | 166949 | 559460 | 19883 | 453082 | 36160 |
| SMAD3 | 166949 | 327367 | 19884 | 332973 | 36161 |
| SMAD3 | 166949 | 559937 | 19885 | N/A | |
| SMAD3 | 166949 | 559092 | 19886 | 453788 | 36162 |
| SMAD3 | 166949 | 560175 | 19887 | 455095 | 36163 |
| SMAD3 | 166949 | 540846 | 19888 | 437757 | 36164 |
| SMAD3 | 166949 | 558894 | 19889 | 458060 | 36165 |
| SMAD3 | 166949 | 439724 | 19890 | 401133 | 36166 |
| SMAD3 | 166949 | 558739 | 19891 | 453684 | 36167 |

-continued

-continued

| Symbol | ENSG | ENST | SEQ ID | ENSP | SEQ ID |
|---|---|---|---|---|---|
| SMAD3 | 166949 | 537194 | 19892 | 445348 | 36168 |
| SMAD3 | 166949 | 558428 | 19893 | 454165 | 36169 |
| SMAD3 | 166949 | 558827 | 19894 | 452767 | 36170 |
| SMAD3 | 166949 | 560402 | 19895 | N/A | |
| SMAD3 | 166949 | 560424 | 19896 | 455540 | 36171 |
| SMAD3 | 166949 | 558763 | 19897 | N/A | |
| SMAD7 | 101665 | 262158 | 19898 | 262158 | 36172 |
| SMAD7 | 101665 | 545051 | 19899 | N/A | |
| SMAD7 | 101665 | 591805 | 19900 | 466902 | 36173 |
| SMAD7 | 101665 | 589634 | 19901 | 467621 | 36174 |
| SMAD7 | 101665 | 587336 | 19902 | N/A | |
| SMAD7 | 101665 | 585986 | 19903 | N/A | |
| SMAD7 | 101665 | 586093 | 19904 | 465590 | 36175 |
| SMAD7 | 101665 | 588190 | 19905 | N/A | |
| SMIM17 | 268182 | 598409 | 19906 | 471126 | 36176 |
| SMIM17 | 268182 | 600547 | 19907 | 472019 | 36177 |
| SMOC1 | 198732 | 555917 | 19908 | N/A | |
| SMOC1 | 198732 | 361956 | 19909 | 355110 | 36178 |
| SMOC1 | 198732 | 381280 | 19910 | 370680 | 36179 |
| SMOC1 | 198732 | 553839 | 19911 | N/A | |
| SMOC1 | 198732 | 557483 | 19912 | N/A | |
| SMPX | 091482 | 379494 | 19913 | 368808 | 36180 |
| SMPX | 091482 | 494525 | 19914 | N/A | |
| SNAI2 | 019549 | 020945 | 19915 | 020945 | 36181 |
| SNAI2 | 019549 | 396822 | 19916 | 380034 | 36182 |
| SNAI3-AS1 | 260630 | 563261 | 19917 | N/A | |
| SNAI3-AS1 | 260630 | 565633 | 19918 | N/A | |
| SNAI3-AS1 | 260630 | 569786 | 19919 | N/A | |
| SNAI3-AS1 | 260630 | 563475 | 19920 | N/A | |
| SNAI3-AS1 | 260630 | 568633 | 19921 | N/A | |
| SNAI3-AS1 | 260630 | 567997 | 19922 | N/A | |
| SNAPC1 | 023608 | 216294 | 19923 | 216294 | 36183 |
| SNCAIP | 064692 | 514467 | 19924 | 427090 | 36184 |
| SNCAIP | 064692 | 510658 | 19925 | 426526 | 36185 |
| SNCAIP | 064692 | 506272 | 19926 | 426551 | 36186 |
| SNCAIP | 064692 | 508681 | 19927 | 422610 | 36187 |
| SNCAIP | 064692 | 509154 | 19928 | 422106 | 36188 |
| SNCAIP | 064692 | 261368 | 19929 | 261368 | 36189 |
| SNCAIP | 064692 | 512385 | 19930 | 426280 | 36190 |
| SNCAIP | 064692 | 514497 | 19931 | 425063 | 36191 |
| SNCAIP | 064692 | 261367 | 19932 | 261367 | 36192 |
| SNCAIP | 064692 | 510003 | 19933 | N/A | |
| SNCAIP | 064692 | 509023 | 19934 | 427078 | 36193 |
| SNCAIP | 064692 | 508017 | 19935 | 424338 | 36194 |
| SNCAIP | 064692 | 509652 | 19936 | 427587 | 36195 |
| SNCAIP | 064692 | 512146 | 19937 | 423360 | 36196 |
| SNCAIP | 064692 | 395469 | 19938 | 378852 | 36197 |
| SNCAIP | 064692 | 395466 | 19939 | 378849 | 36198 |
| SNCAIP | 064692 | 515215 | 19940 | 427575 | 36199 |
| SNCAIP | 064692 | 513719 | 19941 | N/A | |
| SNCAIP | 064692 | 379538 | 19942 | 368854 | 36200 |
| SNCAIP | 064692 | 414317 | 19943 | 394392 | 36201 |
| SNCAIP | 064692 | 504884 | 19944 | 426904 | 36202 |
| SNCAIP | 064692 | 542191 | 19945 | 441681 | 36203 |
| SNED1 | 162804 | 401884 | 19946 | 384871 | 36204 |
| SNED1 | 162804 | 405547 | 19947 | 386007 | 36205 |
| SNED1 | 162804 | 310397 | 19948 | 308893 | 36206 |
| SNED1 | 162804 | 493358 | 19949 | N/A | |
| SNED1 | 162804 | 401644 | 19950 | 384789 | 36207 |
| SNED1 | 162804 | 431690 | 19951 | 401865 | 36208 |
| SNED1 | 162804 | 420591 | 19952 | 394324 | 36209 |
| SNED1 | 162804 | 469006 | 19953 | N/A | |
| SNED1 | 162804 | 483962 | 19954 | N/A | |
| SNED1 | 162804 | 466618 | 19955 | N/A | |
| SNED1 | 162804 | 491761 | 19956 | N/A | |
| SNED1 | 162804 | 342631 | 19957 | 342992 | 36210 |
| SNHG5 | 203875 | 623163 | 19958 | N/A | |
| SNHG5 | 203875 | 623901 | 19959 | N/A | |
| SNHG5 | 203875 | 589187 | 19960 | N/A | |
| SNHG5 | 203875 | 622963 | 19961 | N/A | |
| SNHG5 | 203875 | 623650 | 19962 | N/A | |
| SNHG5 | 203875 | 624128 | 19963 | N/A | |
| SNHG5 | 203875 | 587692 | 19964 | N/A | |
| SNHG5 | 203875 | 369605 | 19965 | N/A | |
| SNHG5 | 203875 | 427501 | 19966 | N/A | |
| SNHG5 | 203875 | 435947 | 19967 | N/A | |
| SNHG5 | 203875 | 624295 | 19968 | N/A | |
| SNHG5 | 203875 | 625175 | 19969 | N/A | |
| SNHG5 | 203875 | 623910 | 19970 | N/A | |
| SNHG5 | 203875 | 428833 | 19971 | N/A | |
| SNHG5 | 203875 | 453754 | 19972 | N/A | |
| SNHG5 | 203875 | 420199 | 19973 | N/A | |
| SNHG5 | 203875 | 414002 | 19974 | N/A | |
| SNHG5 | 203875 | 623267 | 19975 | N/A | |
| SNHG5 | 203875 | 623001 | 19976 | N/A | |
| SNHG5 | 203875 | 431043 | 19977 | N/A | |
| SNHG5 | 203875 | 433843 | 19978 | N/A | |
| SNHG5 | 203875 | 425170 | 19979 | N/A | |
| SNTB1 | 172164 | 395601 | 19980 | 378965 | 36211 |
| SNTB1 | 172164 | 517992 | 19981 | 431124 | 36212 |
| SNTB1 | 172164 | 519177 | 19982 | N/A | |
| SNTB1 | 172164 | 519298 | 19983 | N/A | |
| SNTB1 | 172164 | 520717 | 19984 | 429292 | 36213 |
| SNX22 | 157734 | 557789 | 19985 | N/A | |
| SNX22 | 157734 | 325881 | 19986 | 323435 | 36214 |
| SNX22 | 157734 | 561334 | 19987 | N/A | |
| SNX22 | 157734 | 558466 | 19988 | 452692 | 36215 |
| SNX22 | 157734 | 560607 | 19989 | N/A | |
| SNX22 | 157734 | 560945 | 19990 | N/A | |
| SNX22 | 157734 | 560997 | 19991 | N/A | |
| SNX33 | 173548 | 308527 | 19992 | 311427 | 36216 |
| SNX33 | 173548 | 569152 | 19993 | 455436 | 36217 |
| SOAT1 | 057252 | 367619 | 19994 | 356591 | 36218 |
| SOAT1 | 057252 | 426956 | 19995 | 411309 | 36219 |
| SOAT1 | 057252 | 540564 | 19996 | 445315 | 36220 |
| SOAT1 | 057252 | 539888 | 19997 | 441356 | 36221 |
| SOBP | 112320 | 317357 | 19998 | 318900 | 36222 |
| SOBP | 112320 | 477448 | 19999 | N/A | |
| SOBP | 112320 | 494935 | 20000 | N/A | |
| SOBP | 112320 | 618129 | 20001 | 478366 | 36223 |
| SOCS2 | 120833 | 340600 | 20002 | 339428 | 36224 |
| SOCS2 | 120833 | 549206 | 20003 | 448815 | 36225 |
| SOCS2 | 120833 | 536696 | 20004 | 442898 | 36226 |
| SOCS2 | 120833 | 548091 | 20005 | 447902 | 36227 |
| SOCS2 | 120833 | 549122 | 20006 | 447161 | 36228 |
| SOCS2 | 120833 | 548537 | 20007 | 448709 | 36229 |
| SOCS2 | 120833 | 549887 | 20008 | 448611 | 36230 |
| SOCS2 | 120833 | 551556 | 20009 | 449227 | 36231 |
| SOCS2 | 120833 | 547229 | 20010 | 473902 | 36232 |
| SOCS2 | 120833 | 551883 | 20011 | 474805 | 36233 |
| SOCS2 | 120833 | 549510 | 20012 | 474888 | 36234 |
| SOCS2 | 120833 | 622746 | 20013 | 481249 | 36235 |
| SOD1 | 142168 | 270142 | 20014 | 270142 | 36236 |
| SOD1 | 142168 | 389995 | 20015 | 374645 | 36237 |
| SOD1 | 142168 | 476106 | 20016 | N/A | |
| SOD1 | 142168 | 470944 | 20017 | N/A | |
| SOD3 | 109610 | 598411 | 20018 | 472134 | 36238 |
| SOD3 | 109610 | 593742 | 20019 | N/A | |
| SOD3 | 109610 | 382120 | 20020 | 371554 | 36239 |
| SORBS2 | 154556 | 319471 | 20021 | 322182 | 36240 |
| SORBS2 | 154556 | 449407 | 20022 | 397262 | 36241 |
| SORBS2 | 154556 | 355634 | 20023 | 347852 | 36242 |
| SORBS2 | 154556 | 393528 | 20024 | 377162 | 36243 |
| SORBS2 | 154556 | 478461 | 20025 | N/A | |
| SORBS2 | 154556 | 319454 | 20026 | 321983 | 36244 |
| SORBS2 | 154556 | 498125 | 20027 | N/A | |
| SORBS2 | 154556 | 480146 | 20028 | N/A | |
| SORBS2 | 154556 | 451974 | 20029 | 401818 | 36245 |
| SORBS2 | 154556 | 438278 | 20030 | 389995 | 36246 |
| SORBS2 | 154556 | 487184 | 20031 | N/A | |
| SORBS2 | 154556 | 445625 | 20032 | 391940 | 36247 |
| SORBS2 | 154556 | 487836 | 20033 | N/A | |
| SORBS2 | 154556 | 495932 | 20034 | N/A | |
| SORBS2 | 154556 | 490562 | 20035 | N/A | |
| SORBS2 | 154556 | 492104 | 20036 | N/A | |
| SORBS2 | 154556 | 490779 | 20037 | N/A | |
| SORBS2 | 154556 | 492810 | 20038 | N/A | |
| SORBS2 | 154556 | 476311 | 20039 | N/A | |
| SORBS2 | 154556 | 466289 | 20040 | N/A | |
| SORBS2 | 154556 | 485380 | 20041 | N/A | |
| SORBS2 | 154556 | 470685 | 20042 | N/A | |
| SORBS2 | 154556 | 494140 | 20043 | N/A | |

-continued

| Symbol | ENSG | ENST | SEQ ID | ENSP | SEQ ID |
|---|---|---|---|---|---|
| SORBS2 | 154556 | 445343 | 20044 | 399048 | 36248 |
| SORBS2 | 154556 | 439914 | 20045 | 408909 | 36249 |
| SORBS2 | 154556 | 444771 | 20046 | 410483 | 36250 |
| SORBS2 | 154556 | 430503 | 20047 | 405349 | 36251 |
| SORBS2 | 154556 | 450341 | 20048 | 415680 | 36252 |
| SORBS2 | 154556 | 445115 | 20049 | 397664 | 36253 |
| SORBS2 | 154556 | 457247 | 20050 | 398335 | 36254 |
| SORBS2 | 154556 | 456596 | 20051 | 410967 | 36255 |
| SORBS2 | 154556 | 425679 | 20052 | 415637 | 36256 |
| SORBS2 | 154556 | 439049 | 20053 | 416464 | 36257 |
| SORBS2 | 154556 | 451958 | 20054 | 405092 | 36258 |
| SORBS2 | 154556 | 444781 | 20055 | 396183 | 36259 |
| SORBS2 | 154556 | 414724 | 20056 | 403417 | 36260 |
| SORBS2 | 154556 | 419063 | 20057 | 408504 | 36261 |
| SORBS2 | 154556 | 393523 | 20058 | 377158 | 36262 |
| SORBS2 | 154556 | 420158 | 20059 | 410233 | 36263 |
| SORBS2 | 154556 | 421639 | 20060 | 405646 | 36264 |
| SORBS2 | 154556 | 493709 | 20061 | N/A | |
| SORBS2 | 154556 | 457934 | 20062 | 405314 | 36265 |
| SORBS2 | 154556 | 431902 | 20063 | 405432 | 36266 |
| SORBS2 | 154556 | 435480 | 20064 | 415166 | 36267 |
| SORBS2 | 154556 | 415274 | 20065 | 415392 | 36268 |
| SORBS2 | 154556 | 432655 | 20066 | 407006 | 36269 |
| SORBS2 | 154556 | 451701 | 20067 | 404430 | 36270 |
| SORBS2 | 154556 | 428330 | 20068 | 402328 | 36271 |
| SORBS2 | 154556 | 421420 | 20069 | 393258 | 36272 |
| SORBS2 | 154556 | 464975 | 20070 | N/A | |
| SORBS2 | 154556 | 464819 | 20071 | N/A | |
| SORBS2 | 154556 | 478249 | 20072 | N/A | |
| SORBS2 | 154556 | 452351 | 20073 | 412447 | 36273 |
| SORBS2 | 154556 | 429056 | 20074 | 390162 | 36274 |
| SORBS2 | 154556 | 463104 | 20075 | N/A | |
| SORBS2 | 154556 | 456060 | 20076 | 389829 | 36275 |
| SORBS2 | 154556 | 476878 | 20077 | N/A | |
| SORBS2 | 154556 | 462661 | 20078 | N/A | |
| SORBS2 | 154556 | 469627 | 20079 | N/A | |
| SORBS2 | 154556 | 488562 | 20080 | N/A | |
| SORBS2 | 154556 | 418609 | 20081 | 397482 | 36276 |
| SORBS2 | 154556 | 448662 | 20082 | 409158 | 36277 |
| SORBS2 | 154556 | 437304 | 20083 | 396008 | 36278 |
| SORBS2 | 154556 | 284776 | 20084 | 284776 | 36279 |
| SORBS3 | 120896 | 522037 | 20085 | N/A | |
| SORBS3 | 120896 | 523941 | 20086 | N/A | |
| SORBS3 | 120896 | 240123 | 20087 | 240123 | 36280 |
| SORBS3 | 120896 | 517500 | 20088 | 429723 | 36281 |
| SORBS3 | 120896 | 517535 | 20089 | N/A | |
| SORBS3 | 120896 | 523402 | 20090 | N/A | |
| SORBS3 | 120896 | 520563 | 20091 | 428102 | 36282 |
| SORBS3 | 120896 | 524057 | 20092 | N/A | |
| SORBS3 | 120896 | 518512 | 20093 | N/A | |
| SORBS3 | 120896 | 520574 | 20094 | N/A | |
| SORBS3 | 120896 | 521787 | 20095 | N/A | |
| SORBS3 | 120896 | 523740 | 20096 | N/A | |
| SORBS3 | 120896 | 522315 | 20097 | N/A | |
| SORBS3 | 120896 | 519453 | 20098 | N/A | |
| SORBS3 | 120896 | 523900 | 20099 | 431128 | 36283 |
| SORBS3 | 120896 | 523965 | 20100 | 429764 | 36284 |
| SORBS3 | 120896 | 521554 | 20101 | N/A | |
| SORBS3 | 120896 | 522721 | 20102 | 429479 | 36285 |
| SORBS3 | 120896 | 523348 | 20103 | 428678 | 36286 |
| SORBS3 | 120896 | 517962 | 20104 | 428327 | 36287 |
| SORBS3 | 120896 | 520207 | 20105 | N/A | |
| SORBS3 | 120896 | 519127 | 20106 | N/A | |
| SORCS3 | 156395 | 369701 | 20107 | 358715 | 36288 |
| SORCS3 | 156395 | 393176 | 20108 | 376876 | 36289 |
| SORCS3 | 156395 | 369699 | 20109 | 358713 | 36290 |
| SOS1 | 115904 | 426016 | 20110 | 387784 | 36291 |
| SOS1 | 115904 | 395038 | 20111 | 378479 | 36292 |
| SOS1 | 115904 | 469581 | 20112 | N/A | |
| SOS1 | 115904 | 474390 | 20113 | N/A | |
| SOS1 | 115904 | 472480 | 20114 | N/A | |
| SOS1 | 115904 | 461545 | 20115 | N/A | |
| SOS1 | 115904 | 451331 | 20116 | 393899 | 36293 |
| SOS1 | 115904 | 402219 | 20117 | 384675 | 36294 |
| SOX10 | 100146 | 427770 | 20118 | 414853 | 36295 |
| SOX10 | 100146 | 470555 | 20119 | N/A | |

-continued

| Symbol | ENSG | ENST | SEQ ID | ENSP | SEQ ID |
|---|---|---|---|---|---|
| SOX10 | 100146 | 360880 | 20120 | 354130 | 36296 |
| SOX10 | 100146 | 446929 | 20121 | 399777 | 36297 |
| SOX10 | 100146 | 396884 | 20122 | 380093 | 36298 |
| SOX13 | 143842 | 367203 | 20123 | N/A | |
| SOX13 | 143842 | 534185 | 20124 | N/A | |
| SOX13 | 143842 | 530882 | 20125 | N/A | |
| SOX13 | 143842 | 367204 | 20126 | 356172 | 36299 |
| SOX13 | 143842 | 525442 | 20127 | 433595 | 36300 |
| SOX13 | 143842 | 528591 | 20128 | 436297 | 36301 |
| SOX13 | 143842 | 272193 | 20129 | N/A | |
| SOX13 | 143842 | 480326 | 20130 | 434093 | 36302 |
| SOX13 | 143842 | 525258 | 20131 | N/A | |
| SOX13 | 143842 | 618875 | 20132 | 478239 | 36303 |
| SOX2 | 181449 | 325404 | 20133 | 323588 | 36304 |
| SOX6 | 110693 | 316399 | 20134 | 324948 | 36305 |
| SOX6 | 110693 | 528252 | 20135 | 432134 | 36306 |
| SOX6 | 110693 | 527619 | 20136 | 434455 | 36307 |
| SOX6 | 110693 | 528429 | 20137 | 433233 | 36308 |
| SOX6 | 110693 | 527840 | 20138 | N/A | |
| SOX6 | 110693 | 524650 | 20139 | N/A | |
| SOX6 | 110693 | 531297 | 20140 | N/A | |
| SOX6 | 110693 | 533411 | 20141 | 436170 | 36309 |
| SOX6 | 110693 | 530378 | 20142 | 432577 | 36310 |
| SOX6 | 110693 | 533870 | 20143 | N/A | |
| SOX6 | 110693 | 533658 | 20144 | N/A | |
| SOX6 | 110693 | 526673 | 20145 | 434892 | 36311 |
| SOX6 | 110693 | 529469 | 20146 | 432596 | 36312 |
| SOX6 | 110693 | 525835 | 20147 | N/A | |
| SOX6 | 110693 | 524520 | 20148 | N/A | |
| SOX6 | 110693 | 525259 | 20149 | N/A | |
| SOX6 | 110693 | 396356 | 20150 | 379644 | 36313 |
| SOX8 | 005513 | 293894 | 20151 | 293894 | 36314 |
| SOX8 | 005513 | 566034 | 20152 | N/A | |
| SOX9 | 125398 | 245479 | 20153 | 245479 | 36315 |
| SP5 | 204335 | 375281 | 20154 | 364430 | 36316 |
| SP5 | 204335 | 487037 | 20155 | N/A | |
| SPAG5 | 076382 | 580377 | 20156 | N/A | |
| SPAG5 | 076382 | 582175 | 20157 | N/A | |
| SPAG5 | 076382 | 321765 | 20158 | 323300 | 36317 |
| SPAG5 | 076382 | 582076 | 20159 | 466061 | 36318 |
| SPAG5 | 076382 | 580676 | 20160 | N/A | |
| SPAG5 | 076382 | 581133 | 20161 | N/A | |
| SPAG5 | 076382 | 580682 | 20162 | N/A | |
| SPAG5 | 076382 | 577259 | 20163 | N/A | |
| SPAG5 | 076382 | 580406 | 20164 | N/A | |
| SPAG5 | 076382 | 378976 | 20165 | 466021 | 36319 |
| SPAG5 | 076382 | 578230 | 20166 | 464280 | 36320 |
| SPAG5 | 076382 | 580083 | 20167 | 464474 | 36321 |
| SPAG5 | 076382 | 584206 | 20168 | 463095 | 36322 |
| SPAG5 | 076382 | 580567 | 20169 | 464400 | 36323 |
| SPAG5 | 076382 | 578479 | 20170 | 462663 | 36324 |
| SPAG5 | 076382 | 536674 | 20171 | 444223 | 36325 |
| SPAG9 | 008294 | 262013 | 20172 | 262013 | 36326 |
| SPAG9 | 008294 | 509724 | 20173 | N/A | |
| SPAG9 | 008294 | 510283 | 20174 | 423165 | 36327 |
| SPAG9 | 008294 | 505279 | 20175 | 426900 | 36328 |
| SPAG9 | 008294 | 357122 | 20176 | 349636 | 36329 |
| SPAG9 | 008294 | 506500 | 20177 | N/A | |
| SPAG9 | 008294 | 513746 | 20178 | 423346 | 36330 |
| SPAG9 | 008294 | 511312 | 20179 | N/A | |
| SPAG9 | 008294 | 513906 | 20180 | 430205 | 36331 |
| SPAG9 | 008294 | 514613 | 20181 | N/A | |
| SPAG9 | 008294 | 505173 | 20182 | N/A | |
| SPAG9 | 008294 | 514205 | 20183 | N/A | |
| SPAG9 | 008294 | 506483 | 20184 | N/A | |
| SPAG9 | 008294 | 513827 | 20185 | N/A | |
| SPAG9 | 008294 | 515685 | 20186 | N/A | |
| SPAG9 | 008294 | 513547 | 20187 | N/A | |
| SPAG9 | 008294 | 511795 | 20188 | 429343 | 36332 |
| SPAG9 | 008294 | 576492 | 20189 | N/A | |
| SPAG9 | 008294 | 510855 | 20190 | 426061 | 36333 |
| SPAG9 | 008294 | 511987 | 20191 | N/A | |
| SPAG9 | 008294 | 502329 | 20192 | N/A | |
| SPAG9 | 008294 | 618113 | 20193 | 484908 | 36334 |
| SPARC | 113140 | 231061 | 20194 | 231061 | 36335 |
| SPARC | 113140 | 520687 | 20195 | N/A | |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| SPARC | 113140 | 538026 | 20196 | 440127 | 36336 | 5 | SPEG | 072195 | 463218 | 20272 | N/A | |
| SPARC | 113140 | 537849 | 20197 | N/A | | | SPEG | 072195 | 396688 | 20273 | 379919 | 36393 |
| SPARC | 113140 | 521569 | 20198 | 428119 | 36337 | | SPEG | 072195 | 496786 | 20274 | N/A | |
| SPARC | 113140 | 524277 | 20199 | N/A | | | SPEG | 072195 | 475921 | 20275 | N/A | |
| SPARC | 113140 | 539687 | 20200 | 444998 | 36338 | | SPEG | 072195 | 396686 | 20276 | 379917 | 36394 |
| SPARC | 113140 | 521327 | 20201 | N/A | | | SPEG | 072195 | 396689 | 20277 | 379920 | 36395 |
| SPARC | 113140 | 522348 | 20202 | 429152 | 36339 | 10 | SPEG | 072195 | 485069 | 20278 | N/A | |
| SPARCL1 | 152583 | 282470 | 20203 | 282470 | 36340 | | SPEG | 072195 | 412982 | 20279 | 390353 | 36396 |
| SPARCL1 | 152583 | 503414 | 20204 | 422903 | 36341 | | SPEG | 072195 | 475104 | 20280 | N/A | |
| SPARCL1 | 152583 | 541496 | 20205 | 445678 | 36342 | | SPEG | 072195 | 617028 | 20281 | 479190 | 36397 |
| SPARCL1 | 152583 | 509407 | 20206 | 423483 | 36343 | | SPHK2 | 063176 | 245222 | 20282 | 245222 | 36398 |
| SPARCL1 | 152583 | 434434 | 20207 | 416971 | 36344 | | SPHK2 | 063176 | 601712 | 20283 | 471180 | 36399 |
| SPARCL1 | 152583 | 535835 | 20208 | 438188 | 36345 | 15 | SPHK2 | 063176 | 600537 | 20284 | 470092 | 36400 |
| SPARCL1 | 152583 | 512317 | 20209 | 423448 | 36346 | | SPHK2 | 063176 | 598088 | 20285 | 469158 | 36401 |
| SPARCL1 | 152583 | 543631 | 20210 | 444832 | 36347 | | SPHK2 | 063176 | 426514 | 20286 | 410044 | 36402 |
| SPARCL1 | 152583 | 458304 | 20211 | 406251 | 36348 | | SPHK2 | 063176 | 597434 | 20287 | 471111 | 36403 |
| SPARCL1 | 152583 | 418378 | 20212 | 414856 | 36349 | | SPHK2 | 063176 | 601704 | 20288 | 469448 | 36404 |
| SPATA13 | 228741 | 439928 | 20213 | N/A | | | SPHK2 | 063176 | 593308 | 20289 | 470679 | 36405 |
| SPATA13 | 182957 | 424834 | 20214 | 398560 | 36350 | 20 | SPHK2 | 063176 | 599033 | 20290 | N/A | |
| SPATA13 | 182957 | 466831 | 20215 | N/A | | | SPHK2 | 063176 | 599748 | 20291 | 471205 | 36406 |
| SPATA13 | 182957 | 382095 | 20216 | 371527 | 36351 | | SPHK2 | 063176 | 599029 | 20292 | 472983 | 36407 |
| SPATA13 | 182957 | 474317 | 20217 | N/A | | | SPHK2 | 063176 | 598574 | 20293 | N/A | |
| SPATA13 | 182957 | 434675 | 20218 | 401605 | 36352 | | SPHK2 | 063176 | 340932 | 20294 | 341091 | 36408 |
| SPATA13 | 182957 | 494772 | 20219 | 477296 | 36353 | | SPHKAP | 153820 | 392056 | 20295 | 375909 | 36409 |
| SPATA13 | 182957 | 399949 | 20220 | 382830 | 36354 | | SPHKAP | 153820 | 344657 | 20296 | 339886 | 36410 |
| SPATA13 | 182957 | 409126 | 20221 | 386471 | 36355 | 25 | SPHKAP | 153820 | 490603 | 20297 | N/A | |
| SPATA13 | 182957 | 454083 | 20222 | 397498 | 36356 | | SPOCK3 | 196104 | 357154 | 20298 | 349677 | 36411 |
| SPATA13 | 182957 | 488060 | 20223 | 477304 | 36357 | | SPOCK3 | 196104 | 357545 | 20299 | 350153 | 36412 |
| SPATA13 | 182957 | 343003 | 20224 | 343631 | 36358 | | SPOCK3 | 196104 | 504953 | 20300 | 425570 | 36413 |
| SPATA13 | 182957 | 382108 | 20225 | 371542 | 36359 | | SPOCK3 | 196104 | 511531 | 20301 | 423421 | 36414 |
| SRATA9 | 145757 | 477715 | 20226 | 427257 | 36360 | | SPOCK3 | 196104 | 506886 | 20302 | 420920 | 36415 |
| SPATA9 | 145757 | 477047 | 20227 | N/A | | | SPOCK3 | 196104 | 535728 | 20303 | 441396 | 36416 |
| SPATA9 | 145757 | 316087 | 20228 | 325491 | 36361 | 30 | SPOCK3 | 196104 | 510741 | 20304 | 426716 | 36417 |
| SPAEA9 | 145757 | 274432 | 20229 | 274432 | 36362 | | SPOCK3 | 196104 | 502330 | 20305 | 423606 | 36418 |
| SPAEA9 | 145757 | 379990 | 20230 | N/A | | | SPOCK3 | 196104 | 511905 | 20306 | 425712 | 36419 |
| SPAEA9 | 145757 | 489917 | 20231 | 420883 | 36363 | | SPOCK3 | 196104 | 512681 | 20307 | 426318 | 36420 |
| SPATC1 | 186583 | 377470 | 20232 | 366690 | 36364 | | SPOCK3 | 196104 | 511269 | 20308 | 425502 | 36421 |
| SPATC1 | 186583 | 447830 | 20233 | 387613 | 36365 | 35 | SPOCK3 | 196104 | 507370 | 20309 | 424677 | 36422 |
| SPECC1 | 128487 | 472876 | 20234 | N/A | | | SPOCK3 | 196104 | 502821 | 20310 | 424980 | 36423 |
| SPECC1 | 128487 | 395527 | 20235 | 378898 | 36366 | | SPOCK3 | 196104 | 505187 | 20311 | 422170 | 36424 |
| SPECC1 | 128487 | 583482 | 20236 | 463006 | 36367 | | SPOCK3 | 196104 | 512648 | 20312 | 426177 | 36425 |
| SPECC1 | 128487 | 583528 | 20237 | 461918 | 36368 | | SPOCK3 | 196104 | 510403 | 20313 | 423176 | 36426 |
| SPECC1 | 128487 | 583463 | 20238 | 464489 | 36369 | | SPOCK3 | 196104 | 515143 | 20314 | 425859 | 36427 |
| SPECC1 | 128487 | 578321 | 20239 | 462266 | 36370 | 40 | SPOCK3 | 196104 | 511226 | 20315 | 424674 | 36428 |
| SPECC1 | 128487 | 582604 | 20240 | 464639 | 36371 | | SPOCK3 | 196104 | 507086 | 20316 | 420928 | 36429 |
| SPECC1 | 128487 | 413167 | 20241 | N/A | | | SPOCK3 | 196104 | 502741 | 20317 | 422336 | 36430 |
| SPECC1 | 128487 | 395529 | 20242 | 378900 | 36372 | | SPOCK3 | 196104 | 509854 | 20318 | 423367 | 36431 |
| SPECC1 | 128487 | 261503 | 20243 | 261503 | 36373 | | SPOCK3 | 196104 | 515316 | 20319 | 426995 | 36432 |
| SPECC1 | 128487 | 581973 | 20244 | 464341 | 36374 | | SPOCK3 | 196104 | 506697 | 20320 | 424168 | 36433 |
| SPECC1 | 128487 | 580934 | 20245 | 461944 | 36375 | | SPOCK3 | 196104 | 512042 | 20321 | 425407 | 36434 |
| SPECC1 | 128487 | 582063 | 20246 | N/A | | 45 | SPOCK3 | 196104 | 421836 | 20322 | 411344 | 36435 |
| SPECC1 | 128487 | 579688 | 20247 | N/A | | | SPOCK3 | 196104 | 541354 | 20323 | 444789 | 36436 |
| SPECC1 | 128487 | 395530 | 20248 | 378901 | 36376 | | SPON1 | 262655 | 576479 | 20324 | 460236 | 36437 |
| SPECC1 | 128487 | 467722 | 20249 | 463130 | 36377 | | SPON1 | 262655 | 591785 | 20325 | N/A | |
| SPECC1 | 128487 | 395522 | 20250 | 378893 | 36378 | | SPON2 | 159674 | 290902 | 20326 | 290902 | 36438 |
| SPECC1 | 128487 | 395525 | 20251 | 378896 | 36379 | | SPON2 | 159674 | 509697 | 20327 | N/A | |
| SPECC1 | 128487 | 581399 | 20252 | 462471 | 36380 | 50 | SPON2 | 159674 | 507466 | 20328 | N/A | |
| SPECC1 | 128487 | 582226 | 20253 | 462092 | 36381 | | SPON2 | 159674 | 503765 | 20329 | 424542 | 36439 |
| SPECC1 | 128487 | 584527 | 20254 | 463799 | 36382 | | SPON2 | 159674 | 504909 | 20330 | N/A | |
| SPECC1 | 128487 | 578153 | 20255 | 462987 | 36383 | | SPON2 | 159674 | 512888 | 20331 | N/A | |
| SPECC1 | 128487 | 492188 | 20256 | N/A | | | SPON2 | 159674 | 512150 | 20332 | N/A | |
| SPEG | 072195 | 312358 | 20257 | 311684 | 36384 | | SPON2 | 159674 | 515004 | 20333 | 425871 | 36440 |
| SPEG | 072195 | 498378 | 20258 | N/A | | 55 | SPON2 | 159674 | 502483 | 20334 | 422516 | 36441 |
| SPEG | 072195 | 435853 | 20259 | 393134 | 36385 | | SPON2 | 159674 | 514490 | 20335 | 421634 | 36442 |
| SPEG | 072195 | 403148 | 20260 | 383902 | 36386 | | SPON2 | 159674 | 509233 | 20336 | 421379 | 36443 |
| SPEG | 072195 | 431523 | 20261 | 410986 | 36387 | | SPON2 | 159674 | 511679 | 20337 | 423414 | 36444 |
| SPEG | 072195 | 396698 | 20262 | 379926 | 36388 | | SPON2 | 159674 | 511672 | 20338 | 421858 | 36445 |
| SPEG | 072195 | 452101 | 20263 | 406530 | 36389 | | SPON2 | 159674 | 506266 | 20339 | N/A | |
| SPEG | 072195 | 420132 | 20264 | 397514 | 36390 | 60 | SPON2 | 159674 | 504871 | 20340 | N/A | |
| SPEG | 072195 | 464989 | 20265 | N/A | | | SPON2 | 159674 | 502657 | 20341 | N/A | |
| SPEG | 072195 | 451076 | 20266 | 414549 | 36391 | | SPON2 | 159674 | 400762 | 20342 | N/A | |
| SPEG | 072195 | 409595 | 20267 | 387344 | 36392 | | SPON2 | 159674 | 505653 | 20343 | N/A | |
| SPEG | 072195 | 497065 | 20268 | N/A | | | SPON2 | 159674 | 515553 | 20344 | N/A | |
| SPEG | 072195 | 491248 | 20269 | N/A | | | SPON2 | 159674 | 510542 | 20345 | N/A | |
| SPEG | 072195 | 485813 | 20270 | N/A | | 65 | SPON2 | 159674 | 617421 | 20346 | 483599 | 36446 |
| SPEG | 072195 | 462545 | 20271 | N/A | | | SPON2 | 159674 | 431380 | 20347 | 394832 | 36447 |

| Symbol | ENSG | ENST | SEQ ID | ENSP | SEQ ID |
|---|---|---|---|---|---|
| SPP1 | 118785 | 237623 | 20348 | 237623 | 36448 |
| SPP1 | 118785 | 395080 | 20349 | 378517 | 36449 |
| SPP1 | 118785 | 504310 | 20350 | N/A | |
| SPP1 | 118785 | 513981 | 20351 | N/A | |
| SPP1 | 118785 | 509334 | 20352 | N/A | |
| SPP1 | 118785 | 508233 | 20353 | 422973 | 36450 |
| SPP1 | 118785 | 360804 | 20354 | 354042 | 36451 |
| SPP1 | 118785 | 509659 | 20355 | N/A | |
| SPP1 | 118785 | 508002 | 20356 | N/A | |
| SPP1 | 118785 | 505146 | 20357 | N/A | |
| SPP1 | 118785 | 614857 | 20358 | 477824 | 36452 |
| SPRED3 | 188766 | 587013 | 20359 | 467540 | 36453 |
| SPRED3 | 188766 | 586301 | 20360 | 466568 | 36454 |
| SPRED3 | 188766 | 587947 | 20361 | 467532 | 36455 |
| SPRED3 | 188766 | 338502 | 20362 | 345405 | 36456 |
| SPRED3 | 188766 | 587564 | 20363 | N/A | |
| SPRED3 | 188766 | 586958 | 20364 | 465713 | 36457 |
| SPRED3 | 188766 | 590962 | 20365 | N/A | |
| SPSB4 | 175093 | 310546 | 20366 | 311609 | 36458 |
| SPSB4 | 175093 | 508126 | 20367 | 422034 | 36459 |
| SPSB4 | 175093 | 508828 | 20368 | N/A | |
| SPSB4 | 175093 | 507895 | 20369 | N/A | |
| SPTB | 070182 | 556626 | 20370 | 451752 | 36460 |
| SPTB | 070182 | 342835 | 20371 | N/A | |
| SPTB | 070182 | 553938 | 20372 | 451324 | 36461 |
| SPTB | 070182 | 556227 | 20373 | N/A | |
| SPTB | 070182 | 389721 | 20374 | 374371 | 36162 |
| SPTB | 070182 | 389720 | 20375 | 374370 | 36163 |
| SPTB | 070182 | 542694 | 20376 | N/A | |
| SPTB | 070182 | 389722 | 20377 | 374372 | 36161 |
| SPTBN2 | 173898 | 533211 | 20378 | 432568 | 36165 |
| SPTBN2 | 173898 | 529997 | 20379 | 433593 | 36166 |
| SPTBN2 | 173898 | 528051 | 20380 | N/A | |
| SPTBN2 | 173898 | 530775 | 20381 | N/A | |
| SPTBN2 | 173898 | 532650 | 20382 | N/A | |
| SPTBN2 | 173898 | 532902 | 20383 | N/A | |
| SPTBN2 | 173898 | 530665 | 20384 | N/A | |
| SPTBN2 | 173898 | 527010 | 20385 | 433631 | 36467 |
| SPTBN2 | 173898 | 309996 | 20386 | 311489 | 36468 |
| SPTBN2 | 173898 | 617502 | 20387 | 482000 | 36469 |
| SPTBN2 | 173898 | 611817 | 20388 | 480692 | 36470 |
| SPTY2D1 | 179119 | 336349 | 20389 | 337991 | 36471 |
| SPTY2D1 | 179119 | 536336 | 20390 | N/A | |
| SPTY2D1 | 179119 | 543776 | 20391 | N/A | |
| SRC | 197122 | 497734 | 20392 | N/A | |
| SRC | 197122 | 373578 | 20393 | 362680 | 36472 |
| SRC | 197122 | 373567 | 20394 | 362668 | 36473 |
| SRC | 197122 | 373558 | 20395 | 362659 | 36474 |
| SRC | 197122 | 472968 | 20396 | N/A | |
| SRC | 197122 | 489153 | 20397 | N/A | |
| SRC | 197122 | 477066 | 20398 | N/A | |
| SRC | 197122 | 467556 | 20399 | N/A | |
| SRC | 197122 | 477475 | 20400 | N/A | |
| SRC | 197122 | 493775 | 20401 | N/A | |
| SRC | 197122 | 358208 | 20402 | 350941 | 36475 |
| SRCIN1 | 273608 | 615049 | 20403 | 480869 | 36476 |
| SRCIN1 | 273608 | 631564 | 20404 | 488014 | 36477 |
| SRCIN1 | 273608 | 632724 | 20405 | 488440 | 36478 |
| SRCIN1 | 273608 | 631905 | 20406 | N/A | |
| SRCIN1 | 273608 | 631691 | 20407 | N/A | |
| SRCIN1 | 273608 | 631684 | 20408 | 488254 | 36479 |
| SRCIN1 | 273608 | 631897 | 20409 | N/A | |
| SRCIN1 | 273608 | 613116 | 20410 | N/A | |
| SRCIN1 | 273608 | 632117 | 20411 | 487679 | 36480 |
| SRCIN1 | 277363 | 617146 | 20412 | 484715 | 36481 |
| SRCIN1 | 277363 | 621492 | 20413 | 483931 | 36482 |
| SRCIN1 | 277363 | 622190 | 20414 | 479718 | 36483 |
| SRCIN1 | 277363 | 622519 | 20415 | N/A | |
| SRCIN1 | 277363 | 621763 | 20416 | N/A | |
| SRCIN1 | 277363 | 613927 | 20417 | 477811 | 36484 |
| SRCIN1 | 277363 | 621275 | 20418 | N/A | |
| SRCIN1 | 277363 | 612208 | 20419 | N/A | |
| SRCIN1 | 277363 | 612431 | 20420 | 478342 | 36485 |
| SRGAP1 | 196935 | 355086 | 20421 | 347198 | 36486 |
| SRGAP1 | 196935 | 537556 | 20422 | N/A | |
| SRGAP1 | 196935 | 543397 | 20423 | 437948 | 36487 |

| Symbol | ENSG | ENST | SEQ ID | ENSP | SEQ ID |
|---|---|---|---|---|---|
| SRGAP1 | 196935 | 542381 | 20424 | N/A | |
| SRGAP1 | 196935 | 537585 | 20425 | N/A | |
| SRGAP1 | 196935 | 542841 | 20426 | N/A | |
| SRGAP1 | 196935 | 631006 | 20427 | 485752 | 36488 |
| SRGN | 122862 | 462445 | 20428 | N/A | |
| SRGN | 122862 | 242465 | 20429 | 242465 | 36489 |
| SRPX | 101955 | 378533 | 20430 | 367794 | 36490 |
| SRPX | 101955 | 479015 | 20431 | N/A | |
| SRPX | 101955 | 461865 | 20432 | N/A | |
| SRPX | 101955 | 432886 | 20433 | 411165 | 36491 |
| SRPX | 101955 | 544439 | 20434 | 440758 | 36492 |
| SRPX | 101955 | 538295 | 20435 | 445034 | 36493 |
| SRRM4 | 139767 | 267260 | 20436 | 267260 | 36494 |
| SRRM4 | 139767 | 545224 | 20437 | N/A | |
| SRRM4 | 139767 | 537597 | 20438 | N/A | |
| SRRM4 | 139767 | 641899 | 20439 | 493188 | 36495 |
| SRSF3 | 112081 | 613941 | 20440 | 484891 | 36496 |
| SRSF3 | 112081 | 620242 | 20441 | N/A | |
| SRSF3 | 112081 | 339436 | 20442 | N/A | |
| SRSF3 | 112081 | 373715 | 20443 | 362820 | 36497 |
| SRSF3 | 112081 | 477442 | 20444 | 436036 | 36498 |
| SRSF3 | 112081 | 620941 | 20445 | 482833 | 36499 |
| SRSF3 | 112081 | 620389 | 20446 | N/A | |
| SRSF3 | 112081 | 614136 | 20447 | N/A | |
| SSH1 | 084112 | 326495 | 20448 | 315713 | 36500 |
| SSH1 | 084112 | 546433 | 20449 | 447629 | 36501 |
| SSH1 | 084112 | 551165 | 20450 | 448824 | 36502 |
| SSH1 | 084112 | 326470 | 20451 | 326107 | 36503 |
| SSH1 | 084112 | 547862 | 20452 | N/A | |
| SSH1 | 084112 | 548522 | 20453 | 448586 | 36504 |
| SSH1 | 084112 | 547381 | 20454 | N/A | |
| SSH1 | 084112 | 546697 | 20455 | 446652 | 36505 |
| SSH1 | 084112 | 546812 | 20456 | N/A | |
| SSTR1 | 139874 | 267377 | 20457 | 267377 | 36506 |
| SSTR2 | 180616 | 579323 | 20458 | N/A | |
| SSTR2 | 180616 | 357585 | 20459 | 350198 | 36507 |
| ST13 | 100380 | 216218 | 20460 | 216218 | 36508 |
| ST13 | 100380 | 480048 | 20461 | N/A | |
| ST13 | 100380 | 455824 | 20462 | 397062 | 36509 |
| ST13 | 100380 | 413424 | 20463 | 412049 | 36510 |
| ST13 | 100380 | 411695 | 20464 | 392067 | 36511 |
| ST13 | 100380 | 495652 | 20465 | N/A | |
| ST13 | 100380 | 620312 | 20466 | 481328 | 36512 |
| ST18 | 147488 | 276480 | 20467 | 276480 | 36513 |
| ST18 | 147488 | 521824 | 20468 | 429579 | 36514 |
| ST18 | 147488 | 522251 | 20469 | 428920 | 36515 |
| ST18 | 147488 | 521582 | 20470 | 430763 | 36516 |
| ST18 | 147488 | 518053 | 20471 | N/A | |
| ST18 | 147488 | 522861 | 20472 | N/A | |
| ST18 | 147488 | 518501 | 20473 | N/A | |
| ST18 | 147488 | 517580 | 20474 | 428521 | 36517 |
| ST18 | 147488 | 520257 | 20475 | N/A | |
| ST18 | 147488 | 521549 | 20476 | N/A | |
| ST18 | 147488 | 518037 | 20477 | N/A | |
| ST18 | 147488 | 517456 | 20478 | N/A | |
| ST18 | 147488 | 519118 | 20479 | 428096 | 36518 |
| ST18 | 147488 | 518545 | 20480 | N/A | |
| ST18 | 147488 | 521119 | 20481 | N/A | |
| ST18 | 147488 | 518453 | 20482 | N/A | |
| ST18 | 147488 | 520279 | 20483 | N/A | |
| ST18 | 147488 | 519201 | 20484 | N/A | |
| ST18 | 147488 | 524183 | 20485 | N/A | |
| ST18 | 147488 | 522102 | 20486 | N/A | |
| ST18 | 147488 | 520811 | 20487 | N/A | |
| ST18 | 147488 | 524078 | 20488 | N/A | |
| ST18 | 147488 | 520716 | 20489 | N/A | |
| ST18 | 147488 | 523652 | 20490 | N/A | |
| ST3GAL2 | 157350 | 393640 | 20491 | 377257 | 36519 |
| ST3GAL2 | 157350 | 567822 | 20492 | N/A | |
| ST3GAL2 | 157350 | 566097 | 20493 | N/A | |
| ST3GAL2 | 157350 | 561708 | 20494 | N/A | |
| ST3GAL2 | 157350 | 567586 | 20495 | N/A | |
| ST3GAL2 | 157350 | 342907 | 20496 | 345477 | 36520 |
| ST3GAL5 | 115525 | 638572 | 20497 | 491316 | 36521 |
| ST3GAL5 | 115525 | 639867 | 20498 | N/A | |
| ST3GAL5 | 115525 | 461206 | 20499 | N/A | |

-continued -continued

| Symbol | ENSG | ENST | SEQ ID | ENSP | SEQ ID |
|---|---|---|---|---|---|
| ST3GAL5 | 115525 | 640378 | 20500 | 492030 | 36522 |
| ST3GAL5 | 115525 | 393808 | 20501 | 377397 | 36523 |
| ST3GAL5 | 115525 | 393805 | 20502 | 377394 | 36524 |
| ST3GAL5 | 115525 | 640322 | 20503 | 491564 | 36525 |
| ST3GAL5 | 115525 | 640712 | 20504 | N/A | |
| ST3GAL5 | 115525 | 638659 | 20505 | 491395 | 36526 |
| ST3GAL5 | 115525 | 639311 | 20506 | 491398 | 36527 |
| ST3GAL5 | 115525 | 377332 | 20507 | 366549 | 36528 |
| ST3GAL5 | 115525 | 639119 | 20508 | 492045 | 36529 |
| ST3GAL5 | 115525 | 640763 | 20509 | 491495 | 36530 |
| ST3GAL5 | 115525 | 640418 | 20510 | 492098 | 36531 |
| ST3GAL5 | 115525 | 639472 | 20511 | N/A | |
| ST3GAL5 | 115525 | 640315 | 20512 | 492089 | 36532 |
| ST3GAL5 | 115525 | 639743 | 20513 | N/A | |
| ST3GAL5 | 115525 | 638227 | 20514 | 492602 | 36533 |
| ST3GAL5 | 115525 | 640453 | 20515 | N/A | |
| ST3GAL5 | 115525 | 639074 | 20516 | N/A | |
| ST3GAL5 | 115525 | 640798 | 20517 | N/A | |
| ST3GAL5 | 115525 | 638321 | 20518 | 491084 | 36534 |
| ST3GAL5 | 115525 | 639432 | 20519 | 491828 | 36535 |
| ST3GAL5 | 115525 | 639184 | 20520 | 492305 | 36536 |
| ST3GAL5 | 115525 | 640982 | 20521 | 492299 | 36537 |
| ST3GAL5 | 115525 | 640992 | 20522 | 492753 | 36538 |
| ST3GAL5 | 115525 | 640425 | 20523 | 492459 | 36539 |
| ST3GAL5 | 115525 | 638678 | 20524 | 492847 | 36540 |
| ST3GAL5 | 115525 | 640295 | 20525 | 491027 | 36541 |
| ST3GAL5 | 115525 | 638885 | 20526 | 492209 | 36542 |
| ST3GAL5 | 115525 | 640594 | 20527 | 491356 | 36543 |
| ST3GAL5 | 115525 | 638484 | 20528 | 492635 | 36544 |
| ST3GAL5 | 115525 | 638542 | 20529 | 492468 | 36545 |
| ST3GAL5 | 115525 | 639820 | 20530 | 491802 | 36546 |
| ST3GAL5 | 115525 | 640024 | 20531 | 491238 | 36547 |
| ST3GAL5 | 115525 | 640222 | 20532 | 492035 | 36548 |
| ST3GAL5 | 115525 | 638178 | 20533 | 492103 | 36549 |
| ST3GAL5 | 115525 | 638855 | 20534 | 490979 | 36550 |
| ST3GAL5 | 115525 | 638288 | 20535 | 491699 | 36551 |
| ST3GAL5 | 115525 | 639305 | 20536 | 492244 | 36552 |
| ST3GAL5 | 115525 | 638986 | 20537 | 491853 | 36553 |
| ST3GAL5 | 115525 | 639608 | 20538 | 492473 | 36554 |
| ST3GAL5 | 115525 | 639541 | 20539 | 492280 | 36555 |
| ST3GAL5 | 115525 | 639945 | 20540 | 492866 | 36556 |
| ST3GAL5 | 115525 | 638956 | 20541 | 492097 | 36557 |
| ST3GAL5 | 115525 | 639981 | 20542 | 491172 | 36558 |
| ST3GAL5 | 115525 | 640903 | 20543 | 491443 | 36559 |
| ST3GAL5 | 115525 | 640572 | 20544 | 491880 | 36560 |
| ST3GAL5 | 115525 | 640314 | 20545 | 491315 | 36561 |
| ST3GAL5 | 115525 | 639216 | 20546 | N/A | |
| ST3GAL5 | 115525 | 640835 | 20547 | 491038 | 36562 |
| ST3GAL5 | 115525 | 638523 | 20548 | 491664 | 36563 |
| ST3GAL5 | 115525 | 638581 | 20549 | N/A | |
| ST3GAL5 | 115525 | 639202 | 20550 | 492710 | 36564 |
| ST3GAL5 | 115525 | 640336 | 20551 | N/A | |
| ST3GAL5 | 115525 | 640849 | 20552 | 491701 | 36565 |
| ST3GAL5 | 115525 | 306262 | 20553 | 306247 | 36566 |
| ST3GAL5 | 115525 | 639421 | 20554 | 491029 | 36567 |
| ST3GAL5 | 115525 | 639519 | 20555 | 491857 | 36568 |
| ST3GAL5 | 115525 | 455892 | 20556 | 401375 | 36569 |
| ST3GAL5 | 115525 | 639690 | 20557 | 491917 | 36570 |
| ST3GAL5 | 115525 | 473122 | 20558 | 491314 | 36571 |
| ST3GAL5 | 115525 | 487896 | 20559 | N/A | |
| ST3GAL5 | 115525 | 461892 | 20560 | N/A | |
| ST3GAL5 | 115525 | 461199 | 20561 | N/A | |
| ST3GAL5 | 115525 | 433665 | 20562 | 408635 | 36572 |
| ST3GAL5 | 115525 | 484728 | 20563 | N/A | |
| ST3GAL5 | 115525 | 490946 | 20564 | N/A | |
| ST3GAL5 | 115525 | 638258 | 20565 | 491126 | 36573 |
| ST5 | 166444 | 526757 | 20566 | 435097 | 36574 |
| ST5 | 166444 | 534127 | 20567 | 433528 | 36575 |
| ST5 | 166444 | 313726 | 20568 | 319678 | 36576 |
| ST5 | 166444 | 530991 | 20569 | 432887 | 36577 |
| ST5 | 166444 | 526099 | 20570 | 436808 | 36578 |
| ST5 | 166444 | 527540 | 20571 | N/A | |
| ST5 | 166444 | 532162 | 20572 | N/A | |
| ST5 | 166444 | 534278 | 20573 | 433349 | 36579 |
| ST5 | 166444 | 524513 | 20574 | N/A | |
| ST5 | 166444 | 530438 | 20575 | 436802 | 36580 |

| Symbol | ENSG | ENST | SEQ ID | ENSP | SEQ ID |
|---|---|---|---|---|---|
| ST5 | 166444 | 532738 | 20576 | N/A | |
| ST5 | 166444 | 526062 | 20577 | 433043 | 36581 |
| ST5 | 166444 | 532871 | 20578 | N/A | |
| ST5 | 166444 | 533081 | 20579 | N/A | |
| ST5 | 166444 | 526701 | 20580 | N/A | |
| ST5 | 166444 | 530922 | 20581 | N/A | |
| ST5 | 166444 | 530559 | 20582 | N/A | |
| ST5 | 166444 | 533020 | 20583 | 433588 | 36582 |
| ST5 | 166444 | 526837 | 20584 | N/A | |
| ST5 | 166444 | 530338 | 20585 | 435016 | 36583 |
| ST5 | 166444 | 532734 | 20586 | 433793 | 36584 |
| ST5 | 166444 | 530593 | 20587 | 437096 | 36585 |
| ST5 | 166444 | 528527 | 20588 | 431580 | 36586 |
| ST5 | 166444 | 531060 | 20589 | 433858 | 36587 |
| ST5 | 166444 | 533425 | 20590 | N/A | |
| ST5 | 166444 | 526057 | 20591 | 437006 | 36588 |
| ST5 | 166444 | 528196 | 20592 | 431564 | 36589 |
| ST5 | 166444 | 527510 | 20593 | 434701 | 36590 |
| ST5 | 166444 | 530580 | 20594 | 432521 | 36591 |
| ST5 | 166444 | 532651 | 20595 | N/A | |
| ST5 | 166444 | 527870 | 20596 | N/A | |
| ST5 | 166444 | 531093 | 20597 | 436506 | 36592 |
| ST5 | 166444 | 533225 | 20598 | 435292 | 36593 |
| ST5 | 166444 | 526126 | 20599 | 436760 | 36594 |
| ST5 | 166444 | 526221 | 20600 | N/A | |
| ST5 | 166444 | 529940 | 20601 | N/A | |
| ST5 | 166444 | 528523 | 20602 | 433647 | 36595 |
| ST5 | 166444 | 527930 | 20603 | 431252 | 36596 |
| ST5 | 166444 | 534783 | 20604 | N/A | |
| ST5 | 166444 | 533681 | 20605 | 434935 | 36597 |
| ST5 | 166444 | 526241 | 20606 | 433346 | 36598 |
| ST5 | 166444 | 530959 | 20607 | 433008 | 36599 |
| ST5 | 166444 | 533580 | 20608 | 431332 | 36600 |
| ST5 | 166444 | 526155 | 20609 | 431139 | 36601 |
| ST5 | 166444 | 534248 | 20610 | 432872 | 36602 |
| ST5 | 166444 | 527347 | 20611 | 431673 | 36603 |
| ST5 | 166444 | 533016 | 20612 | 434332 | 36604 |
| ST5 | 166444 | 527516 | 20613 | 431990 | 36605 |
| ST5 | 166444 | 527473 | 20614 | 435228 | 36606 |
| ST5 | 166444 | 530938 | 20615 | 436748 | 36607 |
| ST5 | 166444 | 533471 | 20616 | 434930 | 36608 |
| ST5 | 166444 | 524757 | 20617 | 435925 | 36609 |
| ST5 | 166444 | 527392 | 20618 | 435180 | 36610 |
| ST5 | 166444 | 526828 | 20619 | 435562 | 36611 |
| ST5 | 166444 | 525169 | 20620 | 433175 | 36612 |
| ST5 | 166444 | 534665 | 20621 | 436363 | 36613 |
| ST5 | 166444 | 531578 | 20622 | 436154 | 36614 |
| ST5 | 166444 | 531237 | 20623 | N/A | |
| ST5 | 166444 | 531640 | 20624 | N/A | |
| ST5 | 166444 | 528452 | 20625 | N/A | |
| ST5 | 166444 | 626808 | 20626 | 486899 | 36615 |
| ST6GAL2 | 144057 | 361686 | 20627 | 355273 | 36616 |
| ST6GAL2 | 144057 | 409382 | 20628 | 386942 | 36617 |
| ST6GAL2 | 144057 | 361803 | 20629 | 355386 | 36618 |
| ST6GAL2 | 144057 | 409087 | 20630 | 387332 | 36619 |
| ST6GAL2 | 144057 | 419159 | 20631 | 395581 | 36620 |
| ST6GALNAC3 | 184005 | 328299 | 20632 | 329214 | 36621 |
| ST6GALNAC3 | 184005 | 464140 | 20633 | N/A | |
| ST6GALNAC3 | 184005 | 621530 | 20634 | 480283 | 36622 |
| ST6GALNAC5 | 117069 | 477717 | 20635 | 417583 | 36623 |
| ST6GALNAC5 | 117069 | 480428 | 20636 | N/A | |
| ST6GALNAC5 | 117069 | 318803 | 20637 | 436263 | 36624 |
| ST6GALNAC5 | 117069 | 496845 | 20638 | N/A | |
| ST6GALNAC5 | 117069 | 488940 | 20639 | N/A | |
| STAB2 | 136011 | 388887 | 20640 | 373539 | 36625 |
| STAB2 | 136011 | 549474 | 20641 | 449282 | 36626 |
| STAB2 | 136011 | 549798 | 20642 | N/A | |
| STAB2 | 136011 | 548073 | 20643 | N/A | |
| STAB2 | 136011 | 548579 | 20644 | N/A | |
| STAB2 | 136011 | 552777 | 20645 | 446629 | 36627 |
| STAC | 144681 | 273183 | 20646 | 273183 | 36628 |
| STAC | 144681 | 457375 | 20647 | 393713 | 36629 |
| STAC | 144681 | 427486 | 20648 | 397521 | 36630 |
| STAC | 144681 | 434649 | 20649 | 398403 | 36631 |
| STAC | 144681 | 476388 | 20650 | N/A | |
| STAC | 144681 | 486143 | 20651 | N/A | |

-continued

-continued

| Symbol | ENSG | ENST | SEQ ID | ENSP | SEQ ID |
|---|---|---|---|---|---|
| STAC | 144681 | 473452 | 20652 | N/A | |
| STAC | 144681 | 465064 | 20653 | N/A | |
| STAC2 | 141750 | 333461 | 20654 | 327509 | 36632 |
| STAC2 | 141750 | 584501 | 20655 | 463299 | 36633 |
| STAG3 | 066923 | 426455 | 20656 | 400359 | 36634 |
| STAG3 | 066923 | 394018 | 20657 | 377586 | 36635 |
| STAG3 | 066923 | 416412 | 20658 | 409283 | 36636 |
| STAG3 | 066923 | 317296 | 20659 | 319318 | 36637 |
| STAG3 | 066923 | 422690 | 20660 | 407884 | 36638 |
| STAG3 | 066923 | 496157 | 20661 | N/A | |
| STAG3 | 066923 | 439782 | 20662 | 397067 | 36639 |
| STAG3 | 066923 | 482546 | 20663 | N/A | |
| STAG3 | 066923 | 459699 | 20664 | N/A | |
| STAG3 | 066923 | 491498 | 20665 | N/A | |
| STAG3 | 066923 | 440830 | 20666 | N/A | |
| STAG3 | 066923 | 477469 | 20667 | N/A | |
| STAG3 | 066923 | 476057 | 20668 | N/A | |
| STAG3 | 066923 | 479359 | 20669 | N/A | |
| STAG3 | 066923 | 412190 | 20670 | 395039 | 36640 |
| STAG3 | 066923 | 451963 | 20671 | 393790 | 36641 |
| STAG3 | 066923 | 492674 | 20672 | N/A | |
| STAG3 | 066923 | 620100 | 20673 | 484098 | 36642 |
| STAG3 | 066923 | 615138 | 20674 | 477973 | 36643 |
| STAMBPL1 | 138134 | 371926 | 20675 | 360994 | 36644 |
| STAMBPL1 | 138134 | 371927 | 20676 | 360995 | 36645 |
| STAMBPL1 | 138134 | 461650 | 20677 | N/A | |
| STAMBPL1 | 138134 | 468698 | 20678 | N/A | |
| STAMBPL1 | 138134 | 371924 | 20679 | 360992 | 36646 |
| STAMBPL1 | 138134 | 371922 | 20680 | 360990 | 36647 |
| STARD13 | 133121 | 336934 | 20681 | 338785 | 36648 |
| STARD13 | 133121 | 255486 | 20682 | 255486 | 36649 |
| STARD13 | 133121 | 399365 | 20683 | 382300 | 36650 |
| STARD13 | 133121 | 491333 | 20684 | N/A | |
| STARD13 | 133121 | 567873 | 20685 | 456233 | 36651 |
| STARD13 | 133121 | 487412 | 20686 | N/A | |
| STARD13 | 133121 | 498019 | 20687 | N/A | |
| STARD13 | 133121 | 344312 | 20688 | N/A | |
| STARD13 | 133121 | 439831 | 20689 | 457840 | 36652 |
| STARD8 | 130052 | 488088 | 20690 | N/A | |
| STARD8 | 130052 | 523864 | 20691 | 428031 | 36653 |
| STARD8 | 130052 | 374599 | 20692 | 363727 | 36654 |
| STARD8 | 130052 | 374597 | 20693 | 363725 | 36655 |
| STARD8 | 130052 | 252336 | 20694 | 252336 | 36656 |
| STAT2 | 170581 | 556539 | 20695 | N/A | |
| STAT2 | 170581 | 314128 | 20696 | 315768 | 36657 |
| STAT2 | 170581 | 557235 | 20697 | 450751 | 36658 |
| STAT2 | 170581 | 555488 | 20698 | N/A | |
| STAT2 | 170581 | 557199 | 20699 | N/A | |
| STAT2 | 170581 | 418572 | 20700 | 387354 | 36659 |
| STAT2 | 170581 | 555519 | 20701 | N/A | |
| STAT2 | 170581 | 557252 | 20702 | N/A | |
| STAT2 | 170581 | 556140 | 20703 | N/A | |
| STAT2 | 170581 | 557156 | 20704 | N/A | |
| STAT2 | 170581 | 557417 | 20705 | N/A | |
| STAT2 | 170581 | 555616 | 20706 | 450985 | 36660 |
| STAT5A | 126561 | 345506 | 20707 | 341208 | 36661 |
| STAT5A | 126561 | 590949 | 20708 | 468749 | 36662 |
| STAT5A | 126561 | 546010 | 20709 | 443107 | 36663 |
| STAT5A | 126561 | 590726 | 20710 | 464730 | 36664 |
| STAT5A | 126561 | 469124 | 20711 | N/A | |
| STAT5A | 126561 | 444283 | 20712 | 407327 | 36665 |
| STAT5A | 126561 | 588868 | 20713 | 465437 | 36666 |
| STAT5A | 126561 | 478897 | 20714 | N/A | |
| STAT5A | 126561 | 479417 | 20715 | N/A | |
| STAT5A | 126561 | 468096 | 20716 | N/A | |
| STAT5A | 126561 | 591556 | 20717 | N/A | |
| STAT5A | 126561 | 587616 | 20718 | 466320 | 36667 |
| STC2 | 113739 | 265087 | 20719 | 265087 | 36668 |
| STC2 | 113739 | 520593 | 20720 | N/A | |
| STC2 | 113739 | 520648 | 20721 | 428470 | 36669 |
| STC2 | 113739 | 518455 | 20722 | 427816 | 36670 |
| STC2 | 113739 | 519511 | 20723 | N/A | |
| STEAP3 | 115107 | 393110 | 20724 | 376822 | 36671 |
| STEAP3 | 115107 | 393106 | 20725 | 376818 | 36672 |
| STEAP3 | 115107 | 409811 | 20726 | 386510 | 36673 |
| STEAP3 | 115107 | 393107 | 20727 | 376819 | 36674 |

| Symbol | ENSG | ENST | SEQ ID | ENSP | SEQ ID |
|---|---|---|---|---|---|
| STIP1 | 168439 | 358794 | 20728 | 351646 | 36675 |
| STIP1 | 168439 | 305218 | 20729 | 305958 | 36676 |
| STIP1 | 168439 | 536973 | 20730 | 441036 | 36677 |
| STIP1 | 168439 | 538945 | 20731 | 445957 | 36678 |
| STIP1 | 168439 | 543847 | 20732 | 442704 | 36679 |
| STIP1 | 168439 | 540736 | 20733 | N/A | |
| STIP1 | 168439 | 540501 | 20734 | N/A | |
| STIP1 | 168439 | 544739 | 20735 | N/A | |
| STIP1 | 168439 | 537479 | 20736 | N/A | |
| STIP1 | 168439 | 538497 | 20737 | N/A | |
| STIP1 | 168439 | 540887 | 20738 | 443416 | 36680 |
| STIP1 | 168439 | 355603 | 20739 | N/A | |
| STK17B | 081320 | 263955 | 20740 | 263955 | 36681 |
| STK17B | 081320 | 409228 | 20741 | 386853 | 36682 |
| STK17B | 081320 | 606789 | 20742 | 475843 | 36683 |
| STK17B | 081320 | 420683 | 20743 | 399755 | 36684 |
| STK17B | 081320 | 449152 | 20744 | 413289 | 36685 |
| STK19 | 226257 | 497732 | 20745 | N/A | |
| STK19 | 226257 | 426802 | 20746 | 389352 | 36686 |
| STK19 | 226257 | 452688 | 20747 | 413766 | 36687 |
| STK19 | 226257 | 466867 | 20748 | N/A | |
| STK19 | 226257 | 478799 | 20749 | N/A | |
| STK19 | 226257 | 520138 | 20750 | 428007 | 36688 |
| STK19 | 226257 | 486358 | 20751 | N/A | |
| STK19 | 226257 | 468899 | 20752 | N/A | |
| STK19 | 226257 | 460232 | 20753 | N/A | |
| STK19 | 226257 | 464694 | 20754 | N/A | |
| STK19 | 226257 | 473747 | 20755 | N/A | |
| STK19 | 226257 | 447249 | 20756 | N/A | |
| STK19 | 226257 | 549310 | 20757 | 446620 | 36689 |
| STK19 | 234947 | 459769 | 20758 | N/A | |
| STK19 | 234947 | 425138 | 20759 | 395028 | 36690 |
| STK19 | 234947 | 433397 | 20760 | 395864 | 36691 |
| STK19 | 234947 | 483467 | 20761 | N/A | |
| STK19 | 234947 | 487912 | 20762 | N/A | |
| STK19 | 234947 | 461093 | 20763 | N/A | |
| STK19 | 234947 | 462407 | 20764 | N/A | |
| STK19 | 234947 | 490195 | 20765 | N/A | |
| STK19 | 234947 | 490429 | 20766 | N/A | |
| STK19 | 234947 | 479148 | 20767 | N/A | |
| STK19 | 234947 | 474087 | 20768 | N/A | |
| STK19 | 234947 | 551718 | 20769 | 449149 | 36692 |
| STK19 | 204344 | 466132 | 20770 | N/A | |
| STK19 | 204344 | 460018 | 20771 | 418350 | 36693 |
| STK19 | 204344 | 479644 | 20772 | N/A | |
| STK19 | 204344 | 375331 | 20773 | 364480 | 36694 |
| STK19 | 204344 | 492583 | 20774 | N/A | |
| STK19 | 204344 | 375333 | 20775 | 364482 | 36695 |
| STK19 | 204344 | 473983 | 20776 | N/A | |
| STK19 | 204344 | 478486 | 20777 | N/A | |
| STK19 | 204344 | 463823 | 20778 | N/A | |
| STK19 | 204344 | 483801 | 20779 | 418866 | 36696 |
| STK19 | 204344 | 519179 | 20780 | 454870 | 36697 |
| STK19 | 204344 | 466336 | 20781 | N/A | |
| STK19 | 204344 | 471028 | 20782 | N/A | |
| STK19 | 204344 | 491861 | 20783 | N/A | |
| STK19 | 204344 | 484540 | 20784 | N/A | |
| STK19 | 204344 | 469907 | 20785 | N/A | |
| STK19 | 204344 | 490822 | 20786 | N/A | |
| STK19 | 236250 | 424104 | 20787 | 393272 | 36698 |
| STK19 | 236250 | 438256 | 20788 | 391798 | 36699 |
| STK19 | 236250 | 469677 | 20789 | N/A | |
| STK19 | 236250 | 478011 | 20790 | N/A | |
| STK19 | 236250 | 460069 | 20791 | N/A | |
| STK19 | 236250 | 464830 | 20792 | N/A | |
| STK19 | 236250 | 472631 | 20793 | N/A | |
| STK19 | 236250 | 493840 | 20794 | N/A | |
| STK19 | 236250 | 486636 | 20795 | N/A | |
| STK19 | 236250 | 491132 | 20796 | N/A | |
| STK19 | 236250 | 468547 | 20797 | N/A | |
| STK19 | 236250 | 550656 | 20798 | 447097 | 36700 |
| STK19 | 206342 | 478304 | 20799 | N/A | |
| STK19 | 206342 | 383328 | 20800 | 372818 | 36701 |
| STK19 | 206342 | 383327 | 20801 | 372817 | 36702 |
| STK19 | 206342 | 497879 | 20802 | N/A | |
| STK19 | 206342 | 469629 | 20803 | N/A | |

| Symbol | ENSG | ENST | SEQ ID | ENSP | SEQ ID |
|---|---|---|---|---|---|
| STK19 | 206342 | 481181 | 20804 | 476036 | 36703 |
| STK19 | 206342 | 468702 | 20805 | N/A | |
| STK19 | 206342 | 490657 | 20806 | N/A | |
| STK19 | 206342 | 465945 | 20807 | N/A | |
| STK19 | 206342 | 460304 | 20808 | N/A | |
| STK19 | 206342 | 469343 | 20809 | N/A | |
| STK19 | 206342 | 547578 | 20810 | 448123 | 36704 |
| STK19 | 226033 | 496606 | 20811 | N/A | |
| STK19 | 226033 | 444147 | 20812 | 399915 | 36705 |
| STK19 | 226033 | 431383 | 20813 | 403479 | 36706 |
| STK19 | 226033 | 481637 | 20814 | N/A | |
| STK19 | 226033 | 478362 | 20815 | N/A | |
| STK19 | 226033 | 523972 | 20816 | 429285 | 36707 |
| STK19 | 226033 | 472138 | 20817 | N/A | |
| STK19 | 226033 | 480096 | 20818 | N/A | |
| STK19 | 226033 | 465050 | 20819 | N/A | |
| STK19 | 226033 | 465734 | 20820 | N/A | |
| STK19 | 226033 | 480672 | 20821 | N/A | |
| STK19 | 226033 | 463291 | 20822 | N/A | |
| STK19 | 226033 | 549916 | 20823 | 446725 | 36708 |
| STK3 | 104375 | 517832 | 20824 | N/A | |
| STK3 | 104375 | 419617 | 20825 | 390500 | 36709 |
| STK3 | 104375 | 523601 | 20826 | 429744 | 36710 |
| STK3 | 104375 | 520440 | 20827 | N/A | |
| STK3 | 104375 | 518582 | 20828 | N/A | |
| STK3 | 104375 | 523159 | 20829 | N/A | |
| STK3 | 104375 | 518165 | 20830 | 428014 | 36711 |
| STK3 | 104375 | 518627 | 20831 | N/A | |
| STK3 | 104375 | 522924 | 20832 | N/A | |
| STK3 | 104375 | 521649 | 20833 | 429369 | 36712 |
| STK3 | 104375 | 520053 | 20834 | N/A | |
| STK3 | 104375 | 521768 | 20835 | N/A | |
| STK3 | 104375 | 520653 | 20836 | N/A | |
| STK3 | 104375 | 424861 | 20837 | 428167 | 36713 |
| STK3 | 104375 | 523567 | 20838 | N/A | |
| STK3 | 104375 | 523960 | 20839 | N/A | |
| STK3 | 104375 | 519420 | 20840 | 428295 | 36714 |
| STK3 | 104375 | 617590 | 20841 | 482260 | 36715 |
| STK32A | 169302 | 306304 | 20842 | N/A | |
| STK32A | 169302 | 397936 | 20843 | 381030 | 36716 |
| STK32A | 169302 | 503975 | 20844 | N/A | |
| STK32A | 169302 | 626951 | 20845 | 487441 | 36717 |
| STK32A | 169302 | 398523 | 20846 | 381535 | 36718 |
| STK32A | 169302 | 503384 | 20847 | N/A | |
| STK32A | 169302 | 515832 | 20848 | N/A | |
| STK32A | 169302 | 506091 | 20849 | N/A | |
| STK32A | 169302 | 510953 | 20850 | N/A | |
| STK32B | 152953 | 282908 | 20851 | 282908 | 36719 |
| STK32B | 152953 | 512018 | 20852 | 422820 | 36720 |
| STK32B | 152953 | 512636 | 20853 | 423209 | 36721 |
| STK32B | 152953 | 510398 | 20854 | 420984 | 36722 |
| STK32B | 152953 | 513705 | 20855 | N/A | |
| STK32B | 152953 | 505508 | 20856 | N/A | |
| STK32B | 152953 | 511959 | 20857 | N/A | |
| STK32B | 152953 | 508728 | 20858 | N/A | |
| STK33 | 130413 | 473980 | 20859 | N/A | |
| STK33 | 130413 | 486305 | 20860 | N/A | |
| STK33 | 130413 | 447869 | 20861 | 416750 | 36723 |
| STK33 | 130413 | 315204 | 20862 | 320754 | 36724 |
| STK33 | 130413 | 396672 | 20863 | 379905 | 36725 |
| STK33 | 130413 | 358872 | 20864 | 351743 | 36726 |
| STK33 | 130413 | 444064 | 20865 | 415688 | 36727 |
| STK33 | 130413 | 534493 | 20866 | 436418 | 36728 |
| STK33 | 130413 | 526517 | 20867 | N/A | |
| STK33 | 130413 | 524760 | 20868 | 436905 | 36729 |
| STK33 | 130413 | 418597 | 20869 | 391362 | 36730 |
| STK33 | 130413 | 422559 | 20870 | 411510 | 36731 |
| STK33 | 130413 | 457885 | 20871 | 403599 | 36732 |
| STK33 | 130413 | 532336 | 20872 | N/A | |
| STK33 | 130413 | 431279 | 20873 | 397569 | 36733 |
| STK33 | 130413 | 454443 | 20874 | 397874 | 36734 |
| STK33 | 130413 | 526360 | 20875 | 432822 | 36735 |
| STK38L | 211455 | 541191 | 20876 | 437856 | 36736 |
| STK38L | 211455 | 389032 | 20877 | 373684 | 36737 |
| STK38L | 211455 | 545470 | 20878 | 439457 | 36738 |
| STK38L | 211455 | 544367 | 20879 | 445898 | 36739 |

| Symbol | ENSG | ENST | SEQ ID | ENSP | SEQ ID |
|---|---|---|---|---|---|
| STK38L | 211455 | 539863 | 20880 | N/A | |
| STK38L | 211455 | 434385 | 20881 | N/A | |
| STK38L | 211455 | 540996 | 20882 | 443838 | 36740 |
| STK38L | 211455 | 546286 | 20883 | 443456 | 36741 |
| STK38L | 211455 | 543246 | 20884 | 442253 | 36742 |
| STK38L | 211455 | 544969 | 20885 | 440279 | 36743 |
| STK38L | 211455 | 407753 | 20886 | 385174 | 36744 |
| STK38L | 211455 | 536093 | 20887 | 443961 | 36745 |
| STK38L | 211455 | 543992 | 20888 | N/A | |
| STMN4 | 015592 | 350889 | 20889 | 342538 | 36746 |
| STMN4 | 015592 | 519997 | 20890 | 428474 | 36747 |
| STMN4 | 015592 | 265770 | 20891 | 265770 | 36748 |
| STMN4 | 015592 | 523048 | 20892 | 428428 | 36749 |
| STMN4 | 015592 | 519614 | 20893 | 430699 | 36750 |
| STMN4 | 015592 | 522908 | 20894 | 430389 | 36751 |
| STMN4 | 015592 | 522750 | 20895 | N/A | |
| STON1 | 243244 | 484110 | 20896 | N/A | |
| STON1 | 243244 | 404752 | 20897 | 385273 | 36752 |
| STON1 | 243244 | 406226 | 20898 | 384615 | 36753 |
| STON1 | 243244 | 444932 | 20899 | 399868 | 36754 |
| STON2 | 140022 | 555447 | 20900 | 450857 | 36755 |
| STON2 | 140022 | 553821 | 20901 | 450577 | 36756 |
| STON2 | 140022 | 555284 | 20902 | N/A | |
| STON2 | 140022 | 267540 | 20903 | 267540 | 36757 |
| STON2 | 140022 | 556280 | 20904 | N/A | |
| STON2 | 140022 | 555226 | 20905 | N/A | |
| STON2 | 140022 | 557055 | 20906 | 450990 | 36758 |
| STON2 | 140022 | 554710 | 20907 | 451383 | 36759 |
| STON2 | 140022 | 614646 | 20908 | 477736 | 36760 |
| STOX2 | 173320 | 513034 | 20909 | 422118 | 36761 |
| STOX2 | 173320 | 511250 | 20910 | N/A | |
| STOX2 | 173320 | 308497 | 20911 | 311257 | 36762 |
| STOX2 | 173320 | 512520 | 20912 | 425388 | 36763 |
| STOX2 | 173320 | 506529 | 20913 | 426209 | 36764 |
| STRAP | 023734 | 541731 | 20914 | 445693 | 36765 |
| STRAP | 023734 | 025399 | 20915 | 025399 | 36766 |
| STRAP | 023734 | 419869 | 20916 | 392270 | 36767 |
| STRAP | 023734 | 536737 | 20917 | N/A | |
| STRAP | 023734 | 538718 | 20918 | 445814 | 36768 |
| STRAP | 023734 | 539887 | 20919 | N/A | |
| STRC | 242866 | 450892 | 20920 | 401513 | 36769 |
| STRC | 242866 | 471703 | 20921 | N/A | |
| STRC | 242866 | 448437 | 20922 | N/A | |
| STRC | 242866 | 485556 | 20923 | N/A | |
| STRC | 242866 | 428650 | 20924 | 415991 | 36770 |
| STRC | 242866 | 440125 | 20925 | 394866 | 36771 |
| STRC | 242866 | 460952 | 20926 | N/A | |
| STRC | 242866 | 493750 | 20927 | N/A | |
| STRC | 242866 | 455136 | 20928 | 394755 | 36772 |
| STRC | 242866 | 483250 | 20929 | N/A | |
| STRC | 242866 | 470279 | 20930 | N/A | |
| STRC | 242866 | 432436 | 20931 | 407303 | 36773 |
| STRC | 242866 | 541030 | 20932 | 440413 | 36774 |
| STRIP2 | 128578 | 249344 | 20933 | 249344 | 36775 |
| STRIP2 | 128578 | 435494 | 20934 | 392393 | 36776 |
| STRIP2 | 128578 | 465033 | 20935 | N/A | |
| STRN | 115808 | 263918 | 20936 | 263918 | 36777 |
| STRN | 115808 | 495595 | 20937 | N/A | |
| STRN | 115808 | 379213 | 20938 | 368513 | 36778 |
| STX17 | 136874 | 259400 | 20939 | 259400 | 36779 |
| STX17 | 136874 | 529340 | 20940 | 434323 | 36780 |
| STX17 | 136874 | 533696 | 20941 | N/A | |
| STX17 | 136874 | 531035 | 20942 | 433694 | 36781 |
| STX17 | 136874 | 525342 | 20943 | 433701 | 36782 |
| STX17 | 136874 | 524405 | 20944 | 436666 | 36783 |
| STX17 | 136874 | 525610 | 20945 | 435981 | 36784 |
| STX17 | 136874 | 534052 | 20946 | 433484 | 36785 |
| STX17 | 136874 | 526607 | 20947 | 434547 | 36786 |
| STX17 | 136874 | 525579 | 20948 | N/A | |
| STX17 | 136874 | 525847 | 20949 | N/A | |
| STX17 | 136874 | 529385 | 20950 | N/A | |
| STXBP2 | 076944 | 593535 | 20951 | 470313 | 36787 |
| STXBP2 | 076944 | 597467 | 20952 | N/A | |
| STXBP2 | 076944 | 595950 | 20953 | 471161 | 36788 |
| STXBP2 | 076944 | 595181 | 20954 | N/A | |
| STXBP2 | 076944 | 441779 | 20955 | 413606 | 36789 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| STXBP2 | 076944 | 599905 | 20956 | N/A | | 5 | SVOP | 166111 | 550436 | 21032 | 447583 | 36823 |
| STXBP2 | 076944 | 221283 | 20957 | 221283 | 36790 | | SVOP | 166111 | 546618 | 21033 | 447275 | 36824 |
| STXBP2 | 076944 | 597068 | 20958 | 471327 | 36791 | | SVOP | 166111 | 548229 | 21034 | N/A | |
| STXBP2 | 076944 | 414284 | 20959 | 409471 | 36792 | | SWAP70 | 133789 | 447399 | 21035 | 399056 | 36825 |
| STXBP2 | 076944 | 599737 | 20960 | 471585 | 36793 | | SWAP70 | 133789 | 318950 | 21036 | 315630 | 36826 |
| STXBP2 | 076944 | 599648 | 20961 | N/A | | | SWAP70 | 133789 | 526358 | 21037 | 431768 | 36827 |
| STXBP2 | 076944 | 594221 | 20962 | N/A | | 10 | SWAP70 | 133789 | 531814 | 21038 | N/A | |
| STXBP2 | 076944 | 595861 | 20963 | N/A | | | SWAP70 | 133789 | 524817 | 21039 | N/A | |
| STXBP2 | 076944 | 600702 | 20964 | 471737 | 36794 | | SWAP70 | 133789 | 534662 | 21040 | 435587 | 36828 |
| STXBP2 | 076944 | 599400 | 20965 | 473040 | 36795 | | SWAP70 | 133789 | 534562 | 21041 | 433824 | 36829 |
| STXBP2 | 076944 | 593854 | 20966 | N/A | | | SYAP1 | 169895 | 380155 | 21042 | 369500 | 36830 |
| STXBP2 | 076944 | 595800 | 20967 | N/A | | | SYAP1 | 169895 | 495743 | 21043 | N/A | |
| STXBP2 | 076944 | 599558 | 20968 | N/A | | 15 | SYCP1 | 198765 | 369522 | 21044 | 358535 | 36831 |
| STXBP2 | 076944 | 601061 | 20969 | N/A | | | SYCP1 | 198765 | 455987 | 21045 | 410011 | 36832 |
| STXBP2 | 076944 | 602355 | 20970 | 473406 | 36796 | | SYCP1 | 198765 | 369518 | 21046 | 358531 | 36833 |
| STXBP2 | 076944 | 599278 | 20971 | N/A | | | SYCP1 | 198765 | 477215 | 21047 | N/A | |
| STXBP2 | 076944 | 612033 | 20972 | 478797 | 36797 | | SYCP1 | 198765 | 468191 | 21048 | N/A | |
| STXBP3 | 116266 | 483586 | 20973 | N/A | | | SYCP1 | 198765 | 482717 | 21049 | N/A | |
| STXBP3 | 116266 | 469338 | 20974 | N/A | | 20 | SYCP1 | 198765 | 493377 | 21050 | N/A | |
| STXBP3 | 116266 | 370008 | 20975 | 359025 | 36798 | | SYCP1 | 198765 | 477590 | 21051 | N/A | |
| STXBP3 | 116266 | 486601 | 20976 | N/A | | | SYCP1 | 198765 | 618516 | 21052 | 480997 | 36834 |
| STXBP3 | 116266 | 485167 | 20977 | N/A | | | SYCP1 | 198765 | 613524 | 21053 | 482532 | 36835 |
| STXBP3 | 116266 | 495245 | 20978 | N/A | | | SYN3 | 185666 | 358763 | 21054 | 351614 | 36836 |
| STXBP3 | 116266 | 472099 | 20979 | N/A | | | SYN3 | 185666 | 483062 | 21055 | N/A | |
| SULF2 | 196562 | 479472 | 20980 | N/A | | 25 | SYN3 | 185666 | 467095 | 21056 | N/A | |
| SULF2 | 196562 | 359930 | 20981 | 353007 | 36799 | | SYN3 | 185666 | 461446 | 21057 | N/A | |
| SULF2 | 196562 | 479970 | 20982 | N/A | | | SYN3 | 185666 | 459990 | 21058 | N/A | |
| SULF2 | 196562 | 484875 | 20983 | 418290 | 36800 | | SYN3 | 185666 | 468922 | 21059 | N/A | |
| SULF2 | 196562 | 495544 | 20984 | 417894 | 36801 | | SYN3 | 185666 | 462268 | 21060 | N/A | |
| SULF2 | 196562 | 467815 | 20985 | 418442 | 36802 | | SYN3 | 185666 | 467824 | 21061 | N/A | |
| SULF2 | 196562 | 433632 | 20986 | N/A | | 30 | SYN3 | 185666 | 472027 | 21062 | N/A | |
| SULF2 | 196562 | 465769 | 20987 | N/A | | | SYN3 | 185666 | 441821 | 21063 | 395794 | 36837 |
| SULF2 | 196562 | 474450 | 20988 | N/A | | | SYN3 | 185666 | 412575 | 21064 | 388582 | 36838 |
| SULF2 | 196562 | 463221 | 20989 | N/A | | | SYN3 | 185666 | 619146 | 21065 | 477861 | 36839 |
| SULF2 | 196562 | 437955 | 20990 | 410026 | 36803 | | SYN3 | 185666 | 332840 | 21066 | 330219 | 36840 |
| SULF2 | 196562 | 478766 | 20991 | N/A | | | SYNDIG1 | 101463 | 376862 | 21067 | 366058 | 36841 |
| SURF2 | 148291 | 371964 | 20992 | 361032 | 36804 | | SYNDIG1 | 101463 | 482637 | 21068 | N/A | |
| SURF2 | 148291 | 495524 | 20993 | N/A | | 35 | SYNDIG1L | 183379 | 554823 | 21069 | 450439 | 36842 |
| SURF2 | 148291 | 486887 | 20994 | N/A | | | SYNDIG1L | 183379 | 554953 | 21070 | 451519 | 36843 |
| SURF2 | 281024 | 630633 | 20995 | 487370 | 36805 | | SYNDIG1L | 183379 | 331628 | 21071 | 331474 | 36844 |
| SURF2 | 281024 | 627396 | 20996 | N/A | | | SYNJ2 | 078269 | 355585 | 21072 | 347792 | 36845 |
| SURF2 | 281024 | 626704 | 20997 | N/A | | | SYNJ2 | 078269 | 640338 | 21073 | 492532 | 36846 |
| SUSD5 | 173705 | 309558 | 20998 | 308727 | 36806 | | SYNJ2 | 078269 | 367113 | 21074 | 356080 | 36847 |
| SUSD5 | 173705 | 412539 | 20999 | 406475 | 36807 | 40 | SYNJ2 | 078269 | 638626 | 21075 | 492369 | 36848 |
| SUSD6 | 100647 | 342745 | 21000 | 344424 | 36808 | | SYNJ2 | 078269 | 449320 | 21076 | 411202 | 36849 |
| SUSD6 | 100647 | 553497 | 21001 | N/A | | | SYNJ2 | 078269 | 640569 | 21077 | N/A | |
| SUSD6 | 100647 | 556993 | 21002 | N/A | | | SYNJ2 | 078269 | 485863 | 21078 | 436657 | 36850 |
| SV2B | 185518 | 545111 | 21003 | 443243 | 36809 | | SYNJ2 | 078269 | 367112 | 21079 | N/A | |
| SV2B | 185518 | 394232 | 21004 | 377779 | 36810 | | SYNJ2 | 078269 | 367122 | 21080 | 356089 | 36851 |
| SV2B | 185518 | 557410 | 21005 | 450992 | 36811 | 45 | SYNPR | 163630 | 478456 | 21081 | N/A | |
| SV2B | 185518 | 557291 | 21006 | N/A | | | SYNPR | 163630 | 478300 | 21082 | 418994 | 36852 |
| SV2B | 185518 | 553727 | 21007 | N/A | | | SYNPR | 163630 | 450542 | 21083 | 402121 | 36853 |
| SV2B | 185518 | 330276 | 21008 | 332818 | 36812 | | SYNPR | 163630 | 468110 | 21084 | 419441 | 36854 |
| SV2C | 122012 | 502798 | 21009 | 423541 | 36813 | | SYNPR | 163630 | 496889 | 21085 | N/A | |
| SV2C | 122012 | 322285 | 21010 | 316983 | 36814 | | SYNPR | 163630 | 460142 | 21086 | N/A | |
| SV2C | 122012 | 506257 | 21011 | N/A | | | SYNPR | 163630 | 493532 | 21087 | N/A | |
| SVEP1 | 165124 | 374469 | 21012 | 363593 | 36815 | 50 | SYNPR | 163630 | 467934 | 21088 | N/A | |
| SVEP1 | 165124 | 476205 | 21013 | N/A | | | SYNPR | 163630 | 295894 | 21089 | 295894 | 36855 |
| SVEP1 | 165124 | 467821 | 21014 | N/A | | | SYNPR | 163630 | 498449 | 21090 | 420383 | 36856 |
| SVEP1 | 165124 | 374461 | 21015 | 363585 | 36816 | | SYNPR | 163630 | 472899 | 21091 | 420623 | 36857 |
| SVEP1 | 165124 | 401783 | 21016 | 384917 | 36817 | | SYNPR | 163630 | 479198 | 21092 | 418929 | 36858 |
| SVIL | 197321 | 375400 | 21017 | 364549 | 36818 | | SYNPR | 163630 | 478744 | 21093 | N/A | |
| SVIL | 197321 | 355867 | 21018 | 348128 | 36819 | 55 | SYNPR | 163630 | 460711 | 21094 | 418701 | 36859 |
| SVIL | 197321 | 632315 | 21019 | 488171 | 36820 | | SYNPR | 163630 | 465156 | 21095 | 418123 | 36860 |
| SVIL | 197321 | 460007 | 21020 | N/A | | | SYT10 | 110975 | 228567 | 21096 | 228567 | 36861 |
| SVIL | 197321 | 482607 | 21021 | N/A | | | SYT10 | 110975 | 539102 | 21097 | 444577 | 36862 |
| SVIL | 197321 | 474106 | 21022 | N/A | | | SYT10 | 110975 | 567656 | 21098 | N/A | |
| SVIL | 197321 | 491872 | 21023 | N/A | | | SYT12 | 173227 | 393946 | 21099 | 377520 | 36863 |
| SVIL | 197321 | 464984 | 21024 | N/A | | 60 | SYT12 | 173227 | 525457 | 21100 | 431400 | 36864 |
| SVIL | 197321 | 483758 | 21025 | N/A | | | SYT12 | 173227 | 527043 | 21101 | 435316 | 36865 |
| SVIL | 197321 | 464726 | 21026 | N/A | | | SYT12 | 173227 | 526281 | 21102 | N/A | |
| SVIL | 197321 | 490031 | 21027 | N/A | | | SYT12 | 173227 | 531392 | 21103 | N/A | |
| SVIL | 197321 | 465422 | 21028 | N/A | | | SYT12 | 173227 | 533427 | 21104 | 434709 | 36866 |
| SVIL | 197321 | 375398 | 21029 | 364547 | 36821 | | SYT12 | 173227 | 525149 | 21105 | N/A | |
| SVOP | 166111 | 610966 | 21030 | 479104 | 36822 | 65 | SYT14 | 143469 | 367019 | 21106 | 355986 | 36867 |
| SVOP | 166111 | 551211 | 21031 | N/A | | | SYT14 | 143469 | 637265 | 21107 | 489897 | 36868 |

-continued

| Symbol | ENSG | ENST | SEQ ID | ENSP | SEQ ID |
|---|---|---|---|---|---|
| SYT14 | 143469 | 637945 | 21108 | 489671 | 36869 |
| SYT14 | 143469 | 472886 | 21109 | 418901 | 36870 |
| SYT14 | 143469 | 399639 | 21110 | 445837 | 36871 |
| SYT14 | 143469 | 367015 | 21111 | 355982 | 36872 |
| SYT14 | 143469 | 534859 | 21112 | 442891 | 36873 |
| SYT14 | 143469 | 629778 | 21113 | 486230 | 36874 |
| SYT14 | 143469 | 537238 | 21114 | 437423 | 36875 |
| SYT16 | 139973 | 554138 | 21115 | N/A | |
| SYT16 | 139973 | 636344 | 21116 | N/A | |
| SYT16 | 139973 | 636133 | 21117 | 490266 | 36876 |
| SYT16 | 139973 | 554436 | 21118 | N/A | |
| SYT16 | 139973 | 568344 | 21119 | 478637 | 36877 |
| SYT16 | 139973 | 555409 | 21120 | 451035 | 36878 |
| SYT16 | 139973 | 430451 | 21121 | 394700 | 36879 |
| SYT17 | 103528 | 570264 | 21122 | 456790 | 36880 |
| SYT17 | 103528 | 566261 | 21123 | 454335 | 36881 |
| SYT17 | 103528 | 355377 | 21124 | 347538 | 36882 |
| SYT17 | 103528 | 568115 | 21125 | 456009 | 36883 |
| SYT17 | 103528 | 562034 | 21126 | 456252 | 36884 |
| SYT17 | 103528 | 562711 | 21127 | 454721 | 36885 |
| SYT17 | 103528 | 562274 | 21128 | N/A | |
| SYT17 | 103528 | 565183 | 21129 | 456879 | 36886 |
| SYT17 | 103528 | 568433 | 21130 | 456915 | 36887 |
| SYT2 | 143858 | 367267 | 21131 | 356236 | 36888 |
| SYT2 | 143858 | 367268 | 21132 | 356237 | 36889 |
| SYT3 | 213023 | 595557 | 21133 | 469834 | 36890 |
| SYT3 | 213023 | 338916 | 21134 | 340914 | 36891 |
| SYT3 | 213023 | 600079 | 21135 | 469398 | 36892 |
| SYT3 | 213023 | 593901 | 21136 | 468982 | 36893 |
| SYT3 | 213023 | 595117 | 21137 | N/A | |
| SYT3 | 213023 | 598997 | 21138 | 469637 | 36894 |
| SYT4 | 132872 | 255224 | 21139 | 255224 | 36895 |
| SYT4 | 132872 | 586678 | 21140 | N/A | |
| SYT4 | 132872 | 590752 | 21141 | 466930 | 36896 |
| SYT4 | 132872 | 585604 | 21142 | N/A | |
| SYT4 | 132872 | 596867 | 21143 | 470516 | 36897 |
| SYT4 | 132872 | 589479 | 21144 | N/A | |
| SYT4 | 132872 | 593720 | 21145 | 472583 | 36898 |
| SYT4 | 132872 | 591820 | 21146 | N/A | |
| SYT7 | 011347 | 263846 | 21147 | 263846 | 36899 |
| SYT7 | 011347 | 540677 | 21148 | 444201 | 36900 |
| SYT7 | 011347 | 539246 | 21149 | 438171 | 36901 |
| SYT7 | 011347 | 539468 | 21150 | 441184 | 36902 |
| SYT7 | 011347 | 539008 | 21151 | 439694 | 36903 |
| SYT7 | 011347 | 542836 | 21152 | 444568 | 36904 |
| SYT7 | 011347 | 542670 | 21153 | 444019 | 36905 |
| SYT7 | 011347 | 535826 | 21154 | 437720 | 36906 |
| SYT7 | 011347 | 540831 | 21155 | N/A | |
| SYT7 | 011347 | 545053 | 21156 | 443576 | 36907 |
| TANC1 | 115183 | 263635 | 21157 | 263635 | 36908 |
| TANC1 | 115183 | 464096 | 21158 | N/A | |
| TANC1 | 115183 | 465963 | 21159 | N/A | |
| TANC1 | 115183 | 470074 | 21160 | N/A | |
| TANC1 | 115183 | 496406 | 21161 | N/A | |
| TAOK2 | 149930 | 308893 | 21162 | 310094 | 36909 |
| TAOK2 | 149930 | 543033 | 21163 | 440336 | 36910 |
| TAOK2 | 149930 | 279394 | 21164 | 279394 | 36911 |
| TAOK2 | 149930 | 416441 | 21165 | 393048 | 36912 |
| TAOK2 | 149930 | 566552 | 21166 | N/A | |
| TAOK2 | 149930 | 570844 | 21167 | N/A | |
| TAOK3 | 135090 | 419821 | 21168 | 416374 | 36913 |
| TAOK3 | 135090 | 392533 | 21169 | 376317 | 36914 |
| TAOK3 | 135090 | 543709 | 21170 | N/A | |
| TAOK3 | 135090 | 537305 | 21171 | N/A | |
| TAOK3 | 135090 | 536979 | 21172 | 441932 | 36915 |
| TAOK3 | 135090 | 537952 | 21173 | 443834 | 36916 |
| TAOK3 | 135090 | 537569 | 21174 | N/A | |
| TAOK3 | 135090 | 540561 | 21175 | 443487 | 36917 |
| TAOK3 | 135090 | 537822 | 21176 | 439620 | 36918 |
| TAOK3 | 135090 | 536584 | 21177 | N/A | |
| TAOK3 | 135090 | 538601 | 21178 | 437389 | 36919 |
| TAOK3 | 135090 | 535570 | 21179 | 443465 | 36920 |
| TAOK3 | 135090 | 541186 | 21180 | 438820 | 36921 |
| TAOK3 | 135090 | 541878 | 21181 | 444057 | 36922 |
| TAOK3 | 135090 | 542902 | 21182 | 440315 | 36923 |
| TAOK3 | 135090 | 542532 | 21183 | 441071 | 36924 |

-continued

| Symbol | ENSG | ENST | SEQ ID | ENSP | SEQ ID |
|---|---|---|---|---|---|
| TAOK3 | 135090 | 541786 | 21184 | 442541 | 36925 |
| TAOK3 | 135090 | 539872 | 21185 | 438766 | 36926 |
| TAOK3 | 135090 | 542692 | 21186 | N/A | |
| TBC1D1 | 065882 | 508802 | 21187 | 423651 | 36927 |
| TBC1D1 | 065882 | 261439 | 21188 | 261439 | 36928 |
| TBC1D1 | 065882 | 402522 | 21189 | 383994 | 36929 |
| TBC1D1 | 065882 | 446803 | 21190 | 396877 | 36930 |
| TBC1D1 | 065882 | 491553 | 21191 | N/A | |
| TBC1D1 | 065882 | 510573 | 21192 | 421641 | 36931 |
| TBC1D1 | 065882 | 513936 | 21193 | 425655 | 36932 |
| TBC1D1 | 065882 | 509761 | 21194 | N/A | |
| TBC1D1 | 065882 | 443855 | 21195 | 397610 | 36933 |
| TBC1D1 | 065882 | 421339 | 21196 | 410167 | 36934 |
| TBC1D1 | 065882 | 469803 | 21197 | N/A | |
| TBC1D1 | 065882 | 511238 | 21198 | N/A | |
| TBC1D1 | 065882 | 401554 | 21199 | N/A | |
| TBC1D1 | 065882 | 407365 | 21200 | N/A | |
| TBC1D1 | 065882 | 475531 | 21201 | N/A | |
| TBC1D1 | 065882 | 406664 | 21202 | N/A | |
| TBC1D1 | 065882 | 405444 | 21203 | N/A | |
| TBC1D1 | 065882 | 492180 | 21204 | N/A | |
| TBC1D1 | 065882 | 615497 | 21205 | 478039 | 36935 |
| TBC1D4 | 136111 | 377636 | 21206 | 366863 | 36936 |
| TBC1D4 | 136111 | 478591 | 21207 | N/A | |
| TBC1D4 | 136111 | 493487 | 21208 | N/A | |
| TBC1D4 | 136111 | 413735 | 21209 | 396932 | 36937 |
| TBC1D4 | 136111 | 488955 | 21210 | N/A | |
| TBC1D4 | 136111 | 377625 | 21211 | 366852 | 36938 |
| TBC1D4 | 136111 | 431480 | 21212 | 395986 | 36939 |
| TBC1D5 | 131374 | 253692 | 21213 | 253692 | 36940 |
| TBC1D5 | 131374 | 429383 | 21214 | 398127 | 36941 |
| TBC1D5 | 131374 | 414318 | 21215 | N/A | |
| TBC1D5 | 131374 | 446818 | 21216 | 402935 | 36942 |
| TBC1D5 | 131374 | 429924 | 21217 | 411925 | 36943 |
| TBC1D5 | 131374 | 465884 | 21218 | N/A | |
| TBC1D5 | 131374 | 415814 | 21219 | 396239 | 36944 |
| TBC1D5 | 131374 | 452492 | 21220 | 405886 | 36945 |
| TBC1D5 | 131374 | 412981 | 21221 | 414250 | 36946 |
| TBC1D5 | 131374 | 428355 | 21222 | 387395 | 36947 |
| TBC1D5 | 131374 | 425944 | 21223 | 399967 | 36948 |
| TBC1D5 | 131374 | 430169 | 21224 | 411780 | 36949 |
| TBC1D5 | 131374 | 445294 | 21225 | 410596 | 36950 |
| TBC1D5 | 131374 | 414349 | 21226 | 393882 | 36951 |
| TBC1D5 | 131374 | 443499 | 21227 | N/A | |
| TBC1D5 | 131374 | 443386 | 21228 | N/A | |
| TBC1D5 | 131374 | 497531 | 21229 | N/A | |
| TBC1D5 | 131374 | 444756 | 21230 | N/A | |
| TBC1D5 | 131374 | 507877 | 21231 | 424998 | 36952 |
| TBC1D5 | 131374 | 446863 | 21232 | 415379 | 36953 |
| TBC1D5 | 131374 | 434420 | 21233 | 414159 | 36954 |
| TBC1D5 | 131374 | 486224 | 21234 | N/A | |
| TBC1D5 | 131374 | 444471 | 21235 | 396850 | 36955 |
| TBC1D5 | 131374 | 433533 | 21236 | 408603 | 36956 |
| TBC1D5 | 131374 | 481396 | 21237 | N/A | |
| TBC1D5 | 131374 | 480435 | 21238 | N/A | |
| TBC1D5 | 131374 | 423331 | 21239 | N/A | |
| TBC1D5 | 131374 | 485432 | 21240 | N/A | |
| TBC1D5 | 131374 | 473612 | 21241 | N/A | |
| TBC1D5 | 131374 | 471679 | 21242 | N/A | |
| TBCEL | 154114 | 529397 | 21243 | 437184 | 36957 |
| TBCEL | 154114 | 284259 | 21244 | 284259 | 36958 |
| TBCEL | 154114 | 528512 | 21245 | 431803 | 36959 |
| TBCEL | 154114 | 531148 | 21246 | 433365 | 36960 |
| TBCEL | 154114 | 422003 | 21247 | 403925 | 36961 |
| TBCEL | 154114 | 533712 | 21248 | 431156 | 36962 |
| TBCEL | 154114 | 524726 | 21249 | 432783 | 36963 |
| TBCEL | 154114 | 530362 | 21250 | N/A | |
| TBCEL | 154114 | 533134 | 21251 | 436419 | 36964 |
| TBCEL | 154114 | 533169 | 21252 | N/A | |
| TBL1X | 101849 | 441088 | 21253 | 402923 | 36965 |
| TBL1X | 101849 | 380961 | 21254 | 370348 | 36966 |
| TBL1X | 101849 | 415293 | 21255 | 407069 | 36967 |
| TBL1X | 101849 | 217964 | 21256 | 217964 | 36968 |
| TBL1X | 101849 | 422314 | 21257 | 415508 | 36969 |
| TBL1X | 101849 | 452824 | 21258 | 397878 | 36970 |
| TBL1X | 101849 | 497555 | 21259 | N/A | |

-continued

-continued

| Symbol | ENSG | ENST | SEQ ID | ENSP | SEQ ID |
|---|---|---|---|---|---|
| TBL1X | 101849 | 424279 | 21260 | 394097 | 36971 |
| TBL1X | 101849 | 407597 | 21261 | 385988 | 36972 |
| TBR1 | 136535 | 389554 | 21262 | 374205 | 36973 |
| TBR1 | 136535 | 463544 | 21263 | N/A | |
| TBR1 | 136535 | 411412 | 21264 | 393934 | 36974 |
| TBR1 | 136535 | 410035 | 21265 | 387023 | 36975 |
| TBR1 | 136535 | 477804 | 21266 | N/A | |
| TBR1 | 136535 | 489530 | 21267 | N/A | |
| TBXAS1 | 059377 | 493340 | 21268 | N/A | |
| TBXAS1 | 059377 | 462053 | 21269 | N/A | |
| TBXAS1 | 059377 | 473948 | 21270 | N/A | |
| TBXAS1 | 059377 | 425687 | 21271 | 388736 | 36976 |
| TBXAS1 | 059377 | 474763 | 21272 | N/A | |
| TBXAS1 | 059377 | 481440 | 21273 | N/A | |
| TBXAS1 | 059377 | 438104 | 21274 | 388612 | 36977 |
| TBXAS1 | 059377 | 336425 | 21275 | 338087 | 36978 |
| TBXAS1 | 059377 | 448866 | 21276 | 402536 | 36979 |
| TBXAS1 | 059377 | 422328 | 21277 | 415892 | 36980 |
| TBXAS1 | 059377 | 492560 | 21278 | N/A | |
| TBXAS1 | 059377 | 455353 | 21279 | 391567 | 36981 |
| TBXAS1 | 059377 | 458722 | 21280 | 411274 | 36982 |
| TBXAS1 | 059377 | 411653 | 21281 | 411326 | 36983 |
| TBXAS1 | 059377 | 476637 | 21282 | N/A | |
| TBXAS1 | 059377 | 462275 | 21283 | N/A | |
| TBXAS1 | 059377 | 414041 | 21284 | 412710 | 36984 |
| TBXAS1 | 059377 | 469630 | 21285 | N/A | |
| TBXAS1 | 059377 | 494876 | 21286 | N/A | |
| TBXAS1 | 059377 | 416849 | 21287 | 389414 | 36985 |
| TCEAL2 | 184905 | 476749 | 21288 | N/A | |
| TCEAL2 | 184905 | 329035 | 21289 | 332359 | 36986 |
| TCEAL2 | 184905 | 372780 | 21290 | 361866 | 36987 |
| TCEAL5 | 204065 | 372680 | 21291 | 361765 | 36988 |
| TCEAL6 | 204071 | 372774 | 21292 | 361860 | 36989 |
| TCEAL6 | 204071 | 372773 | 21293 | 361859 | 36990 |
| TCEAL7 | 182916 | 332431 | 21294 | 329794 | 36991 |
| TCEAL7 | 182916 | 372666 | 21295 | 361751 | 36992 |
| TCEAL9 | 185222 | 372661 | 21296 | 361745 | 36993 |
| TCEAL9 | 185222 | 372656 | 21297 | 361740 | 36994 |
| TCERG1L | 176769 | 483040 | 21298 | N/A | |
| TCERG1L | 176769 | 368642 | 21299 | 357631 | 36995 |
| TCF7L1 | 152284 | 282111 | 21300 | 282111 | 36996 |
| TCF7L1 | 152284 | 494519 | 21301 | N/A | |
| TCF7L1 | 152284 | 442813 | 21302 | 388984 | 36997 |
| TCF7L1 | 152284 | 490744 | 21303 | N/A | |
| TCP1 | 120438 | 321394 | 21304 | 317334 | 36998 |
| TCP1 | 120438 | 544255 | 21305 | 439447 | 36999 |
| TCP1 | 120438 | 420894 | 21306 | 390159 | 37000 |
| TCP1 | 120438 | 392168 | 21307 | 376008 | 37001 |
| TCP1 | 120438 | 546204 | 21308 | N/A | |
| TCP1 | 120438 | 539756 | 21309 | 441345 | 37002 |
| TCP1 | 120438 | 536807 | 21310 | N/A | |
| TCP1 | 120438 | 538530 | 21311 | 440617 | 37003 |
| TCP1 | 120438 | 543532 | 21312 | N/A | |
| TCP1 | 120438 | 467544 | 21313 | N/A | |
| TCP1 | 120438 | 538128 | 21314 | 442185 | 37004 |
| TCP1 | 120438 | 543517 | 21315 | 444423 | 37005 |
| TCP1 | 120438 | 539948 | 21316 | 439671 | 37006 |
| TCP1 | 120438 | 545764 | 21317 | N/A | |
| TCP1 | 120438 | 537390 | 21318 | 437840 | 37007 |
| TCP1 | 120438 | 536394 | 21319 | 442856 | 37008 |
| TCP1 | 120438 | 536607 | 21320 | N/A | |
| TCP1 | 120438 | 546023 | 21321 | N/A | |
| TCP11L2 | 166046 | 553143 | 21322 | 447416 | 37009 |
| TCP11L2 | 166046 | 547153 | 21323 | 448952 | 37010 |
| TCP11L2 | 166046 | 299045 | 21324 | 299045 | 37011 |
| TCP11L2 | 166046 | 546625 | 21325 | 449123 | 37012 |
| TCP11L2 | 166046 | 553098 | 21326 | 448629 | 37013 |
| TCP11L2 | 166046 | 549906 | 21327 | 448064 | 37014 |
| TCP11L2 | 166046 | 551802 | 21328 | 447174 | 37015 |
| TCP11L2 | 166046 | 548428 | 21329 | 447457 | 37016 |
| TCP11L2 | 166046 | 551228 | 21330 | 449844 | 37017 |
| TCP11L2 | 166046 | 552690 | 21331 | N/A | |
| TCTE1 | 146221 | 371505 | 21332 | 360560 | 37018 |
| TCTE1 | 146221 | 371504 | 21333 | 360559 | 37019 |
| TCTEX1D1 | 152760 | 525663 | 21334 | N/A | |
| TCTEX1D1 | 152760 | 282670 | 21335 | 282670 | 37020 |

| Symbol | ENSG | ENST | SEQ ID | ENSP | SEQ ID |
|---|---|---|---|---|---|
| TCTEX1D1 | 152760 | 528352 | 21336 | 436731 | 37021 |
| TCTEX1D1 | 152760 | 491611 | 21337 | N/A | |
| TCTEX1D1 | 152760 | 448074 | 21338 | N/A | |
| TCTEX1D1 | 152760 | 489510 | 21339 | N/A | |
| TDP1 | 042088 | 554976 | 21340 | 452042 | 37022 |
| TDP1 | 042088 | 393452 | 21341 | 377098 | 37023 |
| TDP1 | 042088 | 554180 | 21342 | 450872 | 37024 |
| TDP1 | 042088 | 393454 | 21343 | 377099 | 37025 |
| TDP1 | 042088 | 553617 | 21344 | 450708 | 37026 |
| TDP1 | 042088 | 335725 | 21345 | 337353 | 37027 |
| TDP1 | 042088 | 555565 | 21346 | N/A | |
| TDP1 | 042088 | 556867 | 21347 | 452279 | 37028 |
| TDP1 | 042088 | 553569 | 21348 | N/A | |
| TDP1 | 042088 | 553527 | 21349 | 451358 | 37029 |
| TDP1 | 042088 | 553989 | 21350 | 452333 | 37030 |
| TDP1 | 042088 | 545686 | 21351 | 444587 | 37031 |
| TDP1 | 042088 | 555178 | 21352 | 452363 | 37032 |
| TDP1 | 042088 | 556498 | 21353 | 452183 | 37033 |
| TDP1 | 042088 | 555880 | 21354 | 450628 | 37034 |
| TDP1 | 042088 | 557782 | 21355 | 451767 | 37035 |
| TDP1 | 042088 | 556063 | 21356 | 450795 | 37036 |
| TEAD1 | 187079 | 527636 | 21357 | 435233 | 37037 |
| TEAD1 | 187079 | 527376 | 21358 | 432587 | 37038 |
| TEAD1 | 187079 | 527575 | 21359 | 435977 | 37039 |
| TEAD1 | 187079 | 525312 | 21360 | N/A | |
| TEAD1 | 187079 | 526600 | 21361 | 435393 | 37040 |
| TEAD1 | 187079 | 638666 | 21362 | 491500 | 37041 |
| TEAD1 | 187079 | 334310 | 21363 | 334754 | 37042 |
| TEAD4 | 197905 | 358409 | 21364 | 351184 | 37043 |
| TEAD4 | 197905 | 540314 | 21365 | 438960 | 37044 |
| TEAD4 | 197905 | 536826 | 21366 | 438453 | 37045 |
| TEAD4 | 197905 | 359864 | 21367 | 352926 | 37046 |
| TEAD4 | 197905 | 543035 | 21368 | 444528 | 37047 |
| TEAD4 | 197905 | 397122 | 21369 | 380311 | 37048 |
| TEAD4 | 197905 | 443986 | 21370 | 411475 | 37049 |
| TEAD4 | 197905 | 544666 | 21371 | 441959 | 37050 |
| TEC | 135605 | 381501 | 21372 | 370912 | 37051 |
| TEC | 135605 | 505452 | 21373 | 424567 | 37052 |
| TEC | 135605 | 515146 | 21374 | 424365 | 37053 |
| TEC | 135605 | 511150 | 21375 | N/A | |
| TEC | 135605 | 511471 | 21376 | N/A | |
| TEK | 120156 | 519097 | 21377 | 430686 | 37054 |
| TEK | 120156 | 380036 | 21378 | 369375 | 37055 |
| TEK | 120156 | 406359 | 21379 | 383977 | 37056 |
| TEK | 120156 | 519080 | 21380 | 428337 | 37057 |
| TEK | 120156 | 615002 | 21381 | 480251 | 37058 |
| TES | 135269 | 358204 | 21382 | 350937 | 37059 |
| TES | 135269 | 461440 | 21383 | N/A | |
| TES | 135269 | 455989 | 21384 | 413002 | 37060 |
| TES | 135269 | 492891 | 21385 | 420220 | 37061 |
| TES | 135269 | 496871 | 21386 | N/A | |
| TES | 135269 | 393481 | 21387 | 377121 | 37062 |
| TES | 135269 | 485009 | 21388 | N/A | |
| TES | 135269 | 393484 | 21389 | 377124 | 37063 |
| TES | 135269 | 494384 | 21390 | N/A | |
| TES | 135269 | 496912 | 21391 | N/A | |
| TES | 135269 | 463746 | 21392 | N/A | |
| TESC | 088992 | 470612 | 21393 | 432716 | 37064 |
| TESC | 088992 | 335209 | 21394 | 334785 | 37065 |
| TESC | 088992 | 549210 | 21395 | 450386 | 37066 |
| TESC | 088992 | 462502 | 21396 | 432608 | 37067 |
| TESC | 088992 | 535198 | 21397 | N/A | |
| TESC | 088992 | 482176 | 21398 | N/A | |
| TESC | 088992 | 552139 | 21399 | N/A | |
| TESC | 088992 | 541210 | 21400 | 445689 | 37068 |
| TEX14 | 121101 | 389934 | 21401 | 374584 | 37069 |
| TEX14 | 121101 | 584699 | 21402 | N/A | |
| TEX14 | 121101 | 240361 | 21403 | 240361 | 37070 |
| TEX14 | 121101 | 349033 | 21404 | 268910 | 37071 |
| TEX14 | 121101 | 582740 | 21405 | 463593 | 37072 |
| TEX14 | 121101 | 581147 | 21406 | 463243 | 37073 |
| TEX2 | 136478 | 258991 | 21407 | 258991 | 37074 |
| TEX2 | 136478 | 584498 | 21408 | N/A | |
| TEX2 | 136478 | 583097 | 21409 | 462665 | 37075 |
| TEX2 | 136478 | 584379 | 21410 | 463001 | 37076 |
| TEX2 | 136478 | 583501 | 21411 | 462230 | 37077 |

-continued

| Symbol | ENSG | ENST | SEQ ID | ENSP | SEQ ID |
|---|---|---|---|---|---|
| TEX2 | 136478 | 581812 | 21412 | N/A | |
| TEX2 | 136478 | 577489 | 21413 | N/A | |
| TEX2 | 136478 | 583922 | 21414 | 463286 | 37078 |
| TEX2 | 136478 | 583738 | 21415 | 462210 | 37079 |
| TEX2 | 136478 | 615733 | 21416 | 479308 | 37080 |
| TEX36 | 175018 | 532135 | 21417 | 431764 | 37081 |
| TEX36 | 175018 | 526819 | 21418 | 434299 | 37082 |
| TEX36 | 175018 | 368821 | 21419 | 357811 | 37083 |
| TEX9 | 151575 | 560827 | 21420 | 452791 | 37084 |
| TEX9 | 151575 | 352903 | 21421 | 342169 | 37085 |
| TEX9 | 151575 | 537232 | 21422 | 438745 | 37086 |
| TEX9 | 151575 | 561221 | 21423 | 456593 | 37087 |
| TEX9 | 151575 | 558127 | 21424 | 453431 | 37088 |
| TEX9 | 151575 | 558083 | 21425 | 453398 | 37089 |
| TEX9 | 151575 | 559142 | 21426 | N/A | |
| TEX9 | 151575 | 559546 | 21427 | N/A | |
| TEX9 | 151575 | 560582 | 21428 | 453960 | 37090 |
| TFAP2A | 137203 | 461628 | 21429 | 417735 | 37091 |
| TFAP2A | 137203 | 379613 | 21430 | 368933 | 37092 |
| TFAP2A | 137203 | 489805 | 21431 | 420568 | 37093 |
| TFAP2A | 137203 | 319516 | 21432 | 316516 | 37094 |
| TFAP2A | 137203 | 379608 | 21433 | 368928 | 37095 |
| TFAP2A | 137203 | 488193 | 21434 | 419823 | 37096 |
| TFAP2A | 137203 | 482890 | 21435 | 418541 | 37097 |
| TFAP2A | 137203 | 466073 | 21436 | 417495 | 37098 |
| TFAP2A | 137203 | 497266 | 21437 | N/A | |
| TFAP2A | 137203 | 475264 | 21438 | 419696 | 37099 |
| TFAP2A | 137203 | 478375 | 21439 | N/A | |
| TFAP2A | 137203 | 498450 | 21440 | 419961 | 37100 |
| TFAP2A | 137203 | 490875 | 21441 | N/A | |
| TFAP2A | 137203 | 473652 | 21442 | N/A | |
| TFAP2A | 137203 | 474952 | 21443 | N/A | |
| TFAP2A | 137203 | 462727 | 21444 | N/A | |
| TFAP2A | 137203 | 464323 | 21445 | N/A | |
| TFAP2A | 137203 | 465858 | 21446 | 418391 | 37101 |
| TFAP2A | 137203 | 486038 | 21447 | N/A | |
| TFAP2B | 008196 | 344788 | 21448 | 342252 | 37102 |
| TFAP2B | 008196 | 393655 | 21449 | 377265 | 37103 |
| TFAP2B | 008196 | 489228 | 21450 | N/A | |
| TFRC | 072274 | 426789 | 21451 | 414015 | 37104 |
| TFRC | 072274 | 420415 | 21452 | 390133 | 37105 |
| TFRC | 072274 | 360110 | 21453 | 353224 | 37106 |
| TFRC | 072274 | 392396 | 21454 | 376197 | 37107 |
| TFRC | 072274 | 463047 | 21455 | N/A | |
| TFRC | 072274 | 475593 | 21456 | N/A | |
| TFRC | 072274 | 483983 | 21457 | N/A | |
| TFRC | 072274 | 463356 | 21458 | N/A | |
| TFRC | 072274 | 482479 | 21459 | N/A | |
| TFRC | 072274 | 465288 | 21460 | N/A | |
| TFRC | 072274 | 477148 | 21461 | N/A | |
| TFRC | 072274 | 464368 | 21462 | N/A | |
| TFRC | 072274 | 491658 | 21463 | N/A | |
| TFRC | 072274 | 421258 | 21464 | 402839 | 37108 |
| TFRC | 072274 | 464011 | 21465 | N/A | |
| TG | 042832 | 523901 | 21466 | 427871 | 37109 |
| TG | 042832 | 220616 | 21467 | 220616 | 37110 |
| TG | 042832 | 520769 | 21468 | N/A | |
| TG | 042832 | 523756 | 21469 | 428628 | 37111 |
| TG | 042832 | 518097 | 21470 | N/A | |
| TG | 042832 | 518505 | 21471 | 429605 | 37112 |
| TG | 042832 | 519178 | 21472 | 430523 | 37113 |
| TG | 042832 | 518058 | 21473 | 429164 | 37114 |
| TG | 042832 | 519543 | 21474 | 430430 | 37115 |
| TG | 042832 | 520197 | 21475 | N/A | |
| TG | 042832 | 520089 | 21476 | N/A | |
| TG | 042832 | 519294 | 21477 | N/A | |
| TG | 042832 | 524151 | 21478 | N/A | |
| TG | 042832 | 522523 | 21479 | N/A | |
| TG | 042832 | 522797 | 21480 | 430087 | 37116 |
| TG | 042832 | 518108 | 21481 | 429761 | 37117 |
| TG | 042832 | 522996 | 21482 | N/A | |
| TG | 042832 | 522809 | 21483 | N/A | |
| TG | 042832 | 521107 | 21484 | 430161 | 37118 |
| TG | 042832 | 522691 | 21485 | N/A | |
| TGFB2 | 092969 | 366930 | 21486 | 355897 | 37119 |
| TGFB2 | 092969 | 366929 | 21487 | 355896 | 37120 |

-continued

| Symbol | ENSG | ENST | SEQ ID | ENSP | SEQ ID |
|---|---|---|---|---|---|
| TGFB2 | 092969 | 488793 | 21488 | N/A | |
| TGFB2 | 092969 | 479322 | 21489 | N/A | |
| TGFB3 | 119699 | 556507 | 21490 | N/A | |
| TGFB3 | 119699 | 557493 | 21491 | N/A | |
| TGFB3 | 119699 | 556285 | 21492 | 451110 | 37121 |
| TGFB3 | 119699 | 555193 | 21493 | N/A | |
| TGFB3 | 119699 | 556674 | 21494 | N/A | |
| TGFB3 | 119699 | 238682 | 21495 | 238682 | 37122 |
| TGFB3 | 119699 | 554980 | 21496 | N/A | |
| TGFBR2 | 163513 | 295754 | 21497 | 295754 | 37123 |
| TGFBR2 | 163513 | 359013 | 21498 | 351905 | 37124 |
| TH | 180176 | 381178 | 21499 | 370571 | 37125 |
| TH | 180176 | 381175 | 21500 | 370567 | 37126 |
| TH | 180176 | 352909 | 21501 | 325951 | 37127 |
| TH | 180176 | 324155 | 21502 | 325831 | 37128 |
| TH | 180176 | 479437 | 21503 | N/A | |
| TH | 180176 | 416223 | 21504 | 403440 | 37129 |
| TH | 180176 | 412076 | 21505 | 403546 | 37130 |
| TH | 180176 | 461172 | 21506 | N/A | |
| TH | 180176 | 381168 | 21507 | 370560 | 37131 |
| TH | 180176 | 469226 | 21508 | N/A | |
| TH | 180176 | 333684 | 21509 | 328814 | 37132 |
| THBS2 | 186340 | 366787 | 21510 | 355751 | 37133 |
| THBS2 | 186340 | 488355 | 21511 | N/A | |
| THBS2 | 186340 | 461848 | 21512 | N/A | |
| THBS2 | 186340 | 472733 | 21513 | N/A | |
| THBS2 | 186340 | 435791 | 21514 | 398928 | 37134 |
| THBS2 | 186340 | 617924 | 21515 | 482784 | 37135 |
| THBS4 | 113296 | 513310 | 21516 | N/A | |
| THBS4 | 113296 | 510218 | 21517 | N/A | |
| THBS4 | 113296 | 350881 | 21518 | 339730 | 37136 |
| THBS4 | 113296 | 511733 | 21519 | 422298 | 37137 |
| THBS4 | 113296 | 515510 | 21520 | N/A | |
| THBS4 | 113296 | 504720 | 21521 | N/A | |
| THBS4 | 113296 | 511888 | 21522 | N/A | |
| THSD7B | 144229 | 472720 | 21523 | 473349 | 37138 |
| THSD7B | 144229 | 409968 | 21524 | 387145 | 37139 |
| THSD7B | 144229 | 485379 | 21525 | N/A | |
| THSD7B | 144229 | 480352 | 21526 | N/A | |
| THSD7B | 144229 | 413152 | 21527 | 413841 | 37140 |
| THSD7B | 144229 | 272643 | 21528 | 272643 | 37141 |
| THYN1 | 151500 | 392595 | 21529 | 376374 | 37142 |
| THYN1 | 151500 | 341541 | 21530 | 341657 | 37143 |
| THYN1 | 151500 | 392594 | 21531 | 376373 | 37144 |
| THYN1 | 151500 | 352327 | 21532 | 341452 | 37145 |
| THYN1 | 151500 | 531135 | 21533 | N/A | |
| THYN1 | 151500 | 533975 | 21534 | N/A | |
| THYN1 | 151500 | 533781 | 21535 | N/A | |
| THYN1 | 151500 | 525677 | 21536 | N/A | |
| TIMP3 | 100234 | 266085 | 21537 | 266085 | 37146 |
| TIPARP | 163659 | 486483 | 21538 | 418757 | 37147 |
| TIPARP | 163659 | 295924 | 21539 | 295924 | 37148 |
| TIPARP | 163659 | 461166 | 21540 | 420612 | 37149 |
| TIPARP | 163659 | 473702 | 21541 | 419982 | 37150 |
| TIPARP | 163659 | 481853 | 21542 | 418829 | 37151 |
| TIPARP | 163659 | 495891 | 21543 | 420141 | 37152 |
| TIPARP | 163659 | 542783 | 21544 | 438345 | 37153 |
| TLCD1 | 160606 | 292090 | 21545 | 292090 | 37154 |
| TLCD1 | 160606 | 581236 | 21546 | 468670 | 37155 |
| TLCD1 | 160606 | 394933 | 21547 | 378391 | 37156 |
| TLCD1 | 160606 | 580518 | 21548 | 466264 | 37157 |
| TLE4 | 106829 | 376552 | 21549 | 365735 | 37158 |
| TLE4 | 106829 | 461758 | 21550 | 417906 | 37159 |
| TLE4 | 106829 | 470872 | 21551 | 417245 | 37160 |
| TLE4 | 106829 | 435650 | 21552 | 415423 | 37161 |
| TLE4 | 106829 | 414465 | 21553 | 397822 | 37162 |
| TLE4 | 106829 | 376537 | 21554 | 365720 | 37163 |
| TLE4 | 106829 | 462803 | 21555 | 417715 | 37164 |
| TLE4 | 106829 | 376524 | 21556 | N/A | |
| TLE4 | 106829 | 476523 | 21557 | N/A | |
| TLE4 | 106829 | 376525 | 21558 | N/A | |
| TLE4 | 106829 | 265284 | 21559 | 265284 | 37165 |
| TLE4 | 106829 | 425506 | 21560 | 412567 | 37166 |
| TLE4 | 106829 | 485159 | 21561 | N/A | |
| TLE4 | 106829 | 466428 | 21562 | N/A | |
| TLE4 | 106829 | 428713 | 21563 | 409313 | 37167 |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| TLE4 | 106829 | 455913 | 21564 | N/A | | 5 | TMEM108 | 144868 | 514529 | 21640 | N/A | |
| TLE4 | 106829 | 496853 | 21565 | N/A | | | TMEM108 | 144868 | 321871 | 21641 | 324651 | 37206 |
| TLE4 | 106829 | 474519 | 21566 | N/A | | | TMEM108 | 144868 | 393130 | 21642 | 376838 | 37207 |
| TLE4 | 106829 | 483597 | 21567 | N/A | | | TMEM108 | 144868 | 514894 | 21643 | 422072 | 37208 |
| TLE4 | 106829 | 490347 | 21568 | 417844 | 37168 | | TMEM108 | 144868 | 512662 | 21644 | 427447 | 37209 |
| TLE4 | 106829 | 493163 | 21569 | N/A | | | TMEM108 | 144868 | 512137 | 21645 | 426301 | 37210 |
| TLE4 | 106829 | 463431 | 21570 | N/A | | 10 | TMEM108 | 144868 | 511555 | 21646 | 422196 | 37211 |
| TLE4 | 106829 | 495170 | 21571 | N/A | | | TMEM108 | 144868 | 508711 | 21647 | 424897 | 37212 |
| TLE4 | 106829 | 467142 | 21572 | 418409 | 37169 | | TMEM108 | 144868 | 515826 | 21648 | 423338 | 37213 |
| TLE4 | 106829 | 496114 | 21573 | 417102 | 37170 | | TMEM108 | 144868 | 510183 | 21649 | 421486 | 37214 |
| TLE4 | 106829 | 417836 | 21574 | 400334 | 37171 | | TMEM108 | 144868 | 511388 | 21650 | N/A | |
| TLE4 | 106829 | 478290 | 21575 | N/A | | | TMEM123 | 152558 | 361236 | 21651 | 355285 | 37215 |
| TLE4 | 106829 | 376544 | 21576 | 365727 | 37172 | 15 | TMEM123 | 152558 | 398136 | 21652 | 381204 | 37216 |
| TLE6 | 104953 | 246112 | 21577 | 246112 | 37173 | | TMEM123 | 152558 | 532161 | 21653 | 435331 | 37217 |
| TLE6 | 104953 | 453329 | 21578 | 411783 | 37174 | | TMEM123 | 152558 | 528969 | 21654 | 434976 | 37218 |
| TLE6 | 104953 | 482627 | 21579 | 467126 | 37175 | | TMEM123 | 152558 | 529492 | 21655 | N/A | |
| TLE6 | 104953 | 468176 | 21580 | N/A | | | TMEM123 | 152558 | 525577 | 21656 | N/A | |
| TLE6 | 104953 | 452088 | 21581 | 406893 | 37176 | | TMEM123 | 152558 | 531103 | 21657 | 433695 | 37219 |
| TLE6 | 104953 | 591953 | 21582 | N/A | | 20 | TMEM123 | 152558 | 526676 | 21658 | 435842 | 37220 |
| TLE6 | 104953 | 478073 | 21583 | N/A | | | TMEM125 | 179178 | 439858 | 21659 | 429775 | 37221 |
| TLE6 | 104953 | 474207 | 21584 | N/A | | | TMEM125 | 179178 | 432792 | 21660 | 429275 | 37222 |
| TLE6 | 104953 | 497878 | 21585 | N/A | | | TMEM125 | 179178 | 442284 | 21661 | N/A | |
| TLE6 | 104953 | 469572 | 21586 | N/A | | | TMEM125 | 179178 | 456751 | 21662 | 428627 | 37223 |
| TLL1 | 038295 | 061240 | 21587 | 061240 | 37177 | | TMEM130 | 166448 | 416379 | 21663 | 413163 | 37224 |
| TLL1 | 038295 | 509505 | 21588 | 422692 | 37178 | | TMEM130 | 166448 | 339375 | 21664 | 341256 | 37225 |
| TLL1 | 038295 | 507499 | 21589 | 426082 | 37179 | 25 | TMEM130 | 166448 | 450876 | 21665 | 390200 | 37226 |
| TLL1 | 038295 | 504560 | 21590 | 421732 | 37180 | | TMEM130 | 166448 | 474857 | 21666 | N/A | |
| TLL1 | 038295 | 513213 | 21591 | 422937 | 37181 | | TMEM130 | 166448 | 345589 | 21667 | 330262 | 37227 |
| TLL1 | 038295 | 506144 | 21592 | 423748 | 37182 | | TMEM130 | 166448 | 461092 | 21668 | N/A | |
| TLR3 | 164342 | 296795 | 21593 | 296795 | 37183 | | TMEM130 | 166448 | 486839 | 21669 | N/A | |
| TLR3 | 164342 | 513189 | 21594 | 423386 | 37184 | | TMEM130 | 166448 | 445790 | 21670 | 389379 | 37228 |
| TLR3 | 164342 | 512264 | 21595 | N/A | | 30 | TMEM132B | 139364 | 418253 | 21671 | N/A | |
| TLR3 | 164342 | 504367 | 21596 | 423684 | 37185 | | TMEM132B | 139364 | 535330 | 21672 | N/A | |
| TLR3 | 164342 | 508051 | 21597 | N/A | | | TMEM132B | 139364 | 299308 | 21673 | 299308 | 37229 |
| TLR4 | 136869 | 394487 | 21598 | 377997 | 37186 | | TMEM132B | 139364 | 534945 | 21674 | N/A | |
| TLR4 | 136869 | 355622 | 21599 | 363089 | 37187 | | TMEM132B | 139364 | 535886 | 21675 | N/A | |
| TLR4 | 136869 | 472304 | 21600 | N/A | | | TMEM132B | 139364 | 613307 | 21676 | 482788 | 37230 |
| TLR4 | 136869 | 490685 | 21601 | N/A | | 35 | TMEM132C | 181234 | 435159 | 21677 | 410852 | 37231 |
| TM2D2 | 169490 | 456845 | 21602 | 391674 | 37188 | | TMEM132D | 151952 | 389441 | 21678 | 374092 | 37232 |
| TM2D2 | 169490 | 456397 | 21603 | 416050 | 37189 | | TMEM132D | 151952 | 422113 | 21679 | 408581 | 37233 |
| TM2D2 | 169490 | 397070 | 21604 | 380260 | 37190 | | TMEM132E | 181291 | 321639 | 21680 | 316532 | 37234 |
| TM2D2 | 169490 | 522434 | 21605 | N/A | | | TMEM132E | 181291 | 631683 | 21681 | 487800 | 37235 |
| TM2D2 | 169490 | 522142 | 21606 | 428394 | 37191 | | TMEM132E | 181291 | 577271 | 21682 | N/A | |
| TM2D2 | 169490 | 521060 | 21607 | N/A | | 40 | TMEM144 | 164124 | 505049 | 21683 | 425266 | 37236 |
| TM2D2 | 169490 | 524331 | 21608 | N/A | | | TMEM144 | 164124 | 505189 | 21684 | 421289 | 37237 |
| TM2D2 | 169490 | 519186 | 21609 | N/A | | | TMEM144 | 164124 | 511038 | 21685 | 422255 | 37238 |
| TM2D2 | 169490 | 517872 | 21610 | 430685 | 37192 | | TMEM144 | 164124 | 508243 | 21686 | 422297 | 37239 |
| TM2D2 | 169490 | 520152 | 21611 | 428203 | 37193 | | TMEM144 | 164124 | 296529 | 21687 | 296529 | 37240 |
| TM4SF1 | 169908 | 305366 | 21612 | 304277 | 37194 | | TMEM144 | 164124 | 512481 | 21688 | 424659 | 37241 |
| TM4SF1 | 169908 | 472441 | 21613 | 417084 | 37195 | | TMEM144 | 164124 | 504569 | 21689 | 422082 | 37242 |
| TM4SF1 | 169908 | 493348 | 21614 | 419426 | 37196 | 45 | TMEM144 | 164124 | 509278 | 21690 | 425815 | 37243 |
| TM4SF1 | 169908 | 493298 | 21615 | 418057 | 37197 | | TMEM144 | 164124 | 514558 | 21691 | 426211 | 37244 |
| TMC1 | 165091 | 297784 | 21616 | 297784 | 37198 | | TMEM144 | 164124 | 513744 | 21692 | N/A | |
| TMC1 | 165091 | 497073 | 21617 | N/A | | | TMEM144 | 164124 | 514346 | 21693 | N/A | |
| TMC1 | 165091 | 492418 | 21618 | N/A | | | TMEM144 | 164124 | 503200 | 21694 | 420990 | 37245 |
| TMC1 | 165091 | 486417 | 21619 | N/A | | 50 | TMEM144 | 164124 | 511532 | 21695 | 420930 | 37246 |
| TMC1 | 165091 | 469455 | 21620 | N/A | | | TMEM144 | 164124 | 502698 | 21696 | 425907 | 37247 |
| TMC1 | 165091 | 340019 | 21621 | 341433 | 37199 | | TMEM144 | 164124 | 514971 | 21697 | 422899 | 37248 |
| TMC3-AS1 | 259343 | 559781 | 21622 | N/A | | | TMEM144 | 164124 | 503404 | 21698 | N/A | |
| TMC3-AS1 | 259343 | 560973 | 21623 | N/A | | | TMEM144 | 164124 | 512272 | 21699 | N/A | |
| TMC3-AS1 | 259343 | 560851 | 21624 | N/A | | | TMEM150C | 249242 | 515780 | 21700 | 420919 | 37249 |
| TMC3-AS1 | 259343 | 559277 | 21625 | N/A | | | TMEM150C | 249242 | 449862 | 21701 | 403438 | 37250 |
| TMC3-AS1 | 259343 | 612811 | 21626 | N/A | | 55 | TMEM150C | 249242 | 508701 | 21702 | 421812 | 37251 |
| TMC3-AS1 | 259343 | 558086 | 21627 | N/A | | | TMEM150C | 249242 | 454948 | 21703 | 414988 | 37252 |
| TMC3-AS1 | 259343 | 642113 | 21628 | N/A | | | TMEM163 | 152128 | 281924 | 21704 | 281924 | 37253 |
| TMC7 | 170537 | 569532 | 21629 | 455041 | 37200 | | TMEM163 | 152128 | 467316 | 21705 | N/A | |
| TMC7 | 170537 | 304381 | 21630 | 304710 | 37201 | | TMEM163 | 152128 | 476823 | 21706 | N/A | |
| TMC7 | 170537 | 568469 | 21631 | N/A | | | TMEM175 | 127419 | 507319 | 21707 | 424746 | 37254 |
| TMC7 | 170537 | 421369 | 21632 | 397081 | 37202 | 60 | TMEM175 | 127419 | 264771 | 21708 | 264771 | 37255 |
| TMC7 | 170537 | 561963 | 21633 | N/A | | | TMEM175 | 127419 | 513952 | 21709 | 427218 | 37256 |
| TMEM100 | 166292 | 424486 | 21634 | 395328 | 37203 | | TMEM175 | 127419 | 514453 | 21710 | 425181 | 37257 |
| TMEM100 | 166292 | 575734 | 21635 | 465638 | 37204 | | TMEM175 | 127419 | 505734 | 21711 | N/A | |
| TMEM100 | 166292 | 571679 | 21636 | 459290 | 37205 | | TMEM175 | 127419 | 515492 | 21712 | 425867 | 37258 |
| TMEM100 | 166292 | 575685 | 21637 | N/A | | | TMEM175 | 127419 | 504744 | 21713 | 423751 | 37259 |
| TMEM100 | 166292 | 570586 | 21638 | N/A | | 65 | TMEM175 | 127419 | 509508 | 21714 | 421750 | 37260 |
| TMEM100 | 166292 | 575806 | 21639 | N/A | | | TMEM175 | 127419 | 452360 | 21715 | N/A | |

-continued

-continued

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| TMEM175 | 127419 | 515876 | 21716 | N/A | | 5 | TMEM252 | 181778 | 377311 | 21792 | 366528 | 37312 |
| TMEM175 | 127419 | 513682 | 21717 | 427626 | 37261 | | TMEM254 | 133678 | 472622 | 21793 | N/A | |
| TMEM175 | 127419 | 515740 | 21718 | 427039 | 37262 | | TMEM254 | 133678 | 372281 | 21794 | 361355 | 37313 |
| TMEM175 | 127419 | 438836 | 21719 | N/A | | | TMEM254 | 133678 | 372275 | 21795 | 361349 | 37314 |
| TMEM175 | 127419 | 504505 | 21720 | N/A | | | TMEM254 | 133678 | 372274 | 21796 | 361348 | 37315 |
| TMEM175 | 127419 | 508204 | 21721 | 423669 | 37263 | 10 | TMEM254 | 133678 | 372273 | 21797 | 361347 | 37316 |
| TMEM175 | 127419 | 510493 | 21722 | 424208 | 37264 | | TMEM254 | 133678 | 467529 | 21798 | N/A | |
| TMEM175 | 127419 | 514546 | 21723 | 425763 | 37265 | | TMEM254 | 133678 | 463029 | 21799 | N/A | |
| TMEM175 | 127419 | 504850 | 21724 | N/A | | | TMEM254 | 133678 | 476173 | 21800 | N/A | |
| TMEM175 | 127419 | 504180 | 21725 | N/A | | | TMEM254 | 133678 | 483732 | 21801 | N/A | |
| TMEM175 | 127419 | 502513 | 21726 | N/A | | | TMEM254 | 133678 | 463209 | 21802 | N/A | |
| TMEM175 | 127419 | 506669 | 21727 | N/A | | | TMEM254 | 133678 | 450179 | 21803 | 393450 | 37317 |
| TMEM175 | 127419 | 622959 | 21728 | 485461 | 37266 | 15 | TMEM254 | 133678 | 613758 | 21804 | 482766 | 37318 |
| TMEM176A | 002933 | 484928 | 21729 | 417626 | 37267 | | TMEM254 | 133678 | 372277 | 21805 | 361351 | 37319 |
| TMEM176A | 002933 | 004103 | 21730 | 004103 | 37268 | | TMEM255A | 125355 | 309720 | 21806 | 310110 | 37320 |
| TMEM176A | 002933 | 494349 | 21731 | N/A | | | TMEM255A | 125355 | 371369 | 21807 | 360420 | 37321 |
| TMEM176A | 002933 | 475710 | 21732 | N/A | | | TMEM255A | 125355 | 371352 | 21808 | 360403 | 37322 |
| TMEM176A | 002933 | 461345 | 21733 | 420818 | 37269 | | TMEM255A | 125355 | 519908 | 21809 | 428013 | 37323 |
| TMEM176A | 002933 | 475536 | 21734 | 417834 | 37270 | 20 | TMEM255A | 125355 | 480821 | 21810 | N/A | |
| TMEM176A | 002933 | 468689 | 21735 | 420081 | 37271 | | TMEM255A | 125355 | 440464 | 21811 | 405781 | 37324 |
| TMEM176A | 002933 | 462826 | 21736 | N/A | | | TMEM255B | 282107 | 631591 | 21812 | 488630 | 37325 |
| TMEM176A | 002933 | 475007 | 21737 | N/A | | | TMEM255B | 282107 | 633279 | 21813 | 488348 | 37326 |
| TMEM176A | 002933 | 481305 | 21738 | N/A | | | TMEM255B | 184497 | 488362 | 21814 | 479391 | 37327 |
| TMEM176A | 002933 | 474166 | 21739 | N/A | | | TMEM255B | 184497 | 375353 | 21815 | 364502 | 37328 |
| TMEM176B | 106565 | 492607 | 21740 | 419258 | 37272 | 25 | TMEM255B | 184497 | 483678 | 21816 | N/A | |
| TMEM176B | 106565 | 326442 | 21741 | 318409 | 37273 | | TMEM255B | 184497 | 375348 | 21817 | N/A | |
| TMEM176B | 106565 | 447204 | 21742 | 410269 | 37274 | | TMEM255B | 184497 | 498692 | 21818 | N/A | |
| TMEM176B | 106565 | 429904 | 21743 | 397810 | 37275 | | TMEM255B | 184497 | 467169 | 21819 | N/A | |
| TMEM176B | 106565 | 450753 | 21744 | 404831 | 37276 | | TMEM266 | 169758 | 388942 | 21820 | 373594 | 37329 |
| TMEM176B | 106565 | 434545 | 21745 | 413531 | 37277 | | TMEM266 | 169758 | 484722 | 21821 | 435049 | 37330 |
| TMEM178A | 152154 | 437068 | 21746 | N/A | | | TMEM266 | 169758 | 559079 | 21822 | N/A | |
| TMEM178A | 152154 | 482239 | 21747 | N/A | | 30 | TMEM266 | 169758 | 561302 | 21823 | 453957 | 37331 |
| TMEM178A | 152154 | 281961 | 21748 | 281961 | 37278 | | TMEM266 | 169758 | 558249 | 21824 | N/A | |
| TMEM178A | 152154 | 413011 | 21749 | N/A | | | TMEM44 | 145014 | 392432 | 21825 | 376227 | 37332 |
| TMEM178A | 152154 | 495402 | 21750 | N/A | | | TMEM44 | 145014 | 432352 | 21826 | 409963 | 37333 |
| TMEM178A | 152154 | 618232 | 21751 | 477622 | 37279 | | TMEM44 | 145014 | 477651 | 21827 | N/A | |
| TMEM178B | 261115 | 565468 | 21752 | 456594 | 37280 | | TMEM44 | 145014 | 381975 | 21828 | 371402 | 37334 |
| TMEM178B | 261115 | 563442 | 21753 | N/A | | 35 | TMEM44 | 145014 | 347147 | 21829 | 333355 | 37335 |
| TMEM178B | 261115 | 610315 | 21754 | 484025 | 37281 | | TMEM44 | 145014 | 476750 | 21830 | N/A | |
| TMEM179 | 258986 | 415614 | 21755 | 397763 | 37282 | | TMEM44 | 145014 | 473092 | 21831 | 418674 | 37336 |
| TMEM179 | 258986 | 556320 | 21756 | 452113 | 37283 | | TMEM44 | 145014 | 452358 | 21832 | 414333 | 37337 |
| TMEM179 | 258986 | 556573 | 21757 | 450958 | 37284 | | TMEM44 | 145014 | 429560 | 21833 | 403053 | 37338 |
| TMEM179 | 258986 | 341595 | 21758 | 340477 | 37285 | | TMEM44 | 145014 | 419280 | 21834 | 414077 | 37339 |
| TMEM179 | 258986 | 615704 | 21759 | 483627 | 37286 | 40 | TMEM44 | 145014 | 467284 | 21835 | N/A | |
| TMEM179 | 258986 | 616017 | 21760 | 479740 | 37287 | | TMEM44 | 145014 | 494894 | 21836 | N/A | |
| TMEM179 | 276342 | 615269 | 21761 | 481424 | 37288 | | TMEM44 | 145014 | 330115 | 21837 | 328300 | 37340 |
| TMEM179 | 276342 | 625459 | 21762 | 486955 | 37289 | | TMEM44 | 145014 | 430601 | 21838 | 390186 | 37341 |
| TMEM179 | 276342 | 630378 | 21763 | 485891 | 37290 | | TMEM51 | 171729 | 376014 | 21839 | 365182 | 37342 |
| TMEM179 | 276342 | 625335 | 21764 | 487568 | 37291 | | TMEM51 | 171729 | 451326 | 21840 | 412298 | 37343 |
| TMEM179 | 276342 | 621393 | 21765 | 484829 | 37292 | 45 | TMEM51 | 171729 | 400796 | 21841 | 383600 | 37344 |
| TMEM179 | 276342 | 620158 | 21766 | 477614 | 37293 | | TMEM51 | 171729 | 434578 | 21842 | 409665 | 37345 |
| TMEM184C | 164168 | 296582 | 21767 | 296582 | 37294 | | TMEM51 | 171729 | 376008 | 21843 | 365176 | 37346 |
| TMEM184C | 164168 | 508208 | 21768 | 425940 | 37295 | | TMEM51 | 171729 | 428417 | 21844 | 394899 | 37347 |
| TMEM184C | 164168 | 505999 | 21769 | 421159 | 37296 | | TMEM63A | 196187 | 366835 | 21845 | 355800 | 37348 |
| TMEM184C | 164168 | 506826 | 21770 | N/A | | | TMEM63A | 196187 | 496025 | 21846 | N/A | |
| TMEM198 | 188760 | 344458 | 21771 | 343507 | 37297 | | TMEM63A | 196187 | 482753 | 21847 | N/A | |
| TMEM198 | 188760 | 421791 | 21772 | 388087 | 37298 | 50 | TMEM63A | 196187 | 487971 | 21848 | N/A | |
| TMEM198 | 188760 | 373883 | 21773 | 362990 | 37299 | | TMEM63A | 196187 | 474478 | 21849 | N/A | |
| TMEM198 | 188760 | 451952 | 21774 | 415186 | 37300 | | TMEM63A | 196187 | 483779 | 21850 | N/A | |
| TMEM2 | 135048 | 377044 | 21775 | 366243 | 37301 | | TMEM63A | 196187 | 436966 | 21851 | 409002 | 37349 |
| TMEM2 | 135048 | 377057 | 21776 | N/A | | | TMEM63A | 196187 | 487817 | 21852 | N/A | |
| TMEM2 | 135048 | 538669 | 21777 | N/A | | | TMEM63A | 196187 | 537914 | 21853 | 445237 | 37350 |
| TMEM2 | 135048 | 377066 | 21778 | 366266 | 37302 | 55 | TMEM88B | 205116 | 378821 | 21854 | 455099 | 37351 |
| TMEM2 | 135048 | 542935 | 21779 | 437750 | 37303 | | TMEM98 | 006042 | 394642 | 21855 | 378138 | 37352 |
| TMEM2 | 135048 | 396272 | 21780 | 379569 | 37304 | | TMEM98 | 006042 | 579849 | 21856 | 463245 | 37353 |
| TMEM2 | 135048 | 474495 | 21781 | N/A | | | TMEM98 | 006042 | 395149 | 21857 | 398446 | 37354 |
| TMEM2 | 135048 | 377055 | 21782 | 366254 | 37305 | | TMEM98 | 006042 | 261713 | 21858 | 261713 | 37355 |
| TMEM2 | 135048 | 377043 | 21783 | 366242 | 37306 | | TMEM98 | 006042 | 582227 | 21859 | N/A | |
| TMEM2 | 135048 | 537329 | 21784 | N/A | | 60 | TMEM98 | 006042 | 578289 | 21860 | 464537 | 37356 |
| TMEM2 | 135048 | 546219 | 21785 | N/A | | | TMEM98 | 006042 | 439138 | 21861 | 406394 | 37357 |
| TMEM2 | 135048 | 543165 | 21786 | N/A | | | TMEM98 | 006042 | 583437 | 21862 | 463539 | 37358 |
| TMEM2 | 135048 | 545719 | 21787 | 444571 | 37307 | | TMEM98 | 006042 | 583120 | 21863 | N/A | |
| TMEM200A | 164484 | 296978 | 21788 | 296978 | 37308 | | TMOD1 | 136842 | 259365 | 21864 | 259365 | 37359 |
| TMEM200A | 164484 | 392429 | 21789 | 376224 | 37309 | | TMOD1 | 136842 | 375175 | 21865 | 364318 | 37360 |
| TMEM200A | 164484 | 617887 | 21790 | 480294 | 37310 | 65 | TMOD1 | 136842 | 395211 | 21866 | 378637 | 37361 |
| TMEM200A | 164484 | 545622 | 21791 | 438928 | 37311 | | TMPRSS5 | 166682 | 536856 | 21867 | 437937 | 37362 |

-continued

| Symbol | ENSG | ENST | SEQ ID | ENSP | SEQ ID |
|---|---|---|---|---|---|
| TMPRSS5 | 166682 | 540540 | 21868 | 437761 | 37363 |
| TMPRSS5 | 166682 | 299882 | 21869 | 299882 | 37364 |
| TMPRSS5 | 166682 | 545579 | 21870 | 441104 | 37365 |
| TMPRSS5 | 166682 | 538955 | 21871 | 445528 | 37366 |
| TMPRSS5 | 166682 | 544634 | 21872 | 440783 | 37367 |
| TMPRSS5 | 166682 | 544476 | 21873 | 445930 | 37368 |
| TMPRSS5 | 166682 | 545265 | 21874 | N/A | |
| TMPRSS5 | 166682 | 545412 | 21875 | N/A | |
| TMPRSS5 | 166682 | 539732 | 21876 | 443681 | 37369 |
| TMPRSS5 | 166682 | 538770 | 21877 | 445502 | 37370 |
| TMPRSS5 | 166682 | 538091 | 21878 | 440976 | 37371 |
| TMTC1 | 133687 | 256062 | 21879 | 256062 | 37372 |
| TMTC1 | 133687 | 551659 | 21880 | 448112 | 37373 |
| TMTC1 | 133687 | 552618 | 21881 | 449043 | 37374 |
| TMTC1 | 133687 | 552925 | 21882 | N/A | |
| TMTC1 | 133687 | 319685 | 21883 | N/A | |
| TMTC1 | 133687 | 539277 | 21884 | 442016 | 37375 |
| TMTC1 | 133687 | 553189 | 21885 | N/A | |
| TMTC1 | 133687 | 550354 | 21886 | 449054 | 37376 |
| TMTC1 | 133687 | 546582 | 21887 | N/A | |
| TMTC4 | 125247 | 376234 | 21888 | 365408 | 37377 |
| TMTC4 | 125247 | 342624 | 21889 | 343871 | 37378 |
| TMTC4 | 125247 | 328767 | 21890 | 365409 | 37379 |
| TMTC4 | 125247 | 489713 | 21891 | N/A | |
| TMTC4 | 125247 | 462211 | 21892 | N/A | |
| TMTC4 | 125247 | 478272 | 21893 | N/A | |
| TMTC4 | 125247 | 496511 | 21894 | N/A | |
| TMTC4 | 125247 | 440120 | 21895 | 393600 | 37380 |
| TMTC4 | 125247 | 480433 | 21896 | N/A | |
| TMTC4 | 125247 | 423847 | 21897 | 398400 | 37381 |
| TMTC4 | 125247 | 475272 | 21898 | 419613 | 37382 |
| TNC | 041982 | 481475 | 21899 | N/A | |
| TNC | 041982 | 460345 | 21900 | N/A | |
| TNC | 041982 | 423613 | 21901 | 411406 | 37383 |
| TNC | 041982 | 350763 | 21902 | 265131 | 37384 |
| TNC | 041982 | 535648 | 21903 | 438152 | 37385 |
| TNC | 041982 | 534839 | 21904 | 443469 | 37386 |
| TNC | 041982 | 635336 | 21905 | 489385 | 37387 |
| TNC | 041982 | 473855 | 21906 | N/A | |
| TNC | 041982 | 476680 | 21907 | N/A | |
| TNC | 041982 | 498724 | 21908 | N/A | |
| TNC | 041982 | 544972 | 21909 | 445380 | 37388 |
| TNC | 041982 | 542877 | 21910 | 442242 | 37389 |
| TNC | 041982 | 537320 | 21911 | 443478 | 37390 |
| TNC | 041982 | 341037 | 21912 | 339553 | 37391 |
| TNFAIP6 | 123610 | 243347 | 21913 | 243347 | 37392 |
| TNFAIP6 | 123610 | 460812 | 21914 | N/A | |
| TNFRSF13C | 159958 | 291232 | 21915 | 291232 | 37393 |
| TNFRSF19 | 127863 | 248484 | 21916 | 248484 | 37394 |
| TNFRSF19 | 127863 | 464735 | 21917 | N/A | |
| TNFRSF19 | 127863 | 382258 | 21918 | 371693 | 37395 |
| TNFRSF19 | 127863 | 382263 | 21919 | 371694 | 37396 |
| TNFRSF19 | 127863 | 403372 | 21920 | 385408 | 37397 |
| TNFSF9 | 125657 | 245817 | 21921 | 245817 | 37398 |
| TNK2 | 061938 | 416152 | 21922 | 398614 | 37399 |
| TNK2 | 061938 | 381916 | 21923 | 371341 | 37400 |
| TNK2 | 061938 | 333602 | 21924 | 329425 | 37401 |
| TNK2 | 061938 | 420716 | 21925 | N/A | |
| TNK2 | 061938 | 428187 | 21926 | 392546 | 37402 |
| TNK2 | 061938 | 495247 | 21927 | N/A | |
| TNK2 | 061938 | 464041 | 21928 | N/A | |
| TNK2 | 061938 | 439230 | 21929 | 395588 | 37403 |
| TNK2 | 061938 | 481865 | 21930 | N/A | |
| TNK2 | 061938 | 424563 | 21931 | 390435 | 37404 |
| TNK2 | 061938 | 478623 | 21932 | N/A | |
| TNK2 | 061938 | 411741 | 21933 | 415126 | 37405 |
| TNK2 | 061938 | 489628 | 21934 | N/A | |
| TNK2 | 061938 | 478715 | 21935 | N/A | |
| TNK2 | 061938 | 468680 | 21936 | N/A | |
| TNK2 | 061938 | 486523 | 21937 | N/A | |
| TNK2 | 061938 | 438207 | 21938 | 392253 | 37406 |
| TNK2 | 061938 | 430929 | 21939 | 409462 | 37407 |
| TNK2 | 061938 | 468819 | 21940 | N/A | |
| TNK2 | 061938 | 447060 | 21941 | 393707 | 37408 |
| TNK2 | 061938 | 433111 | 21942 | 395154 | 37409 |
| TNK2 | 061938 | 427576 | 21943 | 390088 | 37410 |

-continued

| Symbol | ENSG | ENST | SEQ ID | ENSP | SEQ ID |
|---|---|---|---|---|---|
| TNNI1 | 159173 | 361379 | 21944 | 354488 | 37411 |
| TNNI1 | 159173 | 336092 | 21945 | 337022 | 37412 |
| TNNI1 | 159173 | 555948 | 21946 | 451307 | 37413 |
| TNNI1 | 159173 | 367312 | 21947 | 356281 | 37414 |
| TNNI1 | 159173 | 555340 | 21948 | 451660 | 37415 |
| TNNI1 | 159173 | 556362 | 21949 | 451776 | 37416 |
| TNNI1 | 159173 | 622580 | 21950 | 477578 | 37417 |
| TNR | 116147 | 367674 | 21951 | 356646 | 37418 |
| TNR | 116147 | 422274 | 21952 | 403413 | 37419 |
| TNR | 116147 | 263525 | 21953 | 263525 | 37420 |
| TNS1 | 079308 | 171887 | 21954 | 171887 | 37421 |
| TNS1 | 079308 | 446688 | 21955 | 394171 | 37422 |
| TNS1 | 079308 | 490566 | 21956 | N/A | |
| TNS1 | 079308 | 419504 | 21957 | 408724 | 37423 |
| TNS1 | 079308 | 430930 | 21958 | 406016 | 37424 |
| TNS1 | 079308 | 480416 | 21959 | N/A | |
| TNS1 | 079308 | 495556 | 21960 | N/A | |
| TNS1 | 079308 | 446903 | 21961 | 405460 | 37425 |
| TNS1 | 079308 | 479185 | 21962 | N/A | |
| TNS1 | 079308 | 480665 | 21963 | N/A | |
| TNS1 | 079308 | 413554 | 21964 | 400383 | 37426 |
| TNS1 | 079308 | 310858 | 21965 | 308321 | 37427 |
| TNS1 | 079308 | 453356 | 21966 | 414704 | 37428 |
| TNS1 | 079308 | 492338 | 21967 | N/A | |
| TNS1 | 079308 | 413280 | 21968 | 395615 | 37429 |
| TNS1 | 079308 | 439083 | 21969 | 404477 | 37430 |
| TNS1 | 079308 | 423413 | 21970 | 411349 | 37431 |
| TNS1 | 079308 | 449814 | 21971 | 393925 | 37432 |
| TNS1 | 079308 | 465306 | 21972 | N/A | |
| TNS1 | 079308 | 611415 | 21973 | 484271 | 37433 |
| TNS1 | 079308 | 615025 | 21974 | 480559 | 37434 |
| TNS3 | 136205 | 428457 | 21975 | 387990 | 37435 |
| TNS3 | 136205 | 311160 | 21976 | 312143 | 37436 |
| TNS3 | 136205 | 457718 | 21977 | 414358 | 37437 |
| TNS3 | 136205 | 450444 | 21978 | 396914 | 37438 |
| TNS3 | 136205 | 469470 | 21979 | N/A | |
| TNS3 | 136205 | 485555 | 21980 | N/A | |
| TNS3 | 136205 | 442536 | 21981 | 389285 | 37439 |
| TNS3 | 136205 | 415929 | 21982 | 409415 | 37440 |
| TNS3 | 136205 | 413551 | 21983 | 388142 | 37441 |
| TNS3 | 136205 | 434451 | 21984 | 407464 | 37442 |
| TNS3 | 136205 | 474346 | 21985 | N/A | |
| TNS3 | 136205 | 458317 | 21986 | 388318 | 37443 |
| TOB1 | 141232 | 499247 | 21987 | 427695 | 37444 |
| TOB1 | 141232 | 268957 | 21988 | 268957 | 37445 |
| TOB1 | 141232 | 509385 | 21989 | N/A | |
| TOM1L1 | 141198 | 570371 | 21990 | 458553 | 37446 |
| TOM1L1 | 141198 | 574744 | 21991 | N/A | |
| TOM1L1 | 141198 | 575882 | 21992 | 460823 | 37447 |
| TOM1L1 | 141198 | 570965 | 21993 | 459079 | 37448 |
| TOM1L1 | 141198 | 445275 | 21994 | 408958 | 37449 |
| TOM1L1 | 141198 | 348161 | 21995 | 343901 | 37450 |
| TOM1L1 | 141198 | 572405 | 21996 | 460721 | 37451 |
| TOM1L1 | 141198 | 576932 | 21997 | 461876 | 37452 |
| TOM1L1 | 141198 | 572158 | 21998 | 461284 | 37453 |
| TOM1L1 | 141198 | 572298 | 21999 | 459003 | 37454 |
| TOM1L1 | 141198 | 536554 | 22000 | 443099 | 37455 |
| TOM1L1 | 141198 | 571319 | 22001 | 458219 | 37456 |
| TOM1L1 | 141198 | 575333 | 22002 | 458918 | 37457 |
| TOM1L1 | 141198 | 572360 | 22003 | 460565 | 37458 |
| TOM1L1 | 141198 | 570499 | 22004 | 461215 | 37459 |
| TOM1L1 | 141198 | 572576 | 22005 | 458809 | 37460 |
| TOM1L1 | 141198 | 573607 | 22006 | 461396 | 37461 |
| TOM1L1 | 141198 | 575909 | 22007 | 460213 | 37462 |
| TOM1L1 | 141198 | 570977 | 22008 | N/A | |
| TOM1L1 | 141198 | 570623 | 22009 | N/A | |
| TOM1L1 | 141198 | 572905 | 22010 | N/A | |
| TOM1L1 | 141198 | 574653 | 22011 | N/A | |
| TOM1L1 | 141198 | 574318 | 22012 | 467227 | 37463 |
| TOP1 | 198900 | 361337 | 22013 | 354522 | 37464 |
| TOX2 | 124191 | 341197 | 22014 | 344724 | 37465 |
| TOX2 | 124191 | 423191 | 22015 | 390278 | 37466 |
| TOX2 | 124191 | 372999 | 22016 | 362090 | 37467 |
| TOX2 | 124191 | 358131 | 22017 | 350849 | 37468 |
| TOX2 | 124191 | 435864 | 22018 | N/A | |
| TOX2 | 124191 | 413823 | 22019 | 390876 | 37469 |

587

-continued

| Symbol | ENSG | ENST | SEQ ID | ENSP | SEQ ID |
|---|---|---|---|---|---|
| TOX3 | 103460 | 407228 | 22020 | 385705 | 37470 |
| TOX3 | 103460 | 566696 | 22021 | N/A | |
| TOX3 | 103460 | 219746 | 22022 | 219746 | 37471 |
| TOX3 | 103460 | 563091 | 22023 | 457401 | 37472 |
| TOX3 | 103460 | 568436 | 22024 | 463843 | 37473 |
| TP53INP2 | 078804 | 374810 | 22025 | 363943 | 37474 |
| TP53INP2 | 078804 | 374809 | 22026 | 363942 | 37475 |
| TP53INP2 | 078804 | 451665 | 22027 | 395784 | 37476 |
| TP53INP2 | 078804 | 414082 | 22028 | 404410 | 37477 |
| TP73 | 078900 | 378295 | 22029 | 367545 | 37478 |
| TP73 | 078900 | 604074 | 22030 | 475143 | 37479 |
| TP73 | 078900 | 354437 | 22031 | 346423 | 37480 |
| TP73 | 078900 | 603362 | 22032 | 474626 | 37481 |
| TP73 | 078900 | 604479 | 22033 | 474322 | 37482 |
| TP73 | 078900 | 378285 | 22034 | 367534 | 37483 |
| TP73 | 078900 | 378280 | 22035 | 367529 | 37484 |
| TP73 | 078900 | 378288 | 22036 | 367537 | 37485 |
| TP73 | 078900 | 603364 | 22037 | N/A | |
| TP73 | 078900 | 604194 | 22038 | N/A | |
| TP73 | 078900 | 378290 | 22039 | 367539 | 37486 |
| TP73 | 078900 | 604566 | 22040 | N/A | |
| TP73 | 078900 | 357733 | 22041 | 350366 | 37487 |
| TP73 | 078900 | 346387 | 22042 | 340740 | 37488 |
| TPCN1 | 186815 | 552077 | 22043 | N/A | |
| TPCN1 | 186815 | 392569 | 22044 | 376350 | 37489 |
| TPCN1 | 186815 | 552542 | 22045 | 446767 | 37490 |
| TPCN1 | 186815 | 428632 | 22046 | N/A | |
| TPCN1 | 186815 | 548465 | 22047 | 448561 | 37491 |
| TPCN1 | 186815 | 546781 | 22048 | 449564 | 37492 |
| TPCN1 | 186815 | 551127 | 22049 | N/A | |
| TPCN1 | 186815 | 546503 | 22050 | N/A | |
| TPCN1 | 186815 | 550543 | 22051 | N/A | |
| TPCN1 | 186815 | 547955 | 22052 | 448010 | 37493 |
| TPCN1 | 186815 | 546907 | 22053 | N/A | |
| TPCN1 | 186815 | 546787 | 22054 | N/A | |
| TPCN1 | 186815 | 541517 | 22055 | 438125 | 37494 |
| TPCN1 | 186815 | 549279 | 22056 | 448704 | 37495 |
| TPCN1 | 186815 | 335509 | 22057 | 335300 | 37496 |
| TPCN1 | 186815 | 552897 | 22058 | 449944 | 37497 |
| TPCN1 | 186815 | 550785 | 22059 | 448083 | 37498 |
| TPCN1 | 186815 | 552642 | 22060 | 447806 | 37499 |
| TPCN1 | 186815 | 547275 | 22061 | 449560 | 37500 |
| TPCN1 | 186815 | 552985 | 22062 | 447569 | 37501 |
| TPCN1 | 186815 | 550873 | 22063 | 447073 | 37502 |
| TPCN1 | 186815 | 551096 | 22064 | 447263 | 37503 |
| TPCN1 | 186815 | 551099 | 22065 | 447181 | 37504 |
| TPM3 | 143549 | 368533 | 22066 | 357521 | 37505 |
| TPM3 | 143549 | 368545 | 22067 | N/A | |
| TPM3 | 143549 | 469717 | 22068 | N/A | |
| TPM3 | 143549 | 330188 | 22069 | 339035 | 37506 |
| TPM3 | 143549 | 341485 | 22070 | 341653 | 37507 |
| TPM3 | 143549 | 341372 | 22071 | 339378 | 37508 |
| TPM3 | 143549 | 328159 | 22072 | 357520 | 37509 |
| TPM3 | 143549 | 509409 | 22073 | 426521 | 37510 |
| TPM3 | 143549 | 271850 | 22074 | 271850 | 37511 |
| TPM3 | 143549 | 312970 | 22075 | N/A | |
| TPM3 | 143549 | 513769 | 22076 | N/A | |
| TPM3 | 143549 | 302206 | 22077 | 307712 | 37512 |
| TPM3 | 143549 | 368531 | 22078 | 357517 | 37513 |
| TPM3 | 143549 | 323144 | 22079 | 357518 | 37514 |
| TPM3 | 143549 | 368530 | 22080 | 357516 | 37515 |
| TPM3 | 143549 | 504663 | 22081 | N/A | |
| TPM3 | 143549 | 509601 | 22082 | 422207 | 37516 |
| TPM3 | 143549 | 505010 | 22083 | N/A | |
| TPM3 | 143549 | 368527 | 22084 | N/A | |
| TPM3 | 143549 | 473036 | 22085 | N/A | |
| TPM3 | 143549 | 466010 | 22086 | N/A | |
| TPM3 | 143549 | 515609 | 22087 | 426306 | 37517 |
| TPM3 | 143549 | 611659 | 22088 | 480520 | 37518 |
| TPM4 | 167460 | 589897 | 22089 | 466158 | 37519 |
| TPM4 | 167460 | 344824 | 22090 | 345230 | 37520 |
| TPM4 | 167460 | 586499 | 22091 | 468246 | 37521 |
| TPM4 | 167460 | 586833 | 22092 | 467087 | 37522 |
| TPM4 | 167460 | 588507 | 22093 | 467558 | 37523 |
| TPM4 | 167460 | 300933 | 22094 | 300933 | 37524 |
| TPM4 | 167460 | 587201 | 22095 | N/A | |

588

-continued

| Symbol | ENSG | ENST | SEQ ID | ENSP | SEQ ID |
|---|---|---|---|---|---|
| TPM4 | 167460 | 588410 | 22096 | 467250 | 37525 |
| TPM4 | 167460 | 590180 | 22097 | N/A | |
| TPM4 | 167460 | 588483 | 22098 | 466106 | 37526 |
| TPM4 | 167460 | 592138 | 22099 | 466654 | 37527 |
| TPM4 | 167460 | 588032 | 22100 | 467319 | 37528 |
| TPM4 | 167460 | 586193 | 22101 | N/A | |
| TPM4 | 167460 | 591645 | 22102 | N/A | |
| TPM4 | 167460 | 592822 | 22103 | 468010 | 37529 |
| TPM4 | 167460 | 591226 | 22104 | N/A | |
| TPPP | 171368 | 360578 | 22105 | 353785 | 37530 |
| TPT1 | 133112 | 530705 | 22106 | 431872 | 37531 |
| TPT1 | 133112 | 379056 | 22107 | 368345 | 37532 |
| TPT1 | 133112 | 528619 | 22108 | 433091 | 37533 |
| TPT1 | 133112 | 529421 | 22109 | N/A | |
| TPT1 | 133112 | 484604 | 22110 | N/A | |
| TPT1 | 133112 | 533567 | 22111 | N/A | |
| TPT1 | 133112 | 490277 | 22112 | N/A | |
| TPT1 | 133112 | 530245 | 22113 | 432457 | 37534 |
| TPT1 | 133112 | 379060 | 22114 | 368350 | 37535 |
| TPT1 | 133112 | 379055 | 22115 | 368344 | 37536 |
| TPT1 | 133112 | 309246 | 22116 | 339051 | 37537 |
| TPT1 | 133112 | 527226 | 22117 | 433738 | 37538 |
| TPT1 | 133112 | 442760 | 22118 | N/A | |
| TPT1 | 133112 | 616577 | 22119 | 477781 | 37539 |
| TRA2B | 136527 | 453386 | 22120 | 416959 | 37540 |
| TRA2B | 136527 | 492417 | 22121 | N/A | |
| TRA2B | 136527 | 463328 | 22122 | N/A | |
| TRA2B | 136527 | 259043 | 22123 | 259043 | 37541 |
| TRA2B | 136527 | 414862 | 22124 | 406561 | 37542 |
| TRA2B | 136527 | 466832 | 22125 | N/A | |
| TRA2B | 136527 | 487615 | 22126 | N/A | |
| TRA2B | 136527 | 456380 | 22127 | 416887 | 37543 |
| TRA2B | 136527 | 382191 | 22128 | 371626 | 37544 |
| TRA2B | 136527 | 465245 | 22129 | N/A | |
| TRA2B | 136527 | 485530 | 22130 | N/A | |
| TRA2B | 136527 | 493864 | 22131 | N/A | |
| TRA2B | 136527 | 477939 | 22132 | N/A | |
| TRA2B | 136527 | 471134 | 22133 | N/A | |
| TRA2B | 136527 | 480461 | 22134 | N/A | |
| TRA2B | 136527 | 342294 | 22135 | 343857 | 37545 |
| TRABD2B | 269113 | 606738 | 22136 | 476820 | 37546 |
| TRABD2B | 269113 | 435576 | 22137 | N/A | |
| TRAF1 | 056558 | 373887 | 22138 | 362994 | 37547 |
| TRAF1 | 056558 | 546084 | 22139 | 438583 | 37548 |
| TRAF1 | 056558 | 540010 | 22140 | 443183 | 37549 |
| TRAF4 | 076604 | 262395 | 22141 | 262395 | 37550 |
| TRAF4 | 076604 | 478021 | 22142 | 464097 | 37551 |
| TRAF4 | 076604 | 461195 | 22143 | N/A | |
| TRAF4 | 076604 | 498540 | 22144 | N/A | |
| TRAF4 | 076604 | 422344 | 22145 | 415789 | 37552 |
| TRAF4 | 076604 | 586813 | 22146 | 466306 | 37553 |
| TRAF4 | 076604 | 444415 | 22147 | 438154 | 37554 |
| TRAF4 | 076604 | 394925 | 22148 | N/A | |
| TRAF4 | 076604 | 262396 | 22149 | 262396 | 37555 |
| TRAF4 | 076604 | 475329 | 22150 | 464583 | 37556 |
| TRAF4 | 076604 | 584944 | 22151 | 465164 | 37557 |
| TRAF4 | 076604 | 473421 | 22152 | 468107 | 37558 |
| TRAF4 | 076604 | 454852 | 22153 | 396602 | 37559 |
| TRAF4 | 076604 | 578917 | 22154 | N/A | |
| TRAF4 | 076604 | 469529 | 22155 | N/A | |
| TRAF4 | 076604 | 580073 | 22156 | N/A | |
| TRAF4 | 076604 | 618771 | 22157 | 481248 | 37560 |
| TRAF5 | 082512 | 462410 | 22158 | N/A | |
| TRAF5 | 082512 | 488428 | 22159 | N/A | |
| TRAF5 | 082512 | 494355 | 22160 | N/A | |
| TRAF5 | 082512 | 261464 | 22161 | 261464 | 37561 |
| TRAF5 | 082512 | 367004 | 22162 | 355971 | 37562 |
| TRAF5 | 082512 | 473385 | 22163 | N/A | |
| TRAF5 | 082512 | 336184 | 22164 | 336825 | 37563 |
| TRDN | 186439 | 334268 | 22165 | 333984 | 37564 |
| TRDN | 186439 | 628709 | 22166 | 486095 | 37565 |
| TRDN | 186439 | 361029 | 22167 | 354307 | 37566 |
| TRDN | 186439 | 542443 | 22168 | 437684 | 37567 |
| TRDN | 186439 | 422596 | 22169 | 406768 | 37568 |
| TRDN | 186439 | 546248 | 22170 | 439281 | 37569 |
| TREH | 118094 | 264029 | 22171 | 264029 | 37570 |

| Symbol | ENSG | ENST | SEQ ID | ENSP | SEQ ID |
|---|---|---|---|---|---|
| TREH | 118094 | 613915 | 22172 | 477923 | 37571 |
| TREH | 118094 | 397925 | 22173 | 381020 | 37572 |
| TREH | 118094 | 531295 | 22174 | N/A | |
| TREH | 118094 | 527558 | 22175 | N/A | |
| TREM2 | 095970 | 373122 | 22176 | 362214 | 37573 |
| TREM2 | 095970 | 373113 | 22177 | 362205 | 37574 |
| TREM2 | 095970 | 338469 | 22178 | 342651 | 37575 |
| TRHDE | 072657 | 548156 | 22179 | N/A | |
| TRHDE | 072657 | 261180 | 22180 | 261180 | 37576 |
| TRHDE | 072657 | 547300 | 22181 | 447822 | 37577 |
| TRHDE | 072657 | 552503 | 22182 | N/A | |
| TRHDE | 072657 | 549138 | 22183 | N/A | |
| TRHDE | 072657 | 549401 | 22184 | N/A | |
| TRHDE | 072657 | 549922 | 22185 | N/A | |
| TRIL | 255690 | 539664 | 22186 | 479256 | 37578 |
| TRIM15 | 227147 | 421984 | 22187 | 413961 | 37579 |
| TRIM15 | 227147 | 423220 | 22188 | 400174 | 37580 |
| TRIM15 | 227147 | 476225 | 22189 | N/A | |
| TRIM15 | 227147 | 478964 | 22190 | N/A | |
| TRIM15 | 227147 | 548732 | 22191 | 449583 | 37581 |
| TRIM15 | 233599 | 431059 | 22192 | 403221 | 37582 |
| TRIM15 | 233599 | 426765 | 22193 | 389858 | 37583 |
| TRIM15 | 233599 | 490570 | 22194 | N/A | |
| TRIM15 | 233599 | 474092 | 22195 | N/A | |
| TRIM15 | 233599 | 548653 | 22196 | 447232 | 37584 |
| TRIM15 | 233599 | 550400 | 22197 | 447500 | 37585 |
| TRIM15 | 235905 | 429524 | 22198 | 409605 | 37586 |
| TRIM15 | 235905 | 424597 | 22199 | 403836 | 37587 |
| TRIM15 | 235905 | 493180 | 22200 | N/A | |
| TRIM15 | 235905 | 496657 | 22201 | N/A | |
| TRIM15 | 235905 | 552676 | 22202 | 449686 | 37588 |
| TRIM15 | 235905 | 550702 | 22203 | 448772 | 37589 |
| TRIM15 | 137384 | 259930 | 22204 | 259930 | 37590 |
| TRIM15 | 137384 | 427952 | 22205 | 392768 | 37591 |
| TRIM15 | 137384 | 492678 | 22206 | N/A | |
| TRIM15 | 137384 | 479020 | 22207 | N/A | |
| TRIM15 | 137384 | 550969 | 22208 | 447725 | 37592 |
| TRIM15 | 204610 | 376694 | 22209 | 365884 | 37593 |
| TRIM15 | 204610 | 433744 | 22210 | 398285 | 37594 |
| TRIM15 | 204610 | 477944 | 22211 | N/A | |
| TRIM15 | 204610 | 376688 | 22212 | 365878 | 37595 |
| TRIM15 | 204610 | 619857 | 22213 | 484001 | 37596 |
| TRIM15 | 235960 | 427091 | 22214 | 411683 | 37597 |
| TRIM15 | 235960 | 444157 | 22215 | 412755 | 37598 |
| TRIM15 | 235960 | 498654 | 22216 | N/A | |
| TRIM15 | 235960 | 465041 | 22217 | N/A | |
| TRIM15 | 235960 | 550694 | 22218 | 450011 | 37599 |
| TRIM15 | 224145 | 430090 | 22219 | 398224 | 37600 |
| TRIM15 | 224145 | 440260 | 22220 | 402326 | 37601 |
| TRIM15 | 224145 | 469125 | 22221 | N/A | |
| TRIM15 | 224145 | 473556 | 22222 | N/A | |
| TRIM15 | 224145 | 546888 | 22223 | 447004 | 37602 |
| TRIM15 | 224145 | 552836 | 22224 | 449617 | 37603 |
| TRIM15 | 235259 | 414873 | 22225 | 415480 | 37604 |
| TRIM15 | 235259 | 425255 | 22226 | 391673 | 37605 |
| TRIM15 | 235259 | 485505 | 22227 | N/A | |
| TRIM15 | 235259 | 479130 | 22228 | N/A | |
| TRIM15 | 235259 | 552062 | 22229 | 448307 | 37606 |
| TRIM2 | 109654 | 491446 | 22230 | N/A | |
| TRIM2 | 109654 | 441616 | 22231 | 400879 | 37607 |
| TRIM2 | 109654 | 437508 | 22232 | 415812 | 37608 |
| TRIM2 | 109654 | 496978 | 22233 | N/A | |
| TRIM2 | 109654 | 479711 | 22234 | N/A | |
| TRIM2 | 109654 | 494872 | 22235 | 488229 | 37609 |
| TRIM2 | 109654 | 338700 | 22236 | 339659 | 37610 |
| TRIM2 | 109654 | 632856 | 22237 | 487836 | 37611 |
| TRIM2 | 109654 | 502281 | 22238 | 488602 | 37612 |
| TRIM2 | 109654 | 482578 | 22239 | 487750 | 37613 |
| TRIM2 | 109654 | 433687 | 22240 | 400375 | 37614 |
| TRIM2 | 109654 | 460908 | 22241 | 488751 | 37615 |
| TRIM26 | 230230 | 493978 | 22242 | N/A | |
| TRIM26 | 230230 | 438908 | 22243 | 409182 | 37616 |
| TRIM26 | 230230 | 455000 | 22244 | 392805 | 37617 |
| TRIM26 | 230230 | 436219 | 22245 | 390258 | 37618 |
| TRIM26 | 230230 | 446196 | 22246 | 402135 | 37619 |
| TRIM26 | 230230 | 451189 | 22247 | 393753 | 37620 |

| Symbol | ENSG | ENST | SEQ ID | ENSP | SEQ ID |
|---|---|---|---|---|---|
| TRIM26 | 230230 | 422881 | 22248 | 412641 | 37621 |
| TRIM26 | 230230 | 435387 | 22249 | 405923 | 37622 |
| TRIM26 | 230230 | 475230 | 22250 | N/A | |
| TRIM26 | 231002 | 469107 | 22251 | N/A | |
| TRIM26 | 231002 | 450392 | 22252 | 394421 | 37623 |
| TRIM26 | 231002 | 415923 | 22253 | 415755 | 37624 |
| TRIM26 | 231002 | 428486 | 22254 | 414248 | 37625 |
| TRIM26 | 231002 | 446540 | 22255 | 391602 | 37626 |
| TRIM26 | 231002 | 450103 | 22256 | 416276 | 37627 |
| TRIM26 | 231002 | 433361 | 22257 | 391031 | 37628 |
| TRIM26 | 231002 | 431641 | 22258 | 388005 | 37629 |
| TRIM26 | 231002 | 477569 | 22259 | N/A | |
| TRIM26 | 231641 | 425831 | 22260 | 394371 | 37630 |
| TRIM26 | 231641 | 432326 | 22261 | 407876 | 37631 |
| TRIM26 | 231641 | 438384 | 22262 | 416737 | 37632 |
| TRIM26 | 231641 | 464955 | 22263 | N/A | |
| TRIM26 | 231641 | 449136 | 22264 | 389386 | 37633 |
| TRIM26 | 231641 | 419401 | 22265 | 405710 | 37634 |
| TRIM26 | 231641 | 481596 | 22266 | N/A | |
| TRIM26 | 231641 | 445457 | 22267 | 403765 | 37635 |
| TRIM26 | 231641 | 424124 | 22268 | 400655 | 37636 |
| TRIM26 | 234127 | 480999 | 22269 | N/A | |
| TRIM26 | 234127 | 437089 | 22270 | 395491 | 37637 |
| TRIM26 | 234127 | 454678 | 22271 | 410446 | 37638 |
| TRIM26 | 234127 | 453195 | 22272 | 391879 | 37639 |
| TRIM26 | 234127 | 416596 | 22273 | 413673 | 37640 |
| TRIM26 | 234127 | 418026 | 22274 | 387530 | 37641 |
| TRIM26 | 234127 | 434785 | 22275 | 400920 | 37642 |
| TRIM26 | 234127 | 487829 | 22276 | N/A | |
| TRIM26 | 137313 | 463977 | 22277 | N/A | |
| TRIM26 | 137313 | 383607 | 22278 | 373102 | 37643 |
| TRIM26 | 137313 | 327357 | 22279 | 331131 | 37644 |
| TRIM26 | 137313 | 396558 | 22280 | 379806 | 37645 |
| TRIM26 | 137313 | 412755 | 22281 | 390908 | 37646 |
| TRIM26 | 137313 | 419171 | 22282 | 412165 | 37647 |
| TRIM26 | 137313 | 427612 | 22283 | 405526 | 37648 |
| TRIM26 | 137313 | 461313 | 22284 | N/A | |
| TRIM26 | 234046 | 472707 | 22285 | N/A | |
| TRIM26 | 234046 | 422349 | 22286 | 396188 | 37649 |
| TRIM26 | 234046 | 445259 | 22287 | 407294 | 37650 |
| TRIM26 | 234046 | 427535 | 22288 | 398545 | 37651 |
| TRIM26 | 234046 | 423901 | 22289 | 395820 | 37652 |
| TRIM26 | 234046 | 444979 | 22290 | 403395 | 37653 |
| TRIM26 | 234046 | 415789 | 22291 | 407035 | 37654 |
| TRIM26 | 234046 | 447942 | 22292 | 396089 | 37655 |
| TRIM26 | 234046 | 477353 | 22293 | N/A | |
| TRIM26 | 226060 | 487616 | 22294 | N/A | |
| TRIM26 | 226060 | 433314 | 22295 | 402395 | 37656 |
| TRIM26 | 226060 | 447711 | 22296 | 408233 | 37657 |
| TRIM26 | 226060 | 456093 | 22297 | 406707 | 37658 |
| TRIM26 | 226060 | 438785 | 22298 | 397048 | 37659 |
| TRIM26 | 226060 | 415966 | 22299 | 402684 | 37660 |
| TRIM26 | 226060 | 433836 | 22300 | 402990 | 37661 |
| TRIM26 | 226060 | 429583 | 22301 | 393827 | 37662 |
| TRIM26 | 226060 | 486529 | 22302 | N/A | |
| TRIM26 | 228881 | 425523 | 22303 | 393011 | 37663 |
| TRIM26 | 228881 | 439094 | 22304 | 389203 | 37664 |
| TRIM26 | 228881 | 456770 | 22305 | 415328 | 37665 |
| TRIM26 | 228881 | 471458 | 22306 | N/A | |
| TRIM26 | 228881 | 422802 | 22307 | 412838 | 37666 |
| TRIM26 | 228881 | 453442 | 22308 | 416664 | 37667 |
| TRIM26 | 228881 | 484938 | 22309 | N/A | |
| TRIM26 | 228881 | 440149 | 22310 | 403887 | 37668 |
| TRIM26 | 228881 | 438064 | 22311 | 405791 | 37669 |
| TRIM5 | 132256 | 380034 | 22312 | 369373 | 37670 |
| TRIM5 | 132256 | 380027 | 22313 | 369366 | 37671 |
| TRIM5 | 132256 | 433961 | 22314 | 393052 | 37672 |
| TRIM5 | 132256 | 396847 | 22315 | 380058 | 37673 |
| TRIM5 | 132256 | 438025 | 22316 | 398196 | 37674 |
| TRIM5 | 132256 | 483835 | 22317 | N/A | |
| TRIM5 | 132256 | 492086 | 22318 | N/A | |
| TRIM5 | 132256 | 465634 | 22319 | N/A | |
| TRIM5 | 132256 | 487241 | 22320 | N/A | |
| TRIM5 | 132256 | 412903 | 22321 | 388031 | 37675 |
| TRIM5 | 132256 | 419850 | 22322 | 388150 | 37676 |
| TRIM36 | 152503 | 282369 | 22323 | 282369 | 37677 |

-continued

-continued

| Symbol | ENSG | ENST | SEQ ID | ENSP | SEQ ID |
|---|---|---|---|---|---|
| TRIM36 | 152503 | 513154 | 22324 | 423934 | 37678 |
| TRIM36 | 152503 | 514154 | 22325 | 424259 | 37679 |
| TRIM36 | 152503 | 513485 | 22326 | N/A | |
| TRIM36 | 152503 | 515104 | 22327 | N/A | |
| TRIM36 | 152503 | 510222 | 22328 | N/A | |
| TRIM36 | 152503 | 508894 | 22329 | 424743 | 37680 |
| TRIM36 | 152503 | 379618 | 22330 | 368938 | 37681 |
| TRIM36 | 152503 | 511701 | 22331 | N/A | |
| TRIM36 | 152503 | 379617 | 22332 | 368937 | 37682 |
| TRIM59 | 213186 | 543469 | 22333 | 444313 | 37683 |
| TRIM59 | 213186 | 468542 | 22334 | 420451 | 37684 |
| TRIM59 | 213186 | 494486 | 22335 | 417605 | 37685 |
| TRIM59 | 213186 | 471155 | 22336 | 418699 | 37686 |
| TRIM59 | 213186 | 496222 | 22337 | 418856 | 37687 |
| TRIM59 | 213186 | 471396 | 22338 | 420520 | 37688 |
| TRIM59 | 213186 | 479460 | 22339 | 417081 | 37689 |
| TRIM59 | 213186 | 309784 | 22340 | 311219 | 37690 |
| TRIM62 | 116525 | 291416 | 22341 | 291416 | 37691 |
| TRIM62 | 116525 | 543586 | 22342 | 441173 | 37692 |
| TRIM62 | 116525 | 485148 | 22343 | N/A | |
| TRIM62 | 116525 | 486583 | 22344 | N/A | |
| TRIM67 | 119283 | 444294 | 22345 | 412124 | 37693 |
| TRIM67 | 119283 | 449018 | 22346 | 400163 | 37694 |
| TRIM67 | 119283 | 366653 | 22347 | 355613 | 37695 |
| TP53I11 | 175274 | 354556 | 22348 | 346564 | 37696 |
| TP53I11 | 175274 | 395648 | 22349 | 379009 | 37697 |
| TP53I11 | 175274 | 533940 | 22350 | 436152 | 37698 |
| TP53I11 | 175274 | 525680 | 22351 | 433474 | 37699 |
| TP53I11 | 175274 | 532253 | 22352 | 437243 | 37700 |
| TP53I11 | 175274 | 524774 | 22353 | N/A | |
| TP53I11 | 175274 | 528473 | 22354 | 433454 | 37701 |
| TP53I11 | 175274 | 528290 | 22355 | 437258 | 37702 |
| TP53I11 | 175274 | 533955 | 22356 | N/A | |
| TP53I11 | 175274 | 531130 | 22357 | N/A | |
| TP53I11 | 175274 | 531928 | 22358 | 475501 | 37703 |
| TP53I11 | 175274 | 525667 | 22359 | N/A | |
| TP53I11 | 175274 | 532921 | 22360 | N/A | |
| TP53I11 | 175274 | 525145 | 22361 | 435800 | 37704 |
| TP53I11 | 175274 | 525683 | 22362 | 434461 | 37705 |
| TP53I11 | 175274 | 525138 | 22363 | 435739 | 37706 |
| TP53I11 | 175274 | 533443 | 22364 | 437284 | 37707 |
| TP53I11 | 175274 | 530035 | 22365 | 432089 | 37708 |
| TP53I11 | 175274 | 527685 | 22366 | 431556 | 37709 |
| TP53I11 | 175274 | 533937 | 22367 | 432926 | 37710 |
| TP53I11 | 175274 | 616990 | 22368 | 481456 | 37711 |
| TP53I11 | 175274 | 308212 | 22369 | 309532 | 37712 |
| TP53I11 | 175274 | 627720 | 22370 | 486799 | 37713 |
| TRPC3 | 138741 | 264811 | 22371 | 264811 | 37714 |
| TRPC3 | 138741 | 379645 | 22372 | 368966 | 37715 |
| TRPC3 | 138741 | 506449 | 22373 | 423866 | 37716 |
| TRPC3 | 138741 | 513531 | 22374 | 426899 | 37717 |
| TRPC3 | 138741 | 502968 | 22375 | 422214 | 37718 |
| TRPC5 | 072315 | 262839 | 22376 | 262839 | 37719 |
| TRPC6 | 137672 | 344327 | 22377 | 340913 | 37720 |
| TRPC6 | 137672 | 532133 | 22378 | 435574 | 37721 |
| TRPC6 | 137672 | 348423 | 22379 | 343672 | 37722 |
| TRPC6 | 137672 | 360497 | 22380 | 353687 | 37723 |
| TRPC6 | 137672 | 532184 | 22381 | N/A | |
| TRPC6 | 137672 | 527240 | 22382 | N/A | |
| TRPC6 | 137672 | 526713 | 22383 | N/A | |
| TRPC7 | 069018 | 502753 | 22384 | 424854 | 37724 |
| TRPC7 | 069018 | 378459 | 22385 | 367720 | 37725 |
| TRPC7 | 069018 | 352189 | 22386 | 330322 | 37726 |
| TRPC7 | 069018 | 514963 | 22387 | 426870 | 37727 |
| TRPC7 | 069018 | 513104 | 22388 | 426070 | 37728 |
| TRPC7 | 069018 | 509288 | 22389 | N/A | |
| TRPC7 | 069018 | 503275 | 22390 | 421571 | 37729 |
| TRPM2 | 142185 | 300482 | 22391 | 300482 | 37730 |
| TRPM2 | 142185 | 431901 | 22392 | 393982 | 37731 |
| TRPM2 | 142185 | 397928 | 22393 | 381023 | 37732 |
| TRPM2 | 142185 | 397932 | 22394 | 381026 | 37733 |
| TRPM2 | 142185 | 300481 | 22395 | 300481 | 37734 |
| TRPM2 | 142185 | 498430 | 22396 | N/A | |
| TRPM2 | 142185 | 490982 | 22397 | N/A | |
| TRPM2 | 142185 | 621064 | 22398 | 477514 | 37735 |
| TRPV3 | 167723 | 381913 | 22399 | 371338 | 37736 |

| Symbol | ENSG | ENST | SEQ ID | ENSP | SEQ ID |
|---|---|---|---|---|---|
| TRPV3 | 167723 | 577016 | 22400 | 460856 | 37737 |
| TRPV3 | 167723 | 301365 | 22401 | 301365 | 37738 |
| TRPV3 | 167723 | 571139 | 22402 | 458187 | 37739 |
| TRPV3 | 167723 | 573539 | 22403 | 458239 | 37740 |
| TRPV3 | 167723 | 576742 | 22404 | 461518 | 37741 |
| TRPV3 | 167723 | 572519 | 22405 | 460215 | 37742 |
| TRPV3 | 167723 | 571005 | 22406 | N/A | |
| TRPV3 | 167723 | 575865 | 22407 | N/A | |
| TRPV3 | 167723 | 574773 | 22408 | N/A | |
| TRPV3 | 167723 | 616411 | 22409 | 483947 | 37743 |
| TRPV6 | 165125 | 359396 | 22410 | 352358 | 37744 |
| TRPV6 | 165125 | 485138 | 22411 | N/A | |
| TRPV6 | 165125 | 615386 | 22412 | N/A | |
| TRPV6 | 165125 | 619250 | 22413 | N/A | |
| TRPV6 | 165125 | 436401 | 22414 | 411100 | 37745 |
| TRPV6 | 165125 | 474388 | 22415 | N/A | |
| TRPV6 | 165125 | 489123 | 22416 | N/A | |
| TRPV6 | 165125 | 431833 | 22417 | 415917 | 37746 |
| TRPV6 | 165125 | 638686 | 22418 | 492723 | 37747 |
| TRPV6 | 276971 | 611485 | 22419 | 479828 | 37748 |
| TRPV6 | 276971 | 632381 | 22420 | N/A | |
| TRPV6 | 276971 | 632455 | 22421 | N/A | |
| TRPV6 | 276971 | 632330 | 22422 | N/A | |
| TRPV6 | 276971 | 632149 | 22423 | N/A | |
| TRPV6 | 276971 | 633318 | 22424 | 488490 | 37749 |
| TRPV6 | 276971 | 631384 | 22425 | N/A | |
| TRPV6 | 276971 | 634074 | 22426 | N/A | |
| TRPV6 | 276971 | 633826 | 22427 | 487762 | 37750 |
| TSC22D2 | 196428 | 361875 | 22428 | 354543 | 37751 |
| TSC22D2 | 196428 | 480589 | 22429 | 418149 | 37752 |
| TSC22D2 | 196428 | 466814 | 22430 | 417747 | 37753 |
| TSC22D2 | 196428 | 485421 | 22431 | 420689 | 37754 |
| TSC22D2 | 196428 | 492828 | 22432 | N/A | |
| TSC22D2 | 196428 | 460316 | 22433 | N/A | |
| TSC22D3 | 157514 | 372390 | 22434 | 361466 | 37755 |
| TSC22D3 | 157514 | 372397 | 22435 | 361474 | 37756 |
| TSC22D3 | 157514 | 315660 | 22436 | 314655 | 37757 |
| TSC22D3 | 157514 | 372383 | 22437 | 361458 | 37758 |
| TSC22D3 | 157514 | 372384 | 22438 | 361459 | 37759 |
| TSC22D3 | 157514 | 372382 | 22439 | 361457 | 37760 |
| TSC22D3 | 157514 | 506081 | 22440 | 427427 | 37761 |
| TSC22D3 | 157514 | 514426 | 22441 | 421016 | 37762 |
| TSC22D3 | 157514 | 486554 | 22442 | 425414 | 37763 |
| TSC22D3 | 157514 | 503515 | 22443 | 422060 | 37764 |
| TSC22D3 | 157514 | 514897 | 22444 | 427199 | 37765 |
| TSC22D3 | 157514 | 480691 | 22445 | 425155 | 37766 |
| TSC22D3 | 157514 | 510887 | 22446 | 422636 | 37767 |
| TSC22D3 | 157514 | 502650 | 22447 | 424653 | 37768 |
| TSC22D3 | 157514 | 506724 | 22448 | 427075 | 37769 |
| TSC22D3 | 157514 | 505965 | 22449 | 425158 | 37770 |
| TSC22D3 | 157514 | 502961 | 22450 | 422228 | 37771 |
| TSHB | 134200 | 369517 | 22451 | 358530 | 37772 |
| TSHB | 134200 | 256592 | 22452 | 256592 | 37773 |
| TSHZ2 | 182463 | 371497 | 22453 | 360552 | 37774 |
| TSHZ2 | 182463 | 603338 | 22454 | 475114 | 37775 |
| TSHZ2 | 182463 | 605656 | 22455 | 474159 | 37776 |
| TSHZ2 | 182463 | 626626 | 22456 | 487408 | 37777 |
| TSHZ2 | 182463 | 329613 | 22457 | 333114 | 37778 |
| TSIX | 270641 | 604411 | 22458 | N/A | |
| TSPAN11 | 110900 | 545802 | 22459 | 443890 | 37779 |
| TSPAN11 | 110900 | 546076 | 22460 | 437403 | 37780 |
| TSPAN11 | 110900 | 535215 | 22461 | 445503 | 37781 |
| TSPAN11 | 110900 | 261177 | 22462 | 261177 | 37782 |
| TSPAN14 | 108219 | 429989 | 22463 | 396270 | 37783 |
| TSPAN14 | 108219 | 481124 | 22464 | 418195 | 37784 |
| TSPAN14 | 108219 | 372157 | 22465 | 361230 | 37785 |
| TSPAN14 | 108219 | 469149 | 22466 | N/A | |
| TSPAN14 | 108219 | 372164 | 22467 | 361237 | 37786 |
| TSPAN14 | 108219 | 372158 | 22468 | 361231 | 37787 |
| TSPAN14 | 108219 | 341863 | 22469 | 344076 | 37788 |
| TSPAN14 | 108219 | 372156 | 22470 | 361229 | 37789 |
| TSPAN14 | 108219 | 265450 | 22471 | N/A | |
| TSPAN14 | 108219 | 616406 | 22472 | 480263 | 37790 |
| TSPAN15 | 099282 | 373290 | 22473 | 362387 | 37791 |
| TSPAN15 | 099282 | 478112 | 22474 | N/A | |
| TSPAN15 | 099282 | 475069 | 22475 | N/A | |

-continued

-continued

| Symbol | ENSG | ENST | SEQ ID | ENSP | SEQ ID |
|---|---|---|---|---|---|
| TSPAN15 | 099282 | 452130 | 22476 | 404528 | 37792 |
| TSPAN15 | 099282 | 490083 | 22477 | N/A | |
| TSPAN15 | 099282 | 486093 | 22478 | N/A | |
| TSPAN15 | 099282 | 459981 | 22479 | N/A | |
| TSPAN15 | 099282 | 470508 | 22480 | N/A | |
| TSPAN18 | 157570 | 533786 | 22481 | 433592 | 37793 |
| TSPAN18 | 157570 | 533202 | 22482 | 434625 | 37794 |
| TSPAN18 | 157570 | 533080 | 22483 | 433362 | 37795 |
| TSPAN18 | 157570 | 520358 | 22484 | 429993 | 37796 |
| TSPAN18 | 157570 | 520999 | 22485 | 427942 | 37797 |
| TSPAN18 | 157570 | 520837 | 22486 | 430343 | 37798 |
| TSPAN18 | 157570 | 518429 | 22487 | 429020 | 37799 |
| TSPAN18 | 157570 | 519051 | 22488 | N/A | |
| TSPAN18 | 157570 | 520245 | 22489 | N/A | |
| TSPAN18 | 157570 | 517621 | 22490 | N/A | |
| TSPAN18 | 157570 | 521990 | 22491 | N/A | |
| TSPAN18 | 157570 | 520278 | 22492 | N/A | |
| TSPAN18 | 157570 | 340160 | 22493 | 339820 | 37800 |
| TSPAN2 | 134198 | 369516 | 22494 | 358529 | 37801 |
| TSPAN2 | 134198 | 369515 | 22495 | 358528 | 37802 |
| TSPAN2 | 134198 | 491992 | 22496 | N/A | |
| TSPAN2 | 134198 | 433172 | 22497 | 415256 | 37803 |
| TSPAN5 | 168785 | 508798 | 22498 | 421808 | 37804 |
| TSPAN5 | 168785 | 305798 | 22499 | 307701 | 37805 |
| TSPAN5 | 168785 | 505184 | 22500 | 423916 | 37806 |
| TSPAN5 | 168785 | 511753 | 22501 | N/A | |
| TSPAN5 | 168785 | 515440 | 22502 | 422351 | 37807 |
| TSPAN5 | 168785 | 509168 | 22503 | N/A | |
| TSPAN5 | 168785 | 515287 | 22504 | 423504 | 37808 |
| TSPAN5 | 168785 | 511651 | 22505 | 426248 | 37809 |
| TSPAN5 | 168785 | 511800 | 22506 | 422548 | 37810 |
| TSPAN5 | 168785 | 507167 | 22507 | N/A | |
| TSPAN6 | 000003 | 373020 | 22508 | 362111 | 37811 |
| TSPAN6 | 000003 | 496771 | 22509 | N/A | |
| TSPAN6 | 000003 | 494424 | 22510 | N/A | |
| TSPAN6 | 000003 | 612152 | 22511 | 482130 | 37812 |
| TSPAN6 | 000003 | 614008 | 22512 | 482894 | 37813 |
| TSPOAP1 | 005379 | 581692 | 22513 | N/A | |
| TSPOAP1 | 005379 | 581675 | 22514 | 462518 | 37814 |
| TSPOAP1 | 005379 | 268893 | 22515 | 268893 | 37815 |
| TSPOAP1 | 005379 | 578511 | 22516 | N/A | |
| TSPOAP1 | 005379 | 343736 | 22517 | 345824 | 37816 |
| TSPOAP1 | 005379 | 577871 | 22518 | N/A | |
| TSPOAP1 | 005379 | 580669 | 22519 | 462822 | 37817 |
| TSPOAP1 | 005379 | 582679 | 22520 | 462710 | 37818 |
| TSPOAP1 | 005379 | 578486 | 22521 | N/A | |
| TSPOAP1 | 005379 | 585149 | 22522 | N/A | |
| TSPOAP1 | 005379 | 583624 | 22523 | N/A | |
| TSTD2 | 136925 | 375173 | 22524 | N/A | |
| TSTD2 | 136925 | 341170 | 22525 | 342499 | 37819 |
| TSTD2 | 136925 | 375172 | 22526 | 364315 | 37820 |
| TSTD2 | 136925 | 375165 | 22527 | 364308 | 37821 |
| TSTD2 | 136925 | 375163 | 22528 | N/A | |
| TSTD2 | 136925 | 484708 | 22529 | N/A | |
| TTC23L | 205838 | 502782 | 22530 | N/A | |
| TTC23L | 205838 | 506758 | 22531 | N/A | |
| TTC23L | 205838 | 505624 | 22532 | 422188 | 37822 |
| TTC23L | 205838 | 508722 | 22533 | 424418 | 37823 |
| TTC23L | 205838 | 508377 | 22534 | N/A | |
| TTC23L | 205838 | 514080 | 22535 | N/A | |
| TTC23L | 205838 | 502674 | 22536 | 425242 | 37824 |
| TTC23L | 205838 | 610313 | 22537 | 484792 | 37825 |
| TTC23L | 205838 | 638320 | 22538 | 491000 | 37826 |
| TTC28 | 100154 | 397906 | 22539 | 381003 | 37827 |
| TTC28 | 100154 | 431039 | 22540 | 410244 | 37828 |
| TTC28 | 100154 | 480563 | 22541 | N/A | |
| TTC28 | 100154 | 469670 | 22542 | N/A | |
| TTC28 | 100154 | 442232 | 22543 | 388788 | 37829 |
| TTC28 | 100154 | 490475 | 22544 | N/A | |
| TTC28 | 100154 | 468807 | 22545 | N/A | |
| TTC28 | 100154 | 612946 | 22546 | 479834 | 37830 |
| TTC32 | 183891 | 402414 | 22547 | 385708 | 37831 |
| TTC32 | 183891 | 333610 | 22548 | 333018 | 37832 |
| TTC32 | 183891 | 495698 | 22549 | N/A | |
| TTC32 | 183891 | 431392 | 22550 | 412874 | 37833 |
| TTLL3 | 214021 | 414814 | 22551 | 399930 | 37834 |

| Symbol | ENSG | ENST | SEQ ID | ENSP | SEQ ID |
|---|---|---|---|---|---|
| TTLL3 | 214021 | 452597 | 22552 | 399782 | 37835 |
| TTLL3 | 214021 | 419081 | 22553 | 401686 | 37836 |
| TTLL3 | 214021 | 438596 | 22554 | 414965 | 37837 |
| TTLL3 | 214021 | 459758 | 22555 | N/A | |
| TTLL3 | 214021 | 417065 | 22556 | 408128 | 37838 |
| TTLL3 | 214021 | 439814 | 22557 | 394481 | 37839 |
| TTLL3 | 214021 | 418745 | 22558 | 400462 | 37840 |
| TTLL3 | 214021 | 430718 | 22559 | 402197 | 37841 |
| TTLL3 | 214021 | 427220 | 22560 | 395912 | 37842 |
| TTLL3 | 214021 | 426895 | 22561 | 392549 | 37843 |
| TTLL3 | 214021 | 426827 | 22562 | 389904 | 37844 |
| TTLL3 | 214021 | 431204 | 22563 | 398996 | 37845 |
| TTLL3 | 214021 | 422738 | 22564 | 412915 | 37846 |
| TTLL3 | 214021 | 430390 | 22565 | 396606 | 37847 |
| TTLL3 | 214021 | 483051 | 22566 | N/A | |
| TTLL3 | 214021 | 310252 | 22567 | 312148 | 37848 |
| TTLL3 | 214021 | 496526 | 22568 | N/A | |
| TTLL3 | 214021 | 496246 | 22569 | 473440 | 37849 |
| TTLL3 | 214021 | 474948 | 22570 | 473376 | 37850 |
| TTLL3 | 214021 | 452823 | 22571 | 399191 | 37851 |
| TTLL3 | 214021 | 443148 | 22572 | 398097 | 37852 |
| TTLL3 | 214021 | 383827 | 22573 | 373338 | 37853 |
| TTLL3 | 214021 | 473661 | 22574 | 430051 | 37854 |
| TTLL3 | 214021 | 455274 | 22575 | 409632 | 37855 |
| TTLL3 | 214021 | 438141 | 22576 | 409246 | 37856 |
| TTLL3 | 214021 | 430793 | 22577 | 403874 | 37857 |
| TTLL3 | 214021 | 602338 | 22578 | N/A | |
| TTLL3 | 214021 | 482269 | 22579 | N/A | |
| TTLL3 | 214021 | 492440 | 22580 | N/A | |
| TTLL3 | 214021 | 466245 | 22581 | N/A | |
| TTLL3 | 214021 | 471058 | 22582 | 473314 | 37858 |
| TTLL3 | 214021 | 493241 | 22583 | N/A | |
| TTLL5 | 119685 | 557636 | 22584 | 450713 | 37859 |
| TTLL5 | 119685 | 286650 | 22585 | 286650 | 37860 |
| TTLL5 | 119685 | 298832 | 22586 | 298832 | 37861 |
| TTLL5 | 119685 | 556173 | 22587 | N/A | |
| TTLL5 | 119685 | 554185 | 22588 | N/A | |
| TTLL5 | 119685 | 555422 | 22589 | N/A | |
| TTLL5 | 119685 | 554935 | 22590 | N/A | |
| TTLL5 | 119685 | 554148 | 22591 | N/A | |
| TTLL5 | 119685 | 554878 | 22592 | N/A | |
| TTLL5 | 119685 | 556976 | 22593 | N/A | |
| TTLL5 | 119685 | 556893 | 22594 | 452524 | 37862 |
| TTLL5 | 119685 | 554510 | 22595 | 451946 | 37863 |
| TTLL5 | 119685 | 555018 | 22596 | 478640 | 37864 |
| TTLL5 | 119685 | 608522 | 22597 | N/A | |
| TTLL5 | 119685 | 557219 | 22598 | N/A | |
| TTLL5 | 119685 | 554972 | 22599 | N/A | |
| TTLL5 | 119685 | 554487 | 22600 | N/A | |
| TTLL5 | 119685 | 556685 | 22601 | N/A | |
| TTLL5 | 119685 | 556977 | 22602 | 451917 | 37865 |
| TTLL5 | 119685 | 556265 | 22603 | N/A | |
| TTLL5 | 119685 | 554132 | 22604 | N/A | |
| TTLL5 | 119685 | 555290 | 22605 | N/A | |
| TTPA | 137561 | 521138 | 22606 | N/A | |
| TTPA | 137561 | 260116 | 22607 | 260116 | 37866 |
| TTTY10 | 229236 | 455084 | 22608 | N/A | |
| TTTY10 | 229236 | 439472 | 22609 | N/A | |
| TTTY14 | 176728 | 324446 | 22610 | N/A | |
| TTTY14 | 176728 | 454875 | 22611 | N/A | |
| TTTY14 | 176728 | 452584 | 22612 | N/A | |
| TTTY14 | 176728 | 331787 | 22613 | N/A | |
| TTTY14 | 176728 | 447937 | 22614 | N/A | |
| TTTY14 | 176728 | 610801 | 22615 | N/A | |
| TTTY15 | 233864 | 457658 | 22616 | N/A | |
| TTTY15 | 233864 | 440408 | 22617 | N/A | |
| TTTY15 | 233864 | 417071 | 22618 | N/A | |
| TTTY15 | 233864 | 457658 | 22619 | N/A | |
| TTTY15 | 233864 | 440408 | 22620 | N/A | |
| TTTY15 | 233864 | 417071 | 22621 | N/A | |
| TTTYH3 | 136295 | 258796 | 22622 | 258796 | 37867 |
| TTTYH3 | 136295 | 407643 | 22623 | 385316 | 37868 |
| TTTYH3 | 136295 | 400376 | 22624 | 383227 | 37869 |
| TTTYH3 | 136295 | 403167 | 22625 | 385015 | 37870 |
| TTTYH3 | 136295 | 477439 | 22626 | N/A | |
| TTTYH3 | 136295 | 498454 | 22627 | N/A | |

-continued

-continued

| Symbol | ENSG | ENST | SEQ ID | ENSP | SEQ ID |
|---|---|---|---|---|---|
| TTTYH3 | 136295 | 429448 | 22628 | 413757 | 37871 |
| TUBA8 | 183785 | 426208 | 22629 | 407624 | 37872 |
| TUBA8 | 183785 | 316027 | 22630 | 318575 | 37873 |
| TUBA8 | 183785 | 330423 | 22631 | 333326 | 37874 |
| TUBA8 | 183785 | 416740 | 22632 | 412646 | 37875 |
| TUBA8 | 183785 | 608634 | 22633 | 477306 | 37876 |
| TUBB2B | 137285 | 259818 | 22634 | 259818 | 37877 |
| TUBB2B | 137285 | 473006 | 22635 | N/A | |
| TUBB4A | 104833 | 264071 | 22636 | 264071 | 37878 |
| TUBB4A | 104833 | 594276 | 22637 | 472481 | 37879 |
| TUBB4A | 104833 | 594075 | 22638 | 469936 | 37880 |
| TUBB4A | 104833 | 600216 | 22639 | 470983 | 37881 |
| TUBB4A | 104833 | 595324 | 22640 | 469560 | 37882 |
| TUBB4A | 104833 | 601152 | 22641 | 471320 | 37883 |
| TUBB4A | 104833 | 598006 | 22642 | 472795 | 37884 |
| TUBB4A | 104833 | 596291 | 22643 | 471880 | 3 /885 |
| TUBB4A | 104833 | 597686 | 22644 | 472375 | 37886 |
| TUBB4A | 104833 | 596926 | 22645 | 468843 | 37887 |
| TUBB4A | 104833 | 594290 | 22646 | 471503 | 37888 |
| TUBB4A | 104833 | 601640 | 22647 | 469660 | 37889 |
| TUBB4A | 104833 | 598635 | 22648 | 470627 | 37890 |
| TULP3 | 078246 | 540184 | 22649 | 444110 | 37891 |
| TULP3 | 078246 | 544943 | 22650 | 442631 | 37892 |
| TULP3 | 078246 | 538354 | 22651 | 437899 | 37893 |
| TULP3 | 078246 | 545331 | 22652 | 441599 | 37894 |
| TULP3 | 078246 | 448120 | 22653 | 410051 | 37895 |
| TULP3 | 078246 | 397132 | 22654 | 380321 | 37896 |
| TULP3 | 078246 | 541678 | 22655 | 441319 | 37897 |
| TULP3 | 078246 | 538704 | 22656 | 440364 | 37898 |
| TUNAR | 250366 | 504119 | 22657 | N/A | |
| TUNAR | 250366 | 503525 | 22658 | 489624 | 37899 |
| TUNAR | 250366 | 554321 | 22659 | 490254 | 37900 |
| TUSC3 | 104723 | 503191 | 22660 | N/A | |
| TUSC3 | 104723 | 382020 | 22661 | 371450 | 37901 |
| TUSC3 | 104723 | 515859 | 22662 | 420829 | 37902 |
| TUSC3 | 104723 | 506802 | 22663 | 425777 | 37903 |
| TUSC3 | 104723 | 510836 | 22664 | 426973 | 37904 |
| TUSC3 | 104723 | 509380 | 22665 | 423426 | 37905 |
| TUSC3 | 104723 | 503731 | 22666 | 424544 | 37906 |
| TUSC3 | 104723 | 507400 | 22667 | N/A | |
| TUSC3 | 104723 | 509177 | 22668 | N/A | |
| TUSC3 | 104723 | 511783 | 22669 | 426880 | 37907 |
| TUSC3 | 104723 | 508446 | 22670 | N/A | |
| TUSC3 | 104723 | 507316 | 22671 | N/A | |
| TUSC3 | 104723 | 511342 | 22672 | N/A | |
| TWISTNB | 105849 | 222567 | 22673 | 222567 | 37908 |
| TWISTNB | 105849 | 462263 | 22674 | N/A | |
| TXLNGY | 131002 | 407724 | 22675 | N/A | |
| TXLNGY | 131002 | 459719 | 22676 | N/A | |
| TXLNGY | 131002 | 447520 | 22677 | N/A | |
| TXLNGY | 131002 | 445715 | 22678 | N/A | |
| TXLNGY | 131002 | 538014 | 22679 | N/A | |
| TXLNGY | 131002 | 447202 | 22680 | N/A | |
| TXLNGY | 131002 | 588613 | 22681 | N/A | |
| TXLNGY | 131002 | 589075 | 22682 | N/A | |
| TXLNGY | 131002 | 585549 | 22683 | N/A | |
| TXLNGY | 131002 | 587095 | 22684 | N/A | |
| TXLNGY | 131002 | 488280 | 22685 | N/A | |
| TXLNGY | 131002 | 253320 | 22686 | N/A | |
| TXLNGY | 131002 | 593000 | 22687 | N/A | |
| TXLNGY | 131002 | 592697 | 22688 | N/A | |
| TXNIP | 265972 | 582401 | 22689 | 462521 | 37909 |
| TXNIP | 265972 | 488537 | 22690 | N/A | |
| TXNIP | 265972 | 486597 | 22691 | N/A | |
| TXNIP | 265972 | 425134 | 22692 | 396322 | 37910 |
| TXNL4A | 141759 | 269601 | 22693 | 269601 | 37911 |
| TXNL4A | 141759 | 585474 | 22694 | 465572 | 37912 |
| TXNL4A | 141759 | 588162 | 22695 | 465321 | 37913 |
| TXNL4A | 141759 | 592957 | 22696 | 465493 | 37914 |
| TXNL4A | 141759 | 355491 | 22697 | 347678 | 37915 |
| TXNL4A | 141759 | 585769 | 22698 | 466266 | 37916 |
| TXNL4A | 141759 | 586612 | 22699 | N/A | |
| TXNL4A | 141759 | 592837 | 22700 | 468761 | 37917 |
| TXNL4A | 141759 | 591711 | 22701 | 468493 | 37918 |
| TXNL4A | 141759 | 586825 | 22702 | 467304 | 37919 |
| TXNL4A | 141759 | 586295 | 22703 | 466694 | 37920 |

| Symbol | ENSG | ENST | SEQ ID | ENSP | SEQ ID |
|---|---|---|---|---|---|
| TXNL4A | 141759 | 589926 | 22704 | N/A | |
| TYMS | 176890 | 323274 | 22705 | 315644 | 37921 |
| TYMS | 176890 | 579128 | 22706 | N/A | |
| TYMS | 176890 | 323250 | 22707 | 314902 | 37922 |
| TYMS | 176890 | 323224 | 22708 | 314727 | 37923 |
| TYMS | 176890 | 584122 | 22709 | N/A | |
| TYMS | 176890 | 581920 | 22710 | N/A | |
| U2AF1 | 160201 | 471250 | 22711 | N/A | |
| U2AF1 | 160201 | 478282 | 22712 | N/A | |
| U2AF1 | 160201 | 459639 | 22713 | 418705 | 37924 |
| U2AF1 | 160201 | 464750 | 22714 | 420672 | 37925 |
| U2AF1 | 160201 | 475639 | 22715 | N/A | |
| U2AF1 | 160201 | 380276 | 22716 | 369629 | 37926 |
| U2AF1 | 160201 | 291552 | 22717 | 291552 | 37927 |
| U2AF1 | 160201 | 486519 | 22718 | 489632 | 37928 |
| U2AF1 | 160201 | 463599 | 22719 | N/A | |
| U2AF1 | 160201 | 496462 | 22720 | N/A | |
| U2AF1 | 160201 | 468039 | 22721 | N/A | |
| U2AF1 | 160201 | 398137 | 22722 | 381205 | 37929 |
| UAP1 | 117143 | 367926 | 22723 | 356903 | 37930 |
| UAP1 | 117143 | 476240 | 22724 | N/A | |
| UAP1 | 117143 | 367925 | 22725 | 356902 | 37931 |
| UAP1 | 117143 | 367924 | 22726 | 356901 | 37932 |
| UAP1 | 117143 | 474728 | 22727 | N/A | |
| UAP1 | 117143 | 486089 | 22728 | N/A | |
| UAP1 | 117143 | 271469 | 22729 | 271469 | 37933 |
| UBASH3B | 154127 | 284273 | 22730 | 284273 | 37934 |
| UBASH3B | 154127 | 525711 | 22731 | N/A | |
| UBASH3B | 154127 | 526386 | 22732 | N/A | |
| UBASH3B | 154127 | 530917 | 22733 | N/A | |
| UBASH3B | 154127 | 533451 | 22734 | N/A | |
| UBASH3B | 154127 | 529998 | 22735 | N/A | |
| UBASH3B | 154127 | 526493 | 22736 | N/A | |
| UBASH3B | 154127 | 530578 | 22737 | N/A | |
| UBB | 170315 | 577958 | 22738 | 464594 | 37935 |
| UBB | 170315 | 302182 | 22739 | 304697 | 37936 |
| UBB | 170315 | 577640 | 22740 | 463156 | 37937 |
| UBB | 170315 | 535788 | 22741 | 437475 | 37938 |
| UBB | 170315 | 578649 | 22742 | N/A | |
| UBB | 170315 | 395839 | 22743 | 379180 | 37939 |
| UBB | 170315 | 395837 | 22744 | 379178 | 37940 |
| UBB | 170315 | 578706 | 22745 | 464510 | 37941 |
| UBB | 170315 | 614404 | 22746 | 478771 | 37942 |
| UBC | 150991 | 536769 | 22747 | 441543 | 37943 |
| UBC | 150991 | 538617 | 22748 | 443053 | 37944 |
| UBC | 150991 | 339647 | 22749 | 344818 | 37945 |
| UBC | 150991 | 541272 | 22750 | 440205 | 37946 |
| UBC | 150991 | 540351 | 22751 | 442800 | 37947 |
| UBC | 150991 | 541645 | 22752 | 445337 | 37948 |
| UBC | 150991 | 535131 | 22753 | 439492 | 37949 |
| UBC | 150991 | 544481 | 22754 | N/A | |
| UBC | 150991 | 546271 | 22755 | 438289 | 37950 |
| UBC | 150991 | 540700 | 22756 | 441238 | 37951 |
| UBC | 150991 | 535859 | 22757 | 437452 | 37952 |
| UBC | 150991 | 536661 | 22758 | N/A | |
| UBC | 150991 | 542416 | 22759 | 441556 | 37953 |
| UBC | 150991 | 546120 | 22760 | 438394 | 37954 |
| UBE2B | 119048 | 265339 | 22761 | 265339 | 37955 |
| UBE2B | 119048 | 510021 | 22762 | 425237 | 37956 |
| UBE2B | 119048 | 511807 | 22763 | N/A | |
| UBE2B | 119048 | 506787 | 22764 | 426364 | 37957 |
| UBE2B | 119048 | 507277 | 22765 | 425137 | 37958 |
| UBE2B | 119048 | 504431 | 22766 | N/A | |
| UBE2B | 119048 | 499038 | 22767 | N/A | |
| UBE2B | 119048 | 503080 | 22768 | N/A | |
| UBE2QL1 | 215218 | 399816 | 22769 | 382713 | 37959 |
| UBE4A | 110344 | 252108 | 22770 | 252108 | 37960 |
| UBE4A | 110344 | 431736 | 22771 | 387362 | 37961 |
| UBE4A | 110344 | 545354 | 22772 | 438918 | 37962 |
| UCP2 | 175567 | 310473 | 22773 | 312029 | 37963 |
| UCP2 | 175567 | 536983 | 22774 | 441147 | 37964 |
| UCP2 | 175567 | 544615 | 22775 | 439951 | 37965 |
| UCP2 | 175567 | 545212 | 22776 | 439706 | 37966 |
| UCP2 | 175567 | 545562 | 22777 | N/A | |
| UCP2 | 175567 | 543714 | 22778 | N/A | |
| UCP2 | 175567 | 539764 | 22779 | 438230 | 37967 |

-continued

-continued

| Symbol | ENSG | ENST | SEQ ID | ENSP | SEQ ID |
|---|---|---|---|---|---|
| UCP2 | 175567 | 542615 | 22780 | N/A | |
| UCP2 | 175567 | 541027 | 22781 | N/A | |
| UCP2 | 175567 | 539330 | 22782 | N/A | |
| UFL1 | 014123 | 461673 | 22783 | N/A | |
| UFL1 | 014123 | 369278 | 22784 | 358283 | 37968 |
| UFSP2 | 109775 | 514247 | 22785 | 423599 | 37969 |
| UFSP2 | 109775 | 264689 | 22786 | 264689 | 37970 |
| UFSP2 | 109775 | 510206 | 22787 | N/A | |
| UFSP2 | 109775 | 510755 | 22788 | 421133 | 37971 |
| UFSP2 | 109775 | 511485 | 22789 | 425855 | 37972 |
| UFSP2 | 109775 | 509180 | 22790 | 423657 | 37973 |
| UFSP2 | 109775 | 502428 | 22791 | 424419 | 37974 |
| UFSP2 | 109775 | 502282 | 22792 | N/A | |
| UFSP2 | 109775 | 505357 | 22793 | 423108 | 37975 |
| UGGT2 | 102595 | 376747 | 22794 | 365938 | 37976 |
| UGGT2 | 102595 | 462472 | 22795 | N/A | |
| UGGT2 | 102595 | 476866 | 22796 | N/A | |
| UGGT2 | 102595 | 491509 | 22797 | N/A | |
| UGGT2 | 102595 | 463054 | 22798 | N/A | |
| UGGT2 | 102595 | 465196 | 22799 | N/A | |
| UGGT2 | 102595 | 461329 | 22800 | N/A | |
| UGGT2 | 102595 | 467305 | 22801 | N/A | |
| UGGT2 | 102595 | 376712 | 22802 | 365902 | 37977 |
| UGGT2 | 102595 | 376714 | 22803 | 365904 | 37978 |
| UGGT2 | 102595 | 621375 | 22804 | 482021 | 37979 |
| UGGT2 | 102595 | 397618 | 22805 | 380743 | 37980 |
| UGGT2 | 102595 | 638479 | 22806 | 491729 | 37981 |
| UGT8 | 174607 | 310836 | 22807 | 311648 | 37982 |
| UGT8 | 174607 | 507710 | 22808 | 421446 | 37983 |
| UGT8 | 174607 | 394511 | 22809 | 378019 | 37984 |
| UNC13C | 137766 | 260323 | 22810 | 260323 | 37985 |
| UNC13C | 137766 | 561210 | 22811 | N/A | |
| UNC13C | 137766 | 559093 | 22812 | 453018 | 37986 |
| UNC13C | 137766 | 539562 | 22813 | 443886 | 37987 |
| UNC13C | 137766 | 560537 | 22814 | 456450 | 37988 |
| UNC5B | 107731 | 335350 | 22815 | 334329 | 37989 |
| UNC5B | 107731 | 373192 | 22816 | 362288 | 37990 |
| UNC5D | 156687 | 404895 | 22817 | 385143 | 37991 |
| UNC5D | 156687 | 420357 | 22818 | 392739 | 37992 |
| UNC5D | 156687 | 287272 | 22819 | 287272 | 37993 |
| UNC5D | 156687 | 416672 | 22820 | 412652 | 37994 |
| UNC5D | 156687 | 453357 | 22821 | 394303 | 37995 |
| UNC5D | 156687 | 474634 | 22822 | N/A | |
| UNC5D | 156687 | 449677 | 22823 | 397211 | 37996 |
| UNC80 | 144406 | 478701 | 22824 | N/A | |
| UNC80 | 144406 | 272845 | 22825 | 272845 | 37997 |
| UNC80 | 144406 | 489023 | 22826 | N/A | |
| UNC80 | 144406 | 477301 | 22827 | N/A | |
| UNC80 | 144406 | 481494 | 22828 | N/A | |
| UNC80 | 144406 | 333907 | 22829 | 335576 | 37998 |
| UNC80 | 144406 | 477924 | 22830 | N/A | |
| UNC80 | 144406 | 439458 | 22831 | 391088 | 37999 |
| UNCX | 164853 | 316333 | 22832 | 314480 | 38000 |
| UPP1 | 183696 | 416681 | 22833 | 405209 | 38001 |
| UPP1 | 183696 | 331803 | 22834 | 330032 | 38002 |
| UPP1 | 183696 | 432131 | 22835 | 387607 | 38003 |
| UPP1 | 183696 | 457596 | 22836 | 408899 | 38004 |
| UPP1 | 183696 | 421016 | 22837 | 414963 | 38005 |
| UPP1 | 183696 | 395564 | 22838 | 378931 | 38006 |
| UPP1 | 183696 | 436673 | 22839 | 390118 | 38007 |
| UPP1 | 183696 | 395560 | 22840 | 378927 | 38008 |
| UPP1 | 183696 | 444999 | 22841 | 396820 | 38009 |
| UPP1 | 183696 | 482015 | 22842 | N/A | |
| UPP1 | 183696 | 417464 | 22843 | 413611 | 38010 |
| UPP1 | 183696 | 495446 | 22844 | N/A | |
| USP11 | 102226 | 377107 | 22845 | 366311 | 38011 |
| USP11 | 102226 | 478596 | 22846 | N/A | |
| USP11 | 102226 | 469080 | 22847 | N/A | |
| USP11 | 102226 | 377080 | 22848 | 366282 | 38012 |
| USP11 | 102226 | 377078 | 22849 | 366279 | 38013 |
| USP11 | 102226 | 489111 | 22850 | N/A | |
| USP11 | 102226 | 489030 | 22851 | N/A | |
| USP11 | 102226 | 480104 | 22852 | N/A | |
| USP11 | 102226 | 488848 | 22853 | N/A | |
| USP11 | 102226 | 497179 | 22854 | N/A | |
| USP11 | 102226 | 467378 | 22855 | N/A | |

| Symbol | ENSG | ENST | SEQ ID | ENSP | SEQ ID |
|---|---|---|---|---|---|
| USP11 | 102226 | 218348 | 22856 | 218348 | 38014 |
| USP28 | 048028 | 003302 | 22857 | 003302 | 38015 |
| USP28 | 048028 | 544967 | 22858 | 442431 | 38016 |
| USP28 | 048028 | 545540 | 22859 | 444991 | 38017 |
| USP28 | 048028 | 544272 | 22860 | N/A | |
| USP28 | 048028 | 540438 | 22861 | 441513 | 38018 |
| USP28 | 048028 | 538224 | 22862 | 440260 | 38019 |
| USP28 | 048028 | 538475 | 22863 | 442257 | 38020 |
| USP28 | 048028 | 537706 | 22864 | 445743 | 38021 |
| USP28 | 048028 | 545608 | 22865 | 438050 | 38022 |
| USP28 | 048028 | 535607 | 22866 | 437688 | 38023 |
| USP28 | 048028 | 537490 | 22867 | 445722 | 38024 |
| USP28 | 048028 | 537642 | 22868 | 440799 | 38025 |
| USP28 | 048028 | 542033 | 22869 | N/A | |
| USP28 | 048028 | 540925 | 22870 | 446284 | 38026 |
| USP28 | 048028 | 544750 | 22871 | 437450 | 38027 |
| USP37 | 135913 | 258399 | 22872 | 258399 | 38028 |
| USP37 | 135913 | 454775 | 22873 | 393662 | 38029 |
| USP37 | 135913 | 415516 | 22874 | 400902 | 38030 |
| USP37 | 135913 | 418019 | 22875 | 396585 | 38031 |
| USP37 | 135913 | 473554 | 22876 | N/A | |
| USP37 | 135913 | 484018 | 22877 | N/A | |
| USP37 | 135913 | 475553 | 22878 | N/A | |
| USP37 | 135913 | 466523 | 22879 | N/A | |
| USP37 | 135913 | 486242 | 22880 | N/A | |
| USP37 | 135913 | 478329 | 22881 | N/A | |
| USP37 | 135913 | 338465 | 22882 | 345043 | 38032 |
| USP4 | 114316 | 351842 | 22883 | 341028 | 38033 |
| USP4 | 114316 | 265560 | 22884 | 265560 | 38034 |
| USP4 | 114316 | 483212 | 22885 | N/A | |
| USP4 | 114316 | 485450 | 22886 | N/A | |
| USP4 | 114316 | 431357 | 22887 | 399079 | 38035 |
| USP4 | 114316 | 475873 | 22888 | N/A | |
| USP4 | 114316 | 486549 | 22889 | N/A | |
| USP4 | 114316 | 488520 | 22890 | N/A | |
| USP4 | 114316 | 461553 | 22891 | N/A | |
| USP4 | 114316 | 416417 | 22892 | 400623 | 38036 |
| USP4 | 114316 | 415188 | 22893 | 408274 | 38037 |
| USP4 | 114316 | 462673 | 22894 | N/A | |
| USP4 | 114316 | 464168 | 22895 | N/A | |
| USP4 | 114316 | 491791 | 22896 | N/A | |
| USP43 | 154914 | 570827 | 22897 | N/A | |
| USP43 | 154914 | 570475 | 22898 | 458963 | 38038 |
| USP43 | 154914 | 285199 | 22899 | 285199 | 38039 |
| USP43 | 154914 | 574408 | 22900 | 459328 | 38040 |
| USP43 | 154914 | 575346 | 22901 | N/A | |
| USP43 | 154914 | 573955 | 22902 | 477318 | 38041 |
| USP9Y | 114374 | 338981 | 22903 | 342812 | 38042 |
| USP9Y | 114374 | 493168 | 22904 | N/A | |
| USP9Y | 114374 | 426564 | 22905 | N/A | |
| USP9Y | 114374 | 453031 | 22906 | 406876 | 38043 |
| USP9Y | 114374 | 471409 | 22907 | N/A | |
| USPL1 | 132952 | 465952 | 22908 | N/A | |
| USPL1 | 132952 | 255304 | 22909 | 255304 | 38044 |
| USPL1 | 132952 | 614860 | 22910 | 480656 | 38045 |
| UTY | 183878 | 331397 | 22911 | 328939 | 38046 |
| UTY | 183878 | 624098 | 22912 | 485539 | 38047 |
| UTY | 183878 | 362096 | 22913 | 355420 | 38048 |
| UTY | 183878 | 329134 | 22914 | 330446 | 38049 |
| UTY | 183878 | 478900 | 22915 | N/A | |
| UTY | 183878 | 474365 | 22916 | N/A | |
| UTY | 183878 | 382893 | 22917 | 372349 | 38050 |
| UTY | 183878 | 479713 | 22918 | N/A | |
| UTY | 183878 | 538878 | 22919 | 445274 | 38051 |
| UTY | 183878 | 540140 | 22920 | 441943 | 38052 |
| UTY | 183878 | 382896 | 22921 | 372352 | 38053 |
| UTY | 183878 | 537580 | 22922 | 439922 | 38054 |
| UTY | 183878 | 545955 | 22923 | 442047 | 38055 |
| UTY | 183878 | 617789 | 22924 | 483735 | 38056 |
| UTY | 183878 | 618474 | 22925 | 484698 | 38057 |
| UTY | 183878 | 612274 | 22926 | 485013 | 38058 |
| SLC18A3 | 187714 | 374115 | 22927 | 363229 | 38059 |
| VAMP1 | 139190 | 400911 | 22928 | 383702 | 38060 |
| VAMP1 | 139190 | 361716 | 22929 | 355122 | 38061 |
| VAMP1 | 139190 | 544432 | 22930 | N/A | |
| VAMP1 | 139190 | 535180 | 22931 | 444181 | 38062 |

-continued

| Symbol | ENSG | ENST | SEQ ID | ENSP | SEQ ID |
|---|---|---|---|---|---|
| VAMP1 | 139190 | 396308 | 22932 | 379602 | 38063 |
| VAMP1 | 139190 | 538970 | 22933 | N/A | |
| VAMP1 | 139190 | 535927 | 22934 | N/A | |
| VAMP1 | 139190 | 539047 | 22935 | N/A | |
| VAT1L | 171724 | 302536 | 22936 | 303129 | 38064 |
| VAT1L | 171724 | 563850 | 22937 | N/A | |
| VAV2 | 160293 | 406606 | 22938 | 385362 | 38065 |
| VAV2 | 160293 | 371850 | 22939 | 360916 | 38066 |
| VAV2 | 160293 | 371851 | 22940 | 360917 | 38067 |
| VAV2 | 160293 | 486113 | 22941 | N/A | |
| VAV2 | 160293 | 472905 | 22942 | N/A | |
| VAX2 | 116035 | 234392 | 22943 | 234392 | 38068 |
| VCAN | 038427 | 265077 | 22944 | 265077 | 38069 |
| VCAN | 038427 | 503923 | 22945 | N/A | |
| VCAN | 038427 | 512590 | 22946 | 425959 | 38070 |
| VCAN | 038427 | 513960 | 22947 | 426251 | 38071 |
| VCAN | 038427 | 513984 | 22948 | 426715 | 38072 |
| VCAN | 038427 | 502527 | 22949 | 421362 | 38073 |
| VCAN | 038427 | 515397 | 22950 | N/A | |
| VCAN | 038427 | 513016 | 22951 | N/A | |
| VCAN | 038427 | 507162 | 22952 | N/A | |
| VCAN | 038427 | 505615 | 22953 | N/A | |
| VCAN | 038427 | 342785 | 22954 | 342768 | 38074 |
| VCAN | 038427 | 343200 | 22955 | 340062 | 38075 |
| VGLL4 | 144560 | 273038 | 22956 | 273038 | 38076 |
| VGLL4 | 144560 | 413604 | 22957 | 404624 | 38077 |
| VGLL4 | 144560 | 451674 | 22958 | 416615 | 38078 |
| VGLL4 | 144560 | 424529 | 22959 | 402878 | 38079 |
| VGLL4 | 144560 | 430365 | 22960 | 404251 | 38080 |
| VGLL4 | 144560 | 426568 | 22961 | 413030 | 38081 |
| VGLL4 | 144560 | 445411 | 22962 | 412923 | 38082 |
| VGLL4 | 144560 | 418000 | 22963 | 394439 | 38083 |
| VGLL4 | 144560 | 458499 | 22964 | 394123 | 38084 |
| VGLL4 | 144560 | 417206 | 22965 | 391932 | 38085 |
| VGLL4 | 144560 | 417466 | 22966 | 411670 | 38086 |
| VGLL4 | 144560 | 424709 | 22967 | 391554 | 38087 |
| VGLL4 | 144560 | 419541 | 22968 | 395557 | 38088 |
| VGLL4 | 144560 | 437722 | 22969 | 393100 | 38089 |
| VGLL4 | 144560 | 623028 | 22970 | 485472 | 38090 |
| VGLL4 | 144560 | 480288 | 22971 | N/A | |
| VGLL4 | 144560 | 463387 | 22972 | N/A | |
| VGLL4 | 144560 | 414047 | 22973 | N/A | |
| VGLL4 | 144560 | 638314 | 22974 | 492281 | 38091 |
| VIM | 026025 | 544301 | 22975 | 446007 | 38092 |
| VIM | 026025 | 478746 | 22976 | 489830 | 38093 |
| VIM | 026025 | 497849 | 22977 | 490509 | 38094 |
| VIM | 026025 | 224237 | 22978 | 224237 | 38095 |
| VIM | 026025 | 487938 | 22979 | 435613 | 38096 |
| VIM | 026025 | 485947 | 22980 | N/A | |
| VIM | 026025 | 469543 | 22981 | 431702 | 38097 |
| VIM | 026025 | 421459 | 22982 | N/A | |
| VIM | 026025 | 637053 | 22983 | N/A | |
| VIM | 026025 | 495528 | 22984 | N/A | |
| VIP | 146469 | 367244 | 22985 | 356213 | 38098 |
| VIP | 146469 | 367243 | 22986 | 356212 | 38099 |
| VIP | 146469 | 431366 | 22987 | 410536 | 38100 |
| VIPR2 | 106018 | 262178 | 22988 | 262178 | 38101 |
| VIPR2 | 106018 | 377633 | 22989 | 366860 | 38102 |
| VIPR2 | 106018 | 402066 | 22990 | 384497 | 38103 |
| VIPR2 | 106018 | 421760 | 22991 | 402690 | 38104 |
| VIT | 205221 | 379242 | 22992 | 368544 | 38105 |
| VIT | 205221 | 457137 | 22993 | 393561 | 38106 |
| VIT | 205221 | 497382 | 22994 | 417874 | 38107 |
| VIT | 205221 | 404084 | 22995 | 384154 | 38108 |
| VIT | 205221 | 379241 | 22996 | 368543 | 38109 |
| VIT | 205221 | 401530 | 22997 | 385658 | 38110 |
| VIT | 205221 | 464309 | 22998 | 419251 | 38111 |
| VIT | 205221 | 389975 | 22999 | 374625 | 38112 |
| VMP1 | 062716 | 588915 | 23000 | N/A | |
| VMP1 | 062716 | 262291 | 23001 | 262291 | 38113 |
| VMP1 | 062716 | 593168 | 23002 | 465972 | 38114 |
| VMP1 | 062716 | 586245 | 23003 | 466579 | 38115 |
| VMP1 | 062716 | 585847 | 23004 | 465947 | 38116 |
| VMP1 | 062716 | 587945 | 23005 | 466413 | 38117 |
| VMP1 | 062716 | 588131 | 23006 | N/A | |
| VMP1 | 062716 | 589823 | 23007 | 466198 | 38118 |

-continued

| Symbol | ENSG | ENST | SEQ ID | ENSP | SEQ ID |
|---|---|---|---|---|---|
| VMP1 | 062716 | 592106 | 23008 | 467093 | 38119 |
| VMP1 | 062716 | 591315 | 23009 | 466511 | 38120 |
| VMP1 | 062716 | 587259 | 23010 | 465397 | 38121 |
| VMP1 | 062716 | 592619 | 23011 | 465911 | 38122 |
| VMP1 | 062716 | 591877 | 23012 | 467350 | 38123 |
| VMP1 | 062716 | 591782 | 23013 | N/A | |
| VMP1 | 062716 | 588617 | 23014 | N/A | |
| VMP1 | 062716 | 592790 | 23015 | N/A | |
| VMP1 | 062716 | 587470 | 23016 | N/A | |
| VPS37B | 139722 | 267202 | 23017 | 267202 | 38124 |
| VPS37B | 139722 | 535765 | 23018 | 446075 | 38125 |
| VPS37B | 139722 | 371248 | 23019 | 360294 | 38126 |
| VPS37B | 139722 | 543590 | 23020 | N/A | |
| VSIG2 | 019102 | 326621 | 23021 | 318684 | 38127 |
| VSIG2 | 019102 | 403470 | 23022 | 385013 | 38128 |
| VSIG8 | 243284 | 368100 | 23023 | 357080 | 38129 |
| VSNL1 | 163032 | 404666 | 23024 | 384014 | 38130 |
| VSNL1 | 163032 | 457525 | 23025 | 405511 | 38131 |
| VSNL1 | 163032 | 295156 | 23026 | 295156 | 38132 |
| VSNL1 | 163032 | 451533 | 23027 | 390124 | 38133 |
| VSNL1 | 163032 | 483921 | 23028 | N/A | |
| VSNL1 | 163032 | 406397 | 23029 | 384719 | 38134 |
| VSTM2B | 187135 | 335523 | 23030 | 335038 | 38135 |
| VTN | 109072 | 226218 | 23031 | 226218 | 38136 |
| VTN | 109072 | 539746 | 23032 | N/A | |
| VTN | 109072 | 542029 | 23033 | 440439 | 38137 |
| VWA5A | 110002 | 456829 | 23034 | 407726 | 38138 |
| VWA5A | 110002 | 361352 | 23035 | 355070 | 38139 |
| VWA5A | 110002 | 449321 | 23036 | 404683 | 38140 |
| VWA5A | 110002 | 392744 | 23037 | 376501 | 38141 |
| VWA5A | 110002 | 533623 | 23038 | N/A | |
| VWA5A | 110002 | 392748 | 23039 | 376504 | 38142 |
| VWA5B2 | 145198 | 426955 | 23040 | 398688 | 38143 |
| VWA5B2 | 145198 | 497229 | 23041 | N/A | |
| VWA5B2 | 145198 | 273794 | 23042 | 273794 | 38144 |
| VWA5B2 | 145198 | 461141 | 23043 | N/A | |
| VWA5B2 | 145198 | 474580 | 23044 | N/A | |
| VWA5B2 | 145198 | 493493 | 23045 | N/A | |
| VWC2 | 188730 | 340652 | 23046 | 341819 | 38145 |
| WASH7P | 227232 | 488147 | 23047 | N/A | |
| GALNT17 | 185274 | 333538 | 23048 | 329654 | 38146 |
| GALNT17 | 185274 | 498380 | 23049 | N/A | |
| GALNT17 | 185274 | 447516 | 23050 | 392019 | 38147 |
| GALNT17 | 185274 | 467723 | 23051 | N/A | |
| GALNT17 | 185274 | 618959 | 23052 | 479090 | 38148 |
| TMEM270 | 175877 | 320531 | 23053 | 316775 | 38149 |
| TMEM270 | 175877 | 426490 | 23054 | 403621 | 38150 |
| WDR17 | 150627 | 508596 | 23055 | 422763 | 38151 |
| WDR17 | 150627 | 509792 | 23056 | N/A | |
| WDR17 | 150627 | 280190 | 23057 | 280190 | 38152 |
| WDR17 | 150627 | 507824 | 23058 | 422200 | 38153 |
| WDR17 | 150627 | 513261 | 23059 | 427502 | 38154 |
| WDR17 | 150627 | 505894 | 23060 | 426847 | 38155 |
| WDR17 | 150627 | 443118 | 23061 | 426985 | 38156 |
| WDR17 | 150627 | 508773 | 23062 | N/A | |
| WDR45B | 141580 | 392325 | 23063 | 376139 | 38157 |
| WDR45B | 141580 | 572583 | 23064 | 461488 | 38158 |
| WDR45B | 141580 | 576517 | 23065 | 460297 | 38159 |
| WDR45B | 141580 | 573656 | 23066 | N/A | |
| WDR45B | 141580 | 571835 | 23067 | N/A | |
| WDR45B | 141580 | 573616 | 23068 | 458738 | 38160 |
| WDR45B | 141580 | 577774 | 23069 | N/A | |
| WDR45B | 141580 | 571767 | 23070 | N/A | |
| WDR45B | 141580 | 571817 | 23071 | 461355 | 38161 |
| WDR45B | 141580 | 574828 | 23072 | N/A | |
| WDR49 | 174776 | 308378 | 23073 | 311343 | 38162 |
| WDR49 | 174776 | 476376 | 23074 | N/A | |
| WDR49 | 174776 | 472600 | 23075 | 419130 | 38163 |
| WDR49 | 174776 | 479765 | 23076 | 419749 | 38164 |
| WDR49 | 174776 | 493061 | 23077 | 418539 | 38165 |
| WDR49 | 174776 | 460448 | 23078 | 417090 | 38166 |
| WDR49 | 174776 | 466760 | 23079 | 418718 | 38167 |
| WDR49 | 174776 | 488012 | 23080 | 419917 | 38168 |
| WDR49 | 174776 | 471198 | 23081 | N/A | |
| WDR66 | 158023 | 288912 | 23082 | 288912 | 38169 |
| WDR66 | 158023 | 397454 | 23083 | 380595 | 38170 |

-continued

| Symbol | ENSG | ENST | SEQ ID | ENSP | SEQ ID |
|---|---|---|---|---|---|
| WDR66 | 158023 | 540779 | 23084 | N/A | |
| WDR66 | 158023 | 546044 | 23085 | N/A | |
| WDR66 | 158023 | 543211 | 23086 | N/A | |
| WDR66 | 158023 | 535257 | 23087 | N/A | |
| WDR66 | 158023 | 545752 | 23088 | N/A | |
| WDR66 | 158023 | 428465 | 23089 | N/A | |
| WDR66 | 158023 | 545988 | 23090 | N/A | |
| WFDC1 | 103175 | 219454 | 23091 | 219454 | 38171 |
| WFDC1 | 103175 | 568638 | 23092 | 456920 | 38172 |
| WFDC1 | 103175 | 613603 | 23093 | 481580 | 38173 |
| WFDC1 | 103175 | 567056 | 23094 | N/A | |
| WFDC1 | 103175 | 622779 | 23095 | N/A | |
| WFS1 | 109501 | 503569 | 23096 | 423337 | 38174 |
| WFS1 | 109501 | 506588 | 23097 | N/A | |
| WFS1 | 109501 | 226760 | 23098 | 226760 | 38175 |
| WFS1 | 109501 | 507765 | 23099 | N/A | |
| WFS1 | 109501 | 506362 | 23100 | 424103 | 38176 |
| WFS1 | 109501 | 513395 | 23101 | N/A | |
| WIF1 | 156076 | 286574 | 23102 | 286574 | 38177 |
| WIF1 | 156076 | 543094 | 23103 | 439024 | 38178 |
| WIF1 | 156076 | 546001 | 23104 | 442063 | 38179 |
| WIPI1 | 070540 | 592645 | 23105 | 465695 | 38180 |
| WIPI1 | 070540 | 262139 | 23106 | 262139 | 38181 |
| WIPI1 | 070540 | 589459 | 23107 | N/A | |
| WIPI1 | 070540 | 589316 | 23108 | 465470 | 38182 |
| WIPI1 | 070540 | 585393 | 23109 | 465557 | 38183 |
| WIPI1 | 070540 | 546360 | 23110 | 437345 | 38184 |
| WIPI1 | 070540 | 590402 | 23111 | N/A | |
| WIPI1 | 070540 | 591744 | 23112 | 466270 | 38185 |
| WIPI1 | 070540 | 587731 | 23113 | N/A | |
| WIPI1 | 070540 | 591494 | 23114 | N/A | |
| WIPI1 | 070540 | 586815 | 23115 | N/A | |
| WLS | 116729 | 354777 | 23116 | 346829 | 38186 |
| WLS | 116729 | 262348 | 23117 | 262348 | 38187 |
| WLS | 116729 | 370976 | 23118 | 360015 | 38188 |
| WLS | 116729 | 498615 | 23119 | N/A | |
| WLS | 116729 | 491811 | 23120 | N/A | |
| WLS | 116729 | 497187 | 23121 | N/A | |
| WLS | 116729 | 534713 | 23122 | 431552 | 38189 |
| WLS | 116729 | 533537 | 23123 | 433690 | 38190 |
| WLS | 116729 | 530486 | 23124 | 433111 | 38191 |
| WLS | 116729 | 370973 | 23125 | 360012 | 38192 |
| WLS | 116729 | 471243 | 23126 | 436196 | 38193 |
| WLS | 116729 | 491076 | 23127 | 433188 | 38194 |
| WLS | 116729 | 527864 | 23128 | 433867 | 38195 |
| WLS | 116729 | 370971 | 23129 | 360010 | 38196 |
| WNT6 | 115596 | 233948 | 23130 | 233948 | 38197 |
| WNT6 | 115596 | 486233 | 23131 | N/A | |
| WNT7A | 154764 | 285018 | 23132 | 285018 | 38198 |
| WNT7A | 154764 | 489346 | 23133 | N/A | |
| WNT7A | 154764 | 497808 | 23134 | N/A | |
| WNT7B | 188064 | 339464 | 23135 | 341032 | 38199 |
| WNT7B | 188064 | 409496 | 23136 | 386546 | 38200 |
| WNT7B | 188064 | 410089 | 23137 | 386781 | 38201 |
| WNT7B | 188064 | 410058 | 23138 | 387217 | 38202 |
| WNT7B | 188064 | 428540 | 23139 | 392750 | 38203 |
| WSCD1 | 179314 | 563763 | 23140 | N/A | |
| WSCD1 | 179314 | 573619 | 23141 | 461865 | 38204 |
| WSCD1 | 179314 | 572764 | 23142 | N/A | |
| WSCD1 | 179314 | 574946 | 23143 | 460825 | 38205 |
| WSCD1 | 179314 | 573634 | 23144 | 460396 | 38206 |
| WSCD1 | 179314 | 576083 | 23145 | 460041 | 38207 |
| WSCD1 | 179314 | 574232 | 23146 | 458374 | 38208 |
| WSCD1 | 179314 | 571973 | 23147 | 458527 | 38209 |
| WSCD1 | 179314 | 576233 | 23148 | 461642 | 38210 |
| WSCD1 | 179314 | 571494 | 23149 | 458339 | 38211 |
| WSCD1 | 179314 | 576947 | 23150 | 460428 | 38212 |
| WSCD1 | 179314 | 317744 | 23151 | 323087 | 38213 |
| WSCD1 | 179314 | 539421 | 23152 | 446032 | 38214 |
| WSCD2 | 075035 | 547525 | 23153 | 448047 | 38215 |
| WSCD2 | 075035 | 552195 | 23154 | N/A | |
| WSCD2 | 075035 | 550529 | 23155 | N/A | |
| WSCD2 | 075035 | 551106 | 23156 | N/A | |
| WSCD2 | 075035 | 551638 | 23157 | 446744 | 38216 |
| WSCD2 | 075035 | 546401 | 23158 | N/A | |
| WSCD2 | 075035 | 332082 | 23159 | 331933 | 38217 |

| Symbol | ENSG | ENST | SEQ ID | ENSP | SEQ ID |
|---|---|---|---|---|---|
| WSCD2 | 075035 | 551057 | 23160 | N/A | |
| WSCD2 | 075035 | 551734 | 23161 | N/A | |
| WSCD2 | 075035 | 546811 | 23162 | N/A | |
| WSCD2 | 075035 | 549903 | 23163 | 447272 | 38218 |
| WSCD2 | 075035 | 547185 | 23164 | N/A | |
| WSCD2 | 075035 | 546629 | 23165 | N/A | |
| WWC1 | 113645 | 265293 | 23166 | 265293 | 38219 |
| WWC1 | 113645 | 521089 | 23167 | 427772 | 38220 |
| WWC1 | 113645 | 523043 | 23168 | N/A | |
| WWC1 | 113645 | 519859 | 23169 | N/A | |
| WWC1 | 113645 | 393895 | 23170 | 377473 | 38221 |
| WWC1 | 113645 | 519659 | 23171 | N/A | |
| WWC1 | 113645 | 517425 | 23172 | N/A | |
| WWC1 | 113645 | 524228 | 23173 | 429339 | 38222 |
| WWC1 | 113645 | 517646 | 23174 | N/A | |
| WWC1 | 113645 | 624315 | 23175 | N/A | |
| WWC1 | 113645 | 518334 | 23176 | N/A | |
| WWC1 | 113645 | 524093 | 23177 | N/A | |
| WWC1 | 113645 | 524038 | 23178 | 428084 | 38223 |
| WWC1 | 113645 | 522140 | 23179 | N/A | |
| WWC1 | 113645 | 521391 | 23180 | N/A | |
| WWC1 | 113645 | 518204 | 23181 | N/A | |
| WWC2 | 151718 | 403733 | 23182 | 384222 | 38224 |
| WWC2 | 151718 | 508614 | 23183 | 423238 | 38225 |
| WWC2 | 151718 | 513834 | 23184 | 425054 | 38226 |
| WWC2 | 151718 | 448232 | 23185 | 398577 | 38227 |
| WWC2 | 151718 | 427431 | 23186 | 393342 | 38228 |
| WWC2 | 151718 | 438543 | 23187 | 413521 | 38229 |
| WWC2 | 151718 | 504005 | 23188 | 427569 | 38230 |
| WWC2 | 151718 | 506225 | 23189 | N/A | |
| WWC2 | 151718 | 515284 | 23190 | N/A | |
| WWC2 | 151718 | 508747 | 23191 | 420835 | 38231 |
| XIST | 229807 | 434839 | 23192 | N/A | |
| XIST | 229807 | 421322 | 23193 | N/A | |
| XIST | 229807 | 417942 | 23194 | N/A | |
| XIST | 229807 | 416330 | 23195 | N/A | |
| XIST | 229807 | 429829 | 23196 | N/A | |
| XIST | 229807 | 635841 | 23197 | N/A | |
| XIST | 229807 | 433732 | 23198 | N/A | |
| XIST | 229807 | 602587 | 23199 | N/A | |
| XIST | 229807 | 445814 | 23200 | N/A | |
| XIST | 229807 | 602863 | 23201 | N/A | |
| XIST | 229807 | 602495 | 23202 | N/A | |
| XKR7 | 260903 | 562532 | 23203 | 477059 | 38232 |
| XRRA1 | 166435 | 530562 | 23204 | 436390 | 38233 |
| XRRA1 | 166435 | 340360 | 23205 | 339918 | 38234 |
| XRRA1 | 166435 | 321448 | 23206 | 319303 | 38235 |
| XRRA1 | 166435 | 531849 | 23207 | 433431 | 38236 |
| XRRA1 | 166435 | 531449 | 23208 | 432689 | 38237 |
| XRRA1 | 166435 | 527087 | 23209 | 435838 | 38238 |
| XRRA1 | 166435 | 431210 | 23210 | N/A | |
| XRRA1 | 166435 | 530280 | 23211 | N/A | |
| XRRA1 | 166435 | 529926 | 23212 | N/A | |
| XRRA1 | 166435 | 528819 | 23213 | N/A | |
| XRRA1 | 166435 | 525407 | 23214 | 437334 | 38239 |
| XRRA1 | 166435 | 528219 | 23215 | 435662 | 38240 |
| XRRA1 | 166435 | 526047 | 23216 | N/A | |
| XRRA1 | 166435 | 531852 | 23217 | 433940 | 38241 |
| XRRA1 | 166435 | 533598 | 23218 | N/A | |
| XRRA1 | 166435 | 534041 | 23219 | N/A | |
| XRRA1 | 166435 | 534798 | 23220 | N/A | |
| XRRA1 | 166435 | 529400 | 23221 | N/A | |
| XRRA1 | 166435 | 524430 | 23222 | N/A | |
| XRRA1 | 166435 | 533990 | 23223 | N/A | |
| XYLT1 | 103489 | 261381 | 23224 | 261381 | 38242 |
| XYLT1 | 103489 | 575674 | 23225 | N/A | |
| XYLT1 | 103489 | 568226 | 23226 | N/A | |
| XYLT1 | 103489 | 563403 | 23227 | N/A | |
| YBX2 | 006047 | 007699 | 23228 | 007699 | 38243 |
| YBX2 | 006047 | 571834 | 23229 | N/A | |
| YBX2 | 006047 | 571485 | 23230 | N/A | |
| YBX2 | 006047 | 571464 | 23231 | 459587 | 38244 |
| YBX2 | 006047 | 570720 | 23232 | N/A | |
| YBX2 | 006047 | 570627 | 23233 | N/A | |
| YBX2 | 006047 | 571127 | 23234 | N/A | |
| YES1 | 176105 | 577961 | 23235 | 464380 | 38245 |

| Symbol | ENSG | ENST | SEQ ID | ENSP | SEQ ID |
|---|---|---|---|---|---|
| YES1 | 176105 | 584307 | 23236 | 462468 | 38246 |
| YES1 | 176105 | 314574 | 23237 | 324740 | 38247 |
| YES1 | 176105 | 577611 | 23238 | N/A | |
| YES1 | 176105 | 581960 | 23239 | N/A | |
| YIPF5 | 145817 | 274496 | 23240 | 274496 | 38248 |
| YIPF5 | 145817 | 448443 | 23241 | 397704 | 38249 |
| YIPF5 | 145817 | 513112 | 23242 | 425422 | 38250 |
| YIPF5 | 145817 | 519064 | 23243 | 429777 | 38251 |
| YIPF5 | 145817 | 522203 | 23244 | 428715 | 38252 |
| YIPF5 | 145817 | 508754 | 23245 | N/A | |
| YIPF7 | 177752 | 415895 | 23246 | 412696 | 38253 |
| YIPF7 | 177752 | 510035 | 23247 | N/A | |
| YIPF7 | 177752 | 502794 | 23248 | N/A | |
| YIPF7 | 177752 | 508947 | 23249 | 477355 | 38254 |
| YIPF7 | 177752 | 332990 | 23250 | 332772 | 38255 |
| ZBTB16 | 109906 | 335953 | 23251 | 338157 | 38256 |
| ZBTB16 | 109906 | 541602 | 23252 | N/A | |
| ZBTB16 | 109906 | 544220 | 23253 | 437716 | 38257 |
| ZBTB16 | 109906 | 535700 | 23254 | 443013 | 38258 |
| ZBTB16 | 109906 | 392996 | 23255 | 376721 | 38259 |
| ZBTB16 | 109906 | 539918 | 23256 | 445047 | 38260 |
| ZBTB16 | 109906 | 545851 | 23257 | N/A | |
| ZBTB16 | 109906 | 535379 | 23258 | N/A | |
| ZBTB16 | 109906 | 535509 | 23259 | N/A | |
| ZBTB21 | 173276 | 398505 | 23260 | 381517 | 38261 |
| ZBTB21 | 173276 | 310826 | 23261 | 308759 | 38262 |
| ZBTB21 | 173276 | 398499 | 23262 | 381512 | 38263 |
| ZBTB21 | 173276 | 398511 | 23263 | 381523 | 38264 |
| ZBTB21 | 173276 | 465968 | 23264 | N/A | |
| ZBTB21 | 173276 | 425521 | 23265 | 387788 | 38265 |
| ZBTB21 | 173276 | 449949 | 23266 | 395186 | 38266 |
| ZBTB21 | 173276 | 398497 | 23267 | 381510 | 38267 |
| ZBTB46 | 130584 | 245663 | 23268 | 245663 | 38268 |
| ZBTB46 | 130584 | 460757 | 23269 | N/A | |
| ZBTB46 | 130584 | 480766 | 23270 | N/A | |
| ZBTB46 | 130584 | 302995 | 23271 | 303102 | 38269 |
| ZBTB46 | 130584 | 395104 | 23272 | 378536 | 38270 |
| RTL4 | 187823 | 340433 | 23273 | 340590 | 38271 |
| ZCCHC24 | 165424 | 372336 | 23274 | 361411 | 38272 |
| ZCCHC24 | 165424 | 372333 | 23275 | 361408 | 38273 |
| ZDHHC14 | 175048 | 414563 | 23276 | 410713 | 38274 |
| ZDHHC14 | 175048 | 359775 | 23277 | 352821 | 38275 |
| ZDHHC14 | 175048 | 518214 | 23278 | 428211 | 38276 |
| ZDHHC14 | 175048 | 523468 | 23279 | N/A | |
| ZDHHC14 | 175048 | 341375 | 23280 | N/A | |
| ZDHHC14 | 175048 | 340347 | 23281 | 345721 | 38277 |
| ZDHHC14 | 175048 | 523706 | 23282 | N/A | |
| ZDHHC14 | 175048 | 517432 | 23283 | N/A | |
| ZDHHC14 | 175048 | 422910 | 23284 | N/A | |
| ZDHHC2 | 104219 | 262096 | 23285 | 262096 | 38278 |
| ZDHHC2 | 104219 | 523132 | 23286 | 430804 | 38279 |
| ZDHHC2 | 104219 | 522184 | 23287 | 430317 | 38280 |
| ZDHHC2 | 104219 | 517334 | 23288 | N/A | |
| ZDHHC23 | 184307 | 330212 | 23289 | 330485 | 38281 |
| ZDHHC23 | 184307 | 498275 | 23290 | 417840 | 38282 |
| ZDHHC23 | 184307 | 478793 | 23291 | 420251 | 38283 |
| ZDHHC23 | 184307 | 491556 | 23292 | 420292 | 38284 |
| ZDHHC23 | 184307 | 638807 | 23293 | 492287 | 38285 |
| ZDHHC23 | 184307 | 488129 | 23294 | N/A | |
| ZDHHC23 | 184307 | 496083 | 23295 | 417579 | 38286 |
| ZEB2 | 169554 | 639389 | 23296 | 492572 | 38287 |
| ZEB2 | 169554 | 638087 | 23297 | 490673 | 38288 |
| ZEB2 | 169554 | 638007 | 23298 | 490723 | 38289 |
| ZEB2 | 169554 | 636413 | 23299 | 490508 | 38290 |
| ZEB2 | 169554 | 637045 | 23300 | 490141 | 38291 |
| ZEB2 | 169554 | 636820 | 23301 | N/A | |
| ZEB2 | 169554 | 636179 | 23302 | N/A | |
| ZEB2 | 169554 | 637304 | 23303 | 490872 | 38292 |
| ZEB2 | 169554 | 638128 | 23304 | 490934 | 38293 |
| ZEB2 | 169554 | 636471 | 23305 | 490317 | 38294 |
| ZEB2 | 169554 | 627532 | 23306 | 487174 | 38295 |
| ZEB2 | 169554 | 419938 | 23307 | 394777 | 38296 |
| ZEB2 | 169554 | 409487 | 23308 | 386854 | 38297 |
| ZEB2 | 169554 | 636732 | 23309 | 490175 | 38298 |
| ZEB2 | 169554 | 636026 | 23310 | 490776 | 38299 |
| ZEB2 | 169554 | 539609 | 23311 | 443792 | 38300 |

| Symbol | ENSG | ENST | SEQ ID | ENSP | SEQ ID |
|---|---|---|---|---|---|
| ZEB2 | 169554 | 558170 | 23312 | 454157 | 38301 |
| ZEB2 | 169554 | 303660 | 23313 | 302501 | 38302 |
| ZEB2 | 169554 | 637873 | 23314 | 489701 | 38303 |
| ZEB2 | 169554 | 427902 | 23315 | 395496 | 38304 |
| ZEB2 | 169554 | 637267 | 23316 | 490293 | 38305 |
| ZEB2 | 169554 | 392861 | 23317 | 376601 | 38306 |
| ZEB2 | 169554 | 497268 | 23318 | N/A | |
| ZEB2 | 169554 | 431672 | 23319 | 475267 | 38307 |
| ZEB2 | 169554 | 409211 | 23320 | 387256 | 38308 |
| ZEB2 | 169554 | 465308 | 23321 | 487476 | 38309 |
| ZEB2 | 169554 | 434448 | 23322 | 487261 | 38310 |
| ZEB2 | 169554 | 472146 | 23323 | N/A | |
| ZEB2 | 169554 | 461784 | 23324 | N/A | |
| ZEB2 | 169554 | 476394 | 23325 | N/A | |
| ZEB2 | 169554 | 479735 | 23326 | N/A | |
| ZEB2 | 169554 | 435831 | 23327 | 400993 | 38311 |
| ZEB2 | 169554 | 453352 | 23328 | N/A | |
| ZEB2 | 169554 | 444559 | 23329 | 399451 | 38312 |
| ZEB2 | 169554 | 630572 | 23330 | 486346 | 38313 |
| ZEB2 | 169554 | 628473 | 23331 | N/A | |
| ZEB2 | 169554 | 484313 | 23332 | 486341 | 38314 |
| ZEB2 | 169554 | 637591 | 23333 | N/A | |
| ZEB2 | 169554 | 629955 | 23334 | N/A | |
| ZEB2 | 169554 | 465070 | 23335 | 475502 | 38315 |
| ZEB2 | 169554 | 470879 | 23336 | 475329 | 38316 |
| ZEB2 | 169554 | 629520 | 23337 | 486240 | 38317 |
| ZEB2 | 169554 | 636445 | 23338 | 490851 | 38318 |
| ZEB2 | 169554 | 625161 | 23339 | N/A | |
| ZEB2 | 169554 | 462355 | 23340 | 475400 | 38319 |
| ZEB2 | 169554 | 475115 | 23341 | N/A | |
| ZEB2 | 169554 | 440875 | 23342 | 475553 | 38320 |
| ZFAND2A | 178381 | 401903 | 23343 | 386031 | 38321 |
| ZFAND2A | 178381 | 397083 | 23344 | 380273 | 38322 |
| ZFAND2A | 178381 | 316495 | 23345 | 314619 | 38323 |
| ZFAND2A | 178381 | 471448 | 23346 | N/A | |
| ZFAND2A | 178381 | 574135 | 23347 | 459173 | 38324 |
| ZFAND2A | 178381 | 484977 | 23348 | N/A | |
| ZFAND2A | 178381 | 478137 | 23349 | N/A | |
| ZFAND5 | 107372 | 488164 | 23350 | N/A | |
| ZFAND5 | 107372 | 376962 | 23351 | 366161 | 38325 |
| ZFAND5 | 107372 | 376960 | 23352 | 366159 | 38326 |
| ZFAND5 | 107372 | 343431 | 23353 | 350586 | 38327 |
| ZFAND5 | 107372 | 471197 | 23354 | N/A | |
| ZFAND5 | 107372 | 376956 | 23355 | 366155 | 38328 |
| ZFAND5 | 107372 | 487330 | 23356 | N/A | |
| ZFAND5 | 107372 | 237937 | 23357 | 237937 | 38329 |
| ZFAND6 | 086666 | 261749 | 23358 | 261749 | 38330 |
| ZFAND6 | 086666 | 561060 | 23359 | 452735 | 38331 |
| ZFAND6 | 086666 | 559157 | 23360 | 454152 | 38332 |
| ZFAND6 | 086666 | 561012 | 23361 | 453590 | 38333 |
| ZFAND6 | 086666 | 564367 | 23362 | 454273 | 38334 |
| ZFAND6 | 086666 | 558494 | 23363 | 454137 | 38335 |
| ZFAND6 | 086666 | 560470 | 23364 | 455515 | 38336 |
| ZFAND6 | 086666 | 560228 | 23365 | 454409 | 38337 |
| ZFAND6 | 086666 | 559835 | 23366 | 453291 | 38338 |
| ZFAND6 | 086666 | 559775 | 23367 | 453709 | 38339 |
| ZFAND6 | 086666 | 558688 | 23368 | 452664 | 38340 |
| ZFAND6 | 086666 | 560392 | 23369 | 455146 | 38341 |
| ZFAND6 | 086666 | 560976 | 23370 | 453710 | 38342 |
| ZFAND6 | 086666 | 558272 | 23371 | 456973 | 38343 |
| ZFAND6 | 086666 | 558390 | 23372 | 453308 | 38344 |
| ZFAND6 | 086666 | 557793 | 23373 | N/A | |
| ZFAND6 | 086666 | 558997 | 23374 | 453571 | 38345 |
| ZFAND6 | 086666 | 558087 | 23375 | 453888 | 38346 |
| ZFAND6 | 086666 | 558724 | 23376 | 452625 | 38347 |
| ZFAND6 | 086666 | 561017 | 23377 | N/A | |
| ZFAND6 | 086666 | 557983 | 23378 | N/A | |
| ZFAND6 | 086666 | 618205 | 23379 | 484971 | 38348 |
| ZFAND6 | 086666 | 616533 | 23380 | 478129 | 38349 |
| ZFAND6 | 086666 | 613266 | 23381 | 479071 | 38350 |
| ZFHX4 | 091656 | 521891 | 23382 | 430497 | 38351 |
| ZFHX4 | 091656 | 517683 | 23383 | N/A | |
| ZFHX4 | 091656 | 458716 | 23384 | N/A | |
| ZFHX4 | 091656 | 520307 | 23385 | 428525 | 38352 |
| ZFHX4 | 091656 | 523885 | 23386 | 429495 | 38353 |
| ZFHX4 | 091656 | 517585 | 23387 | 427775 | 38354 |

-continued

| Symbol | ENSG | ENST | SEQ ID | ENSP | SEQ ID |
|---|---|---|---|---|---|
| ZFHX4 | 091656 | 523809 | 23388 | 427739 | 38355 |
| ZFHX4 | 091656 | 518282 | 23389 | 430848 | 38356 |
| ZFHX4 | 091656 | 523625 | 23390 | 431101 | 38357 |
| ZFHX4 | 091656 | 524290 | 23391 | N/A | |
| ZFHX4 | 091656 | 519536 | 23392 | 430375 | 38358 |
| ZFHX4 | 091656 | 522409 | 23393 | N/A | |
| ZFP36L1 | 185650 | 555997 | 23394 | 451093 | 38359 |
| ZFP36L1 | 185650 | 439696 | 23395 | 388402 | 38360 |
| ZFP36L1 | 185650 | 336440 | 23396 | 337386 | 38361 |
| ZFP36L1 | 185650 | 557086 | 23397 | 450784 | 38362 |
| ZFP36L1 | 185650 | 557022 | 23398 | 450600 | 38363 |
| ZFP36L1 | 185650 | 553375 | 23399 | 452119 | 38364 |
| ZNF385C | 187595 | 496039 | 23400 | N/A | |
| ZNF385C | 187595 | 461831 | 23401 | N/A | |
| ZNF385C | 187595 | 436535 | 23402 | 411514 | 38365 |
| ZNF385C | 187595 | 453355 | 23403 | N/A | |
| ZNF385C | 187595 | 618554 | 23404 | 480744 | 38366 |
| ZNF395 | 186918 | 344423 | 23405 | 340494 | 38367 |
| ZNF395 | 186918 | 520535 | 23406 | 427719 | 38368 |
| ZNF395 | 186918 | 523202 | 23407 | 429640 | 38369 |
| ZNF395 | 186918 | 523095 | 23408 | 428452 | 38370 |
| ZNF395 | 186918 | 517372 | 23409 | N/A | |
| ZNF395 | 186918 | 521912 | 23410 | 427934 | 38371 |
| ZNF395 | 186918 | 520290 | 23411 | 430203 | 38372 |
| ZNF395 | 186918 | 521185 | 23412 | 427812 | 38373 |
| ZNF395 | 186918 | 522795 | 23413 | 429823 | 38374 |
| ZNF395 | 186918 | 517459 | 23414 | 429649 | 38375 |
| ZNF395 | 186918 | 519730 | 23415 | N/A | |
| ZNF423 | 102935 | 561648 | 23416 | 455426 | 38376 |
| ZNF423 | 102935 | 563137 | 23417 | 455588 | 38377 |
| ZNF423 | 102935 | 562871 | 23418 | 457928 | 38378 |
| ZNF423 | 102935 | 535559 | 23419 | 442321 | 38379 |
| ZNF423 | 102935 | 567169 | 23420 | 455061 | 38380 |
| ZNF423 | 102935 | 562520 | 23421 | 457664 | 38381 |
| ZNF423 | 102935 | 568094 | 23422 | 479288 | 38382 |
| ZNF423 | 102935 | 262383 | 23423 | 262383 | 38383 |
| ZNF462 | 148143 | 277225 | 23424 | 277225 | 38384 |
| ZNF462 | 148143 | 472574 | 23425 | 476222 | 38385 |
| ZNF462 | 148143 | 480607 | 23426 | N/A | |
| ZNF462 | 148143 | 374686 | 23427 | 363818 | 38386 |
| ZNF462 | 148143 | 441147 | 23428 | 397306 | 38387 |
| ZNF462 | 148143 | 497489 | 23429 | N/A | |
| ZNF462 | 148143 | 469433 | 23430 | N/A | |
| ZNF462 | 148143 | 471032 | 23431 | N/A | |
| ZNF462 | 148143 | 479166 | 23432 | N/A | |
| ZNF462 | 148143 | 427098 | 23433 | 405837 | 38388 |
| ZNF462 | 148143 | 482115 | 23434 | N/A | |
| ZNF462 | 148143 | 483287 | 23435 | N/A | |
| ZNF521 | 198795 | 361524 | 23436 | 354794 | 38389 |
| ZNF521 | 198795 | 584787 | 23437 | 463000 | 38390 |
| ZNF521 | 198795 | 399425 | 23438 | 382352 | 38391 |
| ZNF521 | 198795 | 538137 | 23439 | 440768 | 38392 |
| ZNF521 | 198795 | 577775 | 23440 | 463748 | 38393 |
| ZNF521 | 198795 | 577720 | 23441 | N/A | |
| ZNF521 | 198795 | 577801 | 23442 | 462724 | 38394 |
| ZNF521 | 198795 | 581869 | 23443 | N/A | |
| ZNF521 | 198795 | 580488 | 23444 | 464415 | 38395 |
| ZNF521 | 198795 | 583005 | 23445 | N/A | |
| ZNF521 | 198795 | 579111 | 23446 | N/A | |
| ZNF521 | 198795 | 583398 | 23447 | N/A | |
| ZNF521 | 198795 | 582584 | 23448 | N/A | |
| ZNF521 | 198795 | 577461 | 23449 | 462746 | 38396 |
| ZNF608 | 168916 | 513985 | 23450 | N/A | |
| ZNF608 | 168916 | 504926 | 23451 | 427657 | 38397 |
| ZNF608 | 168916 | 306315 | 23452 | 307746 | 38398 |
| ZNF608 | 168916 | 505686 | 23453 | 424086 | 38399 |
| ZNF608 | 168916 | 503896 | 23454 | N/A | |
| ZNF608 | 168916 | 509799 | 23455 | 423279 | 38400 |
| ZNF608 | 168916 | 513986 | 23456 | 421899 | 38401 |
| ZNF608 | 168916 | 511308 | 23457 | N/A | |
| ZNF608 | 168916 | 512940 | 23458 | N/A | |
| ZNF608 | 168916 | 613878 | 23459 | 477767 | 38402 |
| ZNF804B | 182348 | 333190 | 23460 | 329638 | 38403 |
| ZNF804B | 182348 | 611114 | 23461 | 478506 | 38404 |
| ZNF831 | 124203 | 637017 | 23462 | 490240 | 38405 |
| ZNF831 | 124203 | 610729 | 23463 | N/A | |

-continued

| Symbol | ENSG | ENST | SEQ ID | ENSP | SEQ ID |
|---|---|---|---|---|---|
| ZNF831 | 124203 | 371030 | 23464 | 360069 | 38406 |
| ZFPM1 | 179588 | 319555 | 23465 | 326630 | 38407 |
| ZFPM1 | 179588 | 562417 | 23466 | N/A | |
| ZFPM1 | 179588 | 569086 | 23467 | 482796 | 38408 |
| ZFPM1 | 179588 | 563351 | 23468 | 484216 | 38409 |
| ZFPM1 | 179588 | 562437 | 23469 | 480412 | 38410 |
| ZFPM2 | 169946 | 521923 | 23470 | N/A | |
| ZFPM2 | 169946 | 518180 | 23471 | N/A | |
| ZFPM2 | 169946 | 407775 | 23472 | 384179 | 38411 |
| ZFPM2 | 169946 | 520492 | 23473 | 430757 | 38412 |
| ZFPM2 | 169946 | 520027 | 23474 | 428149 | 38413 |
| ZFPM2 | 169946 | 524235 | 23475 | N/A | |
| ZFPM2 | 169946 | 511341 | 23476 | N/A | |
| ZFPM2 | 169946 | 522160 | 23477 | N/A | |
| ZFPM2 | 169946 | 517361 | 23478 | 428720 | 38414 |
| ZFPM2 | 169946 | 522296 | 23479 | N/A | |
| ZFX | 005889 | 497813 | 23480 | N/A | |
| ZFX | 005889 | 428571 | 23481 | 411637 | 38415 |
| ZFX | 005889 | 419690 | 23482 | 416298 | 38416 |
| ZFX | 005889 | 379177 | 23483 | 368475 | 38417 |
| ZFX | 005889 | 304543 | 23484 | 304985 | 38418 |
| ZFX | 005889 | 459724 | 23485 | N/A | |
| ZFX | 005889 | 480195 | 23486 | N/A | |
| ZFX | 005889 | 338565 | 23487 | 343384 | 38419 |
| ZFX | 005889 | 474385 | 23488 | N/A | |
| ZFX | 005889 | 379188 | 23489 | 368486 | 38420 |
| ZFX | 005889 | 539115 | 23490 | 438233 | 38421 |
| ZFY | 067646 | 383052 | 23491 | 372525 | 38422 |
| ZFY | 067646 | 625061 | 23492 | 485605 | 38423 |
| ZFY | 067646 | 469869 | 23493 | N/A | |
| ZFY | 067646 | 443793 | 23494 | 388814 | 38424 |
| ZFY | 067646 | 449237 | 23495 | 393908 | 38425 |
| ZFY | 067646 | 478783 | 23496 | N/A | |
| ZFY | 067646 | 155093 | 23497 | 155093 | 38426 |
| ZIC1 | 152977 | 472523 | 23498 | N/A | |
| ZIC1 | 152977 | 488404 | 23499 | 419664 | 38427 |
| ZIC1 | 152977 | 282928 | 23500 | 282928 | 38428 |
| ZIC1 | 152977 | 474034 | 23501 | N/A | |
| ZIC1 | 152977 | 481840 | 23502 | N/A | |
| ZIC2 | 043355 | 376335 | 23503 | 365514 | 38429 |
| ZIC2 | 043355 | 490085 | 23504 | N/A | |
| ZIC2 | 043355 | 468291 | 23505 | N/A | |
| ZIC2 | 043355 | 477213 | 23506 | N/A | |
| ZIC2 | 043355 | 481565 | 23507 | N/A | |
| ZIC3 | 156925 | 287538 | 23508 | 287538 | 38430 |
| ZIC3 | 156925 | 370606 | 23509 | 359638 | 38431 |
| ZIC3 | 156925 | 478471 | 23510 | N/A | |
| ZIC4 | 174963 | 383075 | 23511 | 372553 | 38432 |
| ZIC4 | 174963 | 472749 | 23512 | N/A | |
| ZIC4 | 174963 | 494569 | 23513 | N/A | |
| ZIC4 | 174963 | 493664 | 23514 | N/A | |
| ZIC4 | 174963 | 484399 | 23515 | 417855 | 38433 |
| ZIC4 | 174963 | 473123 | 23516 | 420775 | 38434 |
| ZIC4 | 174963 | 463850 | 23517 | N/A | |
| ZIC4 | 174963 | 480015 | 23518 | N/A | |
| ZIC4 | 174963 | 464502 | 23519 | N/A | |
| ZIC4 | 174963 | 491672 | 23520 | 418277 | 38435 |
| ZIC4 | 174963 | 475502 | 23521 | N/A | |
| ZIC4 | 174963 | 462748 | 23522 | 420627 | 38436 |
| ZIC4 | 174963 | 484586 | 23523 | 418343 | 38437 |
| ZIC4 | 174963 | 463250 | 23524 | 419727 | 38438 |
| ZIC4 | 174963 | 464144 | 23525 | N/A | |
| ZIC4 | 174963 | 425731 | 23526 | 397695 | 38439 |
| ZIC4 | 174963 | 525172 | 23527 | 435509 | 38440 |
| ZIC5 | 139800 | 267294 | 23528 | 267294 | 38441 |
| ZKSCAN1 | 106261 | 324306 | 23529 | 323148 | 38442 |
| ZKSCAN1 | 106261 | 482979 | 23530 | N/A | |
| ZKSCAN1 | 106261 | 426572 | 23531 | 409172 | 38443 |
| ZKSCAN1 | 106261 | 432317 | 23532 | 394445 | 38444 |
| ZKSCAN1 | 106261 | 620510 | 23533 | 480305 | 38445 |
| ZKSCAN1 | 106261 | 535170 | 23534 | 443508 | 38446 |
| ZMAT4 | 165061 | 315769 | 23535 | 319785 | 38447 |
| ZMAT4 | 165061 | 297737 | 23536 | 297737 | 38448 |
| ZMAT4 | 165061 | 519406 | 23537 | 428423 | 38449 |
| ZMAT4 | 165061 | 519806 | 23538 | N/A | |
| ZMAT4 | 165061 | 518242 | 23539 | N/A | |

| Symbol | ENSG | ENST | SEQ ID | ENSP | SEQ ID | | Symbol | ENSG | ENST | SEQ ID | ENSP | SEQ ID |
|---|---|---|---|---|---|---|---|---|---|---|---|---|
| ZMAT4 | 165061 | 523188 | 23540 | 430050 | 38450 | | ZNF331 | 130844 | 253144 | 23616 | 253144 | 38504 |
| ZMAT4 | 165061 | 523542 | 23541 | 427918 | 38451 | | ZNF331 | 130844 | 502248 | 23617 | 423675 | 38505 |
| ZMAT4 | 165061 | 522623 | 23542 | 429068 | 38452 | | ZNF331 | 130844 | 511593 | 23618 | 427439 | 38506 |
| ZMAT4 | 165061 | 523823 | 23543 | N/A | | | ZNF331 | 130844 | 504033 | 23619 | N/A | |
| ZNF10 | 256223 | 538918 | 23544 | 445997 | 38453 | | ZNF331 | 130844 | 514374 | 23620 | 424835 | 38507 |
| ZNF10 | 256223 | 540609 | 23545 | 438232 | 38454 | | ZNF331 | 130844 | 411977 | 23621 | 393336 | 38508 |
| ZNF10 | 256223 | 248211 | 23546 | 248211 | 38455 | | ZNF331 | 130844 | 511154 | 23622 | 421014 | 38509 |
| ZNF10 | 256223 | 543271 | 23547 | N/A | | | ZNF331 | 130844 | 509069 | 23623 | N/A | |
| ZNF10 | 256223 | 540927 | 23548 | N/A | | | ZNF331 | 130844 | 509047 | 23624 | 423263 | 38510 |
| ZNF10 | 256223 | 536704 | 23549 | N/A | | | ZNF331 | 130844 | 509585 | 23625 | 426155 | 38511 |
| ZNF10 | 256223 | 536877 | 23550 | 441339 | 38456 | | ZNF331 | 130844 | 504940 | 23626 | N/A | |
| ZNF10 | 256223 | 426665 | 23551 | 393814 | 38457 | | ZNF331 | 130844 | 513999 | 23627 | 423156 | 38512 |
| ZNF10 | 256223 | 402932 | 23552 | 384893 | 38458 | | ZNF331 | 130844 | 512387 | 23628 | 421728 | 38513 |
| ZNF10 | 256223 | 537119 | 23553 | N/A | | | ZNF331 | 130844 | 511567 | 23629 | 426127 | 38514 |
| ZNF124 | 196418 | 472531 | 23554 | 462445 | 38459 | | ZNF331 | 130844 | 514022 | 23630 | 422471 | 38515 |
| ZNF124 | 196418 | 476312 | 23555 | N/A | | | ZNF331 | 130844 | 505949 | 23631 | 427532 | 38516 |
| ZNF124 | 196418 | 491356 | 23556 | 463191 | 38460 | | ZNF331 | 130844 | 513265 | 23632 | 426458 | 38517 |
| ZNF124 | 196418 | 340684 | 23557 | 340749 | 38461 | | ZNF331 | 130844 | 502616 | 23633 | 422586 | 38518 |
| ZNF124 | 196418 | 543802 | 23558 | 440365 | 38462 | | ZNF331 | 130844 | 504493 | 23634 | 425517 | 38519 |
| ZNF124 | 196418 | 491848 | 23559 | N/A | | | ZNF331 | 130844 | 505426 | 23635 | 424929 | 38520 |
| ZNF131 | 172262 | 503599 | 23560 | N/A | | | ZNF331 | 130844 | 449416 | 23636 | 393817 | 38521 |
| ZNF131 | 172262 | 499046 | 23561 | N/A | | | ZNF404 | 176222 | 587539 | 23637 | 466051 | 38522 |
| ZNF131 | 172262 | 508795 | 23562 | N/A | | | ZNF404 | 176222 | 588094 | 23638 | N/A | |
| ZNF131 | 172262 | 507393 | 23563 | 427003 | 38463 | | ZNF404 | 176222 | 324394 | 23639 | 319479 | 38523 |
| ZNF131 | 172262 | 514169 | 23564 | N/A | | | ZNF496 | 162714 | 462139 | 23640 | N/A | |
| ZNF131 | 172262 | 515326 | 23565 | 422079 | 38464 | | ZNF496 | 162714 | 294753 | 23641 | 294753 | 38524 |
| ZNF131 | 172262 | 510026 | 23566 | 425623 | 38465 | | ZNF496 | 162714 | 461277 | 23642 | 473324 | 38525 |
| ZNF131 | 172262 | 504359 | 23567 | N/A | | | ZNF496 | 162714 | 478225 | 23643 | N/A | |
| ZNF131 | 172262 | 509156 | 23568 | 426504 | 38466 | | ZNF496 | 162714 | 477903 | 23644 | N/A | |
| ZNF131 | 172262 | 508259 | 23569 | 422659 | 38467 | | ZNF546 | 187187 | 597363 | 23645 | N/A | |
| ZNF131 | 172262 | 507218 | 23570 | 425139 | 38468 | | ZNF546 | 187187 | 599504 | 23646 | 469334 | 38526 |
| ZNF131 | 172262 | 306938 | 23571 | 305804 | 38469 | | ZNF546 | 187187 | 596894 | 23647 | 470423 | 38527 |
| ZNF131 | 172262 | 505606 | 23572 | 423945 | 38470 | | ZNF546 | 187187 | 593687 | 23648 | N/A | |
| ZNF131 | 172262 | 509634 | 23573 | 421246 | 38471 | | ZNF546 | 187187 | 601138 | 23649 | 469168 | 38528 |
| ZNF131 | 172262 | 509341 | 23574 | 424771 | 38472 | | ZNF546 | 187187 | 600094 | 23650 | 469540 | 38529 |
| ZNF131 | 172262 | 509931 | 23575 | 425722 | 38473 | | ZNF546 | 187187 | 347077 | 23651 | 339823 | 38530 |
| ZNF131 | 172262 | 511736 | 23576 | 426614 | 38474 | | ZNF546 | 187187 | 602253 | 23652 | N/A | |
| ZNF131 | 172262 | 510037 | 23577 | N/A | | | ZNF546 | 187187 | 595225 | 23653 | 472403 | 38531 |
| ZNF131 | 172262 | 502623 | 23578 | 423254 | 38475 | | ZNF546 | 281526 | 627810 | 23654 | N/A | |
| ZNF131 | 172262 | 507231 | 23579 | N/A | | | ZNF546 | 281526 | 631242 | 23655 | 486015 | 38532 |
| ZNF141 | 131127 | 366506 | 23580 | N/A | | | ZNF546 | 281526 | 629260 | 23656 | 487382 | 38533 |
| ZNF141 | 131127 | 512994 | 23581 | 425799 | 38476 | | ZNF546 | 281526 | 625917 | 23657 | N/A | |
| ZNF141 | 131127 | 503699 | 23582 | N/A | | | ZNF546 | 281526 | 628247 | 23658 | 486807 | 38534 |
| ZNF141 | 131127 | 505939 | 23583 | 424403 | 38477 | | ZNF546 | 281526 | 627583 | 23659 | 487351 | 38535 |
| ZNF141 | 131127 | 240499 | 23584 | 240499 | 38478 | | ZNF546 | 281526 | 626389 | 23660 | 487125 | 38536 |
| ZNF141 | 131127 | 579770 | 23585 | N/A | | | ZNF546 | 281526 | 626141 | 23661 | N/A | |
| ZNF184 | 096654 | 377419 | 23586 | 366636 | 38479 | | ZNF546 | 281526 | 626396 | 23662 | 486294 | 38537 |
| ZNF184 | 096654 | 211936 | 23587 | 211936 | 38480 | | ZNF580 | 213015 | 592881 | 23663 | 468407 | 38538 |
| ZNF212 | 170260 | 335870 | 23588 | 338572 | 38481 | | ZNF580 | 213015 | 325333 | 23664 | 320050 | 38539 |
| ZNF212 | 170260 | 486371 | 23589 | 418281 | 38482 | | ZNF580 | 213015 | 590190 | 23665 | 465028 | 38540 |
| ZNF212 | 170260 | 462724 | 23590 | 418167 | 38483 | | ZNF580 | 213015 | 543039 | 23666 | 443957 | 38541 |
| ZNF212 | 170260 | 481584 | 23591 | 419419 | 38484 | | ZNF580 | 213015 | 592461 | 23667 | 467142 | 38542 |
| ZNF212 | 170260 | 488917 | 23592 | 419261 | 38485 | | ZNF580 | 213015 | 545125 | 23668 | 446126 | 38543 |
| ZNF219 | 165804 | 360947 | 23593 | 354206 | 38486 | | ZNF585A | 196967 | 587817 | 23669 | 466825 | 38544 |
| ZNF219 | 165804 | 451119 | 23594 | 388558 | 38487 | | ZNF585A | 196967 | 588723 | 23670 | N/A | |
| ZNF219 | 165804 | 421093 | 23595 | 392401 | 38488 | | ZNF585A | 196967 | 292841 | 23671 | 292841 | 38545 |
| ZNF219 | 165804 | 555270 | 23596 | 450803 | 38489 | | ZNF585A | 196967 | 392157 | 23672 | 375998 | 38546 |
| ZNF219 | 165804 | 554478 | 23597 | 451212 | 38490 | | ZNF585A | 196967 | 588354 | 23673 | 466185 | 38547 |
| ZNF219 | 165804 | 556174 | 23598 | 450609 | 38491 | | ZNF585A | 196967 | 356958 | 23674 | 349440 | 38548 |
| ZNF219 | 165804 | 554923 | 23599 | 451890 | 38492 | | ZNF607 | 198182 | 355202 | 23675 | 347338 | 38549 |
| ZNF219 | 165804 | 553296 | 23600 | 450900 | 38493 | | ZNF607 | 198182 | 395835 | 23676 | 438015 | 38550 |
| ZNF219 | 165804 | 553980 | 23601 | 451969 | 38494 | | ZNF607 | 198182 | 586559 | 23677 | 466265 | 38551 |
| ZNF219 | 165804 | 556944 | 23602 | N/A | | | ZNF607 | 198182 | 590670 | 23678 | 466785 | 38552 |
| ZNF219 | 165804 | 555697 | 23603 | 451595 | 38495 | | ZNF607 | 198182 | 591664 | 23679 | 468817 | 38553 |
| ZNF219 | 165804 | 556101 | 23604 | N/A | | | ZNF703 | 183779 | 331569 | 23680 | 332325 | 38554 |
| ZNF219 | 165804 | 624093 | 23605 | N/A | | | ZNF711 | 147180 | 373165 | 23681 | 362260 | 38555 |
| ZNF253 | 256771 | 592725 | 23606 | 467235 | 38496 | | ZNF711 | 147180 | 276123 | 23682 | 276123 | 38556 |
| ZNF253 | 256771 | 589717 | 23607 | 468720 | 38497 | | ZNF711 | 147180 | 360700 | 23683 | 353922 | 38557 |
| ZNF253 | 256771 | 355650 | 23608 | 347868 | 38498 | | ZNF736 | 234444 | 493036 | 23684 | N/A | |
| ZNF253 | 256771 | 589668 | 23609 | N/A | | | ZNF736 | 234444 | 465343 | 23685 | N/A | |
| ZNF253 | 256771 | 640599 | 23610 | 492582 | 38499 | | ZNF736 | 234444 | 492322 | 23686 | N/A | |
| ZNF304 | 131845 | 443917 | 23611 | 401642 | 38500 | | ZNF736 | 234444 | 606716 | 23687 | N/A | |
| ZNF304 | 131845 | 598744 | 23612 | 470319 | 38501 | | ZNF736 | 234444 | 438373 | 23688 | 391083 | 38558 |
| ZNF304 | 131845 | 282286 | 23613 | 282286 | 38502 | | ZNF736 | 234444 | 488621 | 23689 | N/A | |
| ZNF304 | 131845 | 391705 | 23614 | 375586 | 38503 | | ZNF736 | 234444 | 423484 | 23690 | 400852 | 38559 |
| ZNF331 | 130844 | 513929 | 23615 | N/A | | | ZNF736 | 234444 | 355095 | 23691 | 347210 | 38560 |

-continued

| Symbol | ENSG | ENST | SEQ ID | ENSP | SEQ ID |
|---|---|---|---|---|---|
| ZNF84 | 198040 | 543758 | 23692 | 437949 | 38561 |
| ZNF84 | 198040 | 539354 | 23693 | 445549 | 38562 |
| ZNF84 | 198040 | 438628 | 23694 | 387416 | 38563 |
| ZNF84 | 198040 | 540031 | 23695 | 445820 | 38564 |
| ZNF84 | 198040 | 539098 | 23696 | N/A | |
| ZNF84 | 198040 | 539686 | 23697 | N/A | |
| ZNF84 | 198040 | 536123 | 23698 | 445958 | 38565 |
| ZNF84 | 198040 | 327668 | 23699 | 331465 | 38566 |
| ZNF84 | 198040 | 543310 | 23700 | 438982 | 38567 |
| ZNF84 | 198040 | 545299 | 23701 | 437636 | 38568 |
| ZNF84 | 198040 | 542358 | 23702 | N/A | |
| ZNF84 | 198040 | 441010 | 23703 | N/A | |
| ZNF84 | 198040 | 542874 | 23704 | 442963 | 38569 |
| ZNF84 | 198040 | 535439 | 23705 | 439130 | 38570 |
| ZNF84 | 198040 | 543124 | 23706 | N/A | |
| ZNF84 | 198040 | 392319 | 23707 | 376133 | 38571 |
| ZNF891 | 214029 | 537226 | 23708 | 437590 | 38572 |
| ZNHIT1 | 106400 | 305105 | 23709 | 304593 | 38573 |
| ZNHIT1 | 106400 | 461205 | 23710 | N/A | |
| ZNHIT1 | 106400 | 492315 | 23711 | N/A | |
| ZNHIT1 | 106400 | 485387 | 23712 | N/A | |
| ZNRD1 | 224859 | 446493 | 23713 | 399966 | 38574 |
| ZNRD1 | 224859 | 455948 | 23714 | 402198 | 38575 |
| ZNRD1 | 224859 | 481657 | 23715 | N/A | |
| ZNRD1 | 224859 | 472459 | 23716 | N/A | |
| ZNRD1 | 224859 | 428913 | 23717 | 414110 | 38576 |
| ZNRD1 | 224859 | 451875 | 23718 | 387914 | 38577 |
| ZNRD1 | 235443 | 471263 | 23719 | N/A | |
| ZNRD1 | 235443 | 437507 | 23720 | 412369 | 38578 |
| ZNRD1 | 235443 | 443494 | 23721 | 395397 | 38579 |
| ZNRD1 | 235443 | 465992 | 23722 | N/A | |
| ZNRD1 | 235443 | 453694 | 23723 | 405636 | 38580 |
| ZNRD1 | 235443 | 443142 | 23724 | 391809 | 38581 |
| ZNRD1 | 235176 | 466305 | 23725 | N/A | |
| ZNRD1 | 235176 | 417738 | 23726 | 407715 | 38582 |
| ZNRD1 | 235176 | 429558 | 23727 | 410954 | 38583 |
| ZNRD1 | 235176 | 441251 | 23728 | 413265 | 38584 |
| ZNRD1 | 235176 | 431416 | 23729 | 395065 | 38585 |
| ZNRD1 | 235176 | 477956 | 23730 | N/A | |
| ZNRD1 | 236808 | 466296 | 23731 | N/A | |
| ZNRD1 | 236808 | 432904 | 23732 | 414720 | 38586 |
| ZNRD1 | 236808 | 420100 | 23733 | 410530 | 38587 |
| ZNRD1 | 236808 | 432227 | 23734 | 399302 | 38588 |
| ZNRD1 | 236808 | 444027 | 23735 | 396661 | 38589 |
| ZNRD1 | 236808 | 476397 | 23736 | N/A | |
| ZNRD1 | 206502 | 484199 | 23737 | N/A | |
| ZNRD1 | 206502 | 400662 | 23738 | 383503 | 38590 |
| ZNRD1 | 206502 | 383613 | 23739 | 373108 | 38591 |
| ZNRD1 | 206502 | 400660 | 23740 | 383501 | 38592 |
| ZNRD1 | 206502 | 400659 | 23741 | 383500 | 38593 |
| ZNRD1 | 206502 | 476699 | 23742 | N/A | |
| ZNRD1 | 236949 | 485907 | 23743 | N/A | |
| ZNRD1 | 236949 | 437373 | 23744 | 410127 | 38594 |
| ZNRD1 | 236949 | 431032 | 23745 | 416599 | 38595 |
| ZNRD1 | 236949 | 433264 | 23746 | 393236 | 38596 |
| ZNRD1 | 236949 | 432545 | 23747 | 405264 | 38597 |
| ZNRD1 | 236949 | 459984 | 23748 | N/A | |
| ZNRD1 | 233795 | 481680 | 23749 | N/A | |
| ZNRD1 | 233795 | 417275 | 23750 | 397636 | 38598 |
| ZNRD1 | 233795 | 444794 | 23751 | 407364 | 38599 |
| ZNRD1 | 233795 | 442585 | 23752 | 394779 | 38600 |
| ZNRD1 | 233795 | 412396 | 23753 | 396922 | 38601 |
| ZNRD1 | 233795 | 484119 | 23754 | N/A | |
| ZNRD1 | 066379 | 471008 | 23755 | N/A | |
| ZNRD1 | 066379 | 332435 | 23756 | 331111 | 38602 |
| ZNRD1 | 066379 | 376782 | 23757 | 365978 | 38603 |
| ZNRD1 | 066379 | 359374 | 23758 | 352333 | 38604 |
| ZNRD1 | 066379 | 376785 | 23759 | 365981 | 38605 |
| ZNRD1 | 066379 | 463141 | 23760 | N/A | |
| ZNRF1 | 186187 | 335325 | 23761 | 335091 | 38606 |
| ZNRF1 | 186187 | 320619 | 23762 | 323362 | 38607 |
| ZNRF1 | 186187 | 566250 | 23763 | 456168 | 38608 |
| ZNRF1 | 186187 | 567962 | 23764 | 455601 | 38609 |
| ZNRF1 | 186187 | 564320 | 23765 | N/A | |
| ZNRF1 | 186187 | 568511 | 23766 | 462910 | 38610 |
| ZNRF1 | 186187 | 579084 | 23767 | N/A | |

-continued

| Symbol | ENSG | ENST | SEQ ID | ENSP | SEQ ID |
|---|---|---|---|---|---|
| ZNRF1 | 186187 | 566244 | 23768 | N/A | |
| ZNRF1 | 186187 | 568351 | 23769 | 457606 | 38611 |
| ZNRF1 | 186187 | 568494 | 23770 | N/A | |
| ZNRF1 | 186187 | 568844 | 23771 | N/A | |
| ZP2 | 103310 | 574091 | 23772 | 458991 | 38612 |
| ZP2 | 103310 | 574002 | 23773 | 460971 | 38613 |
| ZP2 | 103310 | 573114 | 23774 | N/A | |
| ZP2 | 103310 | 576162 | 23775 | N/A | |
| ZP2 | 103310 | 572752 | 23776 | N/A | |
| ZP2 | 284588 | 640487 | 23777 | 491583 | 38614 |
| ZP2 | 284588 | 638300 | 23778 | 492703 | 38615 |
| ZP2 | 284588 | 639836 | 23779 | N/A | |
| ZP2 | 284588 | 640213 | 23780 | N/A | |
| ZP2 | 284588 | 640539 | 23781 | N/A | |
| ZSCAN29 | 140265 | 396976 | 23782 | 380174 | 38616 |
| ZSCAN29 | 140265 | 566849 | 23783 | 457835 | 38617 |
| ZSCAN29 | 140265 | 562072 | 23784 | 456089 | 38618 |
| ZSCAN29 | 140265 | 568898 | 23785 | 456883 | 38619 |
| ZSCAN29 | 140265 | 570181 | 23786 | 454548 | 38620 |
| ZSCAN29 | 140265 | 561661 | 23787 | 458119 | 38621 |
| ZSCAN29 | 140265 | 563508 | 23788 | N/A | |
| ZSCAN29 | 140265 | 396972 | 23789 | 380170 | 38622 |
| ZSCAN30 | 186814 | 333206 | 23790 | 329738 | 38623 |
| ZSCAN30 | 186814 | 420878 | 23791 | 392371 | 38624 |
| ZSCAN30 | 186814 | 590777 | 23792 | N/A | |
| ZSCAN30 | 186814 | 589178 | 23793 | 465046 | 38625 |
| ZSCAN30 | 186814 | 588448 | 23794 | 470677 | 38626 |
| ZSCAN30 | 186814 | 601405 | 23795 | 472179 | 38627 |
| ZSCAN30 | 186814 | 592278 | 23796 | 470443 | 38628 |
| ZSCAN30 | 186814 | 592598 | 23797 | 468180 | 38629 |
| ZSCAN30 | 186814 | 592211 | 23798 | 467308 | 38630 |
| ZSCAN30 | 186814 | 588832 | 23799 | N/A | |
| ZSCAN30 | 186814 | 610712 | 23800 | 480152 | 38631 |
| ZSCAN30 | 186814 | 639929 | 23801 | 491237 | 38632 |
| ZSWIM6 | 130449 | 252744 | 23802 | 252744 | 38633 |
| ZYG11A | 203995 | 371532 | 23803 | 360587 | 38634 |
| ZYG11A | 203995 | 371528 | 23804 | 360583 | 38635 |
| ZYG11A | 203995 | 612017 | 23805 | 482761 | 38636 |
| ZYX | 159840 | 322764 | 23806 | 324422 | 38637 |
| ZYX | 159840 | 449630 | 23807 | 413467 | 38638 |
| ZYX | 159840 | 468083 | 23808 | N/A | |
| ZYX | 159840 | 457235 | 23809 | 400537 | 38639 |
| ZYX | 159840 | 354434 | 23810 | 346417 | 38640 |
| ZYX | 159840 | 392910 | 23811 | 376642 | 38641 |
| ZYX | 159840 | 477373 | 23812 | N/A | |
| ZYX | 159840 | 436448 | 23813 | 411230 | 38642 |
| ZYX | 159840 | 446634 | 23814 | 403714 | 38643 |
| ZYX | 159840 | 497119 | 23815 | N/A | |

III. Methods for Isolating and Profiling Nuclei From a Cell Type

Many issues of human biology may be investigated productively in defined cell populations. For example, an understanding of molecular events associated with human neurodegenerative events may be gained through longitudinal studies of a variety of cell types in significant numbers from human samples due to the genetic complexities of these conditions (Burguiere, E., et al. (2015) Curr Opin Neurobiol 30, 59-65.; Hinz, et al. (2017) Cold Spring Harb Perspect Biol 9, a023705; Vorstman, et al. (2017) Nat Rev Genet 18, 362-376, each of which is hereby incorporated by reference herein in its entirety), the probabilistic nature of neuronal cell loss (Clarke, et al. (2000). Nature 406, 195-199 and Clarke, et al. (2005) Brain Research Bulletin 65, 59-67, each of which is hereby incorporated by reference herein in its entirety), and the variable impacts of aging on both disease onset and progression (Corrada, et al. (2010) Ann. Neurol. 67, 114-121 and Niccoli, et al. (2012) Current Biology 22, R741-R752, each of which is hereby incorporated by reference herein in its entirety). Given these considerations, the methodology herein was developed to determine precisely the molecular properties of defined brain cell types and that is sufficiently robust to employ postmortem tissue from common brain tissue banks without requiring transgenic animals.

The cellular profiling technique described herein was developed as an approach for cell type specific analysis that takes advantage of the unique complement of nuclear-localized and nuclear associated proteins within each cell type to enable robust and reproducible studies of defined cell types in the mammalian brain. The cellular profiling technique described herein allows for cell-type specific gene expression profiling of mouse, rat, and human post-mortem brains and these methods may be extended to any organ or tissue sample.

Comparative studies of data generated from the cellular profiling technique described herein from rodent and human brain cell types reveal evolutionary divergence of gene expression profiles from classically defined, highly conserved cerebellar cell types (D'Angelo, E. (2013) Handbook of the Cerebellum and Cerebellar Disorders, (Dordrecht: Springer Netherlands), pp. 765-791; Eccles, J. C. (1967) The Cerebellum as a Neuronal Machine (Berlin/Heidelberg/New York: Springer); Llinas, R. R. (1969). Neurobiology of Cerebellar Evolution and Development (Chicago: American Medical Association); each of which is hereby incorporated by reference herein in its entirety). Data show also that molecular mechanisms of brain aging unfold differently in each human cell type. Finally, the data show robust, molecular phenotypes indicating a shared external event may be identified in control postmortem human brains. Correlative studies of human genetic and clinical data with expression and epigenetic studies using the cellular profiling technique described herein will provide insight into additional, yet unrecognized molecular characteristics of human brain function and dysfunction.

Transgenic mice expressing an EGFP-L10a ribosomal protein fusion under the control of cell-type specific drivers were previously developed in Doyle, et al. (2008) Cell 135, 749-762 and Heiman, et al. (2008) Cell 135, 738-748, each of which is hereby incorporated by reference herein in its entirety. Using these five transgenic animal lines developed for use in the TRAP method, EGFP+ nuclei (Kriaucionis, et al. (2009) Science 324, 929-930 and Mellen, M., et al. (2012) Cell 151, 1417-1430, each of which is hereby incorporated by reference in its entirety) were purified from specific cell types by gene expression using the TRAP methodology or by epigenetic characteristics after using fluorescence activated cell sorting (FACS). Previous studies have established that nuclear RNA profiles are also unique to each cell type, and that they are informative regarding cell function (Deal, et al. (2011) Nat Protoc 6, 56-68; Henry et al., Nucleic Acids Res. 2012 October; 40(19):9691-704; Mo, et al. (2015) Neuron 86, 1369-1384; Steiner, et al. (2012) Genome Res 22, 766-777; each of which is hereby incorporated by reference herein in its entirety).

An important limitation of methods for cell-type specific molecular profiling developed previously to the cellular profiling technique described herein is that they require the use of transgenic animals to genetically target cell types of interest. To overcome this limitation, cell type specific expression of nuclear and endoplasmic reticulum proteins was investigated in order to purify and characterize nuclei from specific cell types in a broad range of species, including human postmortem brain samples.

In some embodiments of the present invention, nuclei were prepared from wild-type or transgenic tissue, fixed using formaldehyde, stained with fluorescent antibodies that are specific to a given cell type in the brain region of interest, sorted by flow cytometry (e.g. FACs), and then analyzed using RNAseq for discovery of species, cell type, or environmental specific expression profile characteristics.

The cellular profiling technique described herein may be applied to nuclei from any cell type or tissues associated with a particular disease, disorder, or condition. For example, nuclei from cells types that originate in basal ganglia tissue including: striatonigral medium-sized spiny neurons (MSNs), striatopallidal MSNs (caudate and accumbens), striatal cholinergic interneurons, subthalamic nucleus, dopaminergic neurons, and bed nucleus of the stria terminalis (BNST) neurons. For example, nuclei from cell types that originate in thalamus tissue including: thalamocortical neurons, thalamostriatal neurons, and thalamic reticular nucleus neurons. For example, nuclei from cell types that originate in cortex tissue including: entorhinal cortex layer 2/3 neurons, fast-spiking cortical interneurons, and layer 2/3 pyramidal cells from pre-frontal cortex tissue. For example, nuclei from cell types that originate in hippocampus tissue including cornu ammonis region 1 (CA1), cornu ammonis region 2 (CA2), cornu ammonis region 3 (CA3), and dentate gyms cells.

The cell types may also be associated with the following tissues: medial habenula (cholinergic projection neurons to interpeduncular nucleus), brain stem (upper motor neurons), spinal cord (lower motor neurons), or all tissues (various classes of interneurons, astrocytes and oligodendrocytes). Cell types in human brains may also be associated with neurodegenerative conditions, such as ataxias, Parkinson's disease, Alzheimer's disease, and amyotrophic lateral sclerosis (ALS). For example, Purkinje cells, granule cells, Bergmann glia, basket/stellate cells, and cerebellar deep nuclei associated with ataxias are profiled. Substantia nigra ventral tegmental area (VTA) dopaminergic neurons associated with Parkinson's disease or layer 2/3 entorhincortex, CA1 hippocampus, CA2/3 hippocampus neurons associated with Alzheimer disease may also be profiled. Alternatively, brain stem and spinal cord motor neurons associated with ALS are profiled.

A. Sorting Cell Types Using the Nuclear Transcriptome

Nuclei may be sorted using antibodies, RNA probes, or DNA probes specific to endoplasmic reticulum (ER) protein, membrane proteins synthesized in the ER, or nuclear transcripts. To enrich for ER transcripts translated near the nuclear membrane, a polyA pulldown of nuclear transcripts may be performed. In some embodiments, nuclei originating from a cell type of interest were isolated from tissues of transgenic mice that had been previously profiled using the TRAP method to compare the cellular identity results from each technique. The profiling results for the transgenic animals developed for use with the TRAP method were based on the fact that the GFP-tagged ribosomal subunit is assembled in the nucleolus. Alternatively, the tissue that is the source of the nuclei to be sorted is dervied from a wild-type mammal, such as a human, a non-human primate, a mouse, or a rat.

FIG. 1 provides an embodiment of a sorting method that may be used with the cellular profiling technique described herein, which is also referred to as the NETSseq™ technique or INSPECTION™. "A" represents the cell type of interest, and "B" represents nuclei of the cell type of interest in FIG. 1.

In some embodiments, the strategy for isolating 3 cell types from the cerebellum in mice includes antibody-binding using Itpr1 (Inositol 1,4,5-Trisphosphate Receptor Type 1; an intracellular receptor of the endoplasmic reticulum (ER)) as a target to label Purkinje cells, NeuN (a gene encoded by a member of the RNA-binding Fox protein family; NeuN is a neronal antigen commonly used as a biomarker of neurons) as a target to label granule cells, and Gfap (Glial Fibrillary Acidic Protein; one of the major intermediate filament proteins of mature astrocytes used to distinguis astrocytes from glial cells) as a target to label glia to confirm the presence of these types of cells in the sample. Then, a combination of results for Itpr1 and NeuN may be used to isolate all 3 populations. Alternatively, nuclei from granule cells of wild-type mice may be sorted as positive for Itpr (Itpr+) and NeuN (NeuN+) and negative for Olig2 (Olig2−) and Sorcs3 (Sorcs3−). Nuclei from purkinkje cells may be sorted as Itpr1+ and NeuN+. Nuclei from basket cells may be identified as Sorcs3+ and medium NeuN−. Nuclei from astrocytes may be identified as Sorcs3− and NeuN−

Alternatively, Neuronal Differentiation 1 or Neurod1 (Neurod1+) may be used to sort granule cells; Purkinje Cell Protein 2 or Pcp2 (Pcp2+) may be used to sort Purkinje cells; Septin 4 or Sept4 (Sept4+) may be used to sort Bergmann glia; Collagen Beta(1-O)Galactosyltransferase 2 or Glt25d2, also known as Colgalt2, (Glt25d2+) was used to sort corticopontine pyramidal cells; and Neurotensin Receptor 1 or Ntsr1 (Ntsr+) was used to sort coticothalamic pyramidal cells. In some embodiments, the following nuclear transcripts may be used to identify the nuclei of each cell type: Alpha-2-Macroglobulin (A2m) for Sept4-positive cells (Bergmann glia), Pde1a and Colgalt2 for Colgalt2-positive cells (corticopontine pyramidal), Pde1a and Heparan Sulfate-Glucosamine 3-Sulfotransferase 4 (Hs3st4) for Excit-positive cells (excitatory neurons), Pde1a and Hs3st4 for Ntsr1-positive cells (corticothalamic pyramidal), Aristaless Related Homeobox (Arx) and Parvalbumin (Pvalb) for PV-positive cells (parvalbumin interneurons), Vasoactive Intestinal Peptide (Vip) for VIP-positive cells (VIP interneurons), Solute Carrier Family 9 Member A3 (S1c9a3) for Pcp2-positive cells (Purkinje), and Grin2c for NeuroD1-positive cells (granule).

In some embodiments, the nuclei of dopaminergic neurons from mice were sorted using forkhead Box A1 (FoxA1) and dopamine transporter solute carrier family 6 member 3 (Dat, also known as Slc6a3). Dopaminergic neurons are observed to be positive for both FoxA1 and Dat. In some embodiments, additional markers of dopaminergic neurons that may be used for sorting include: tyrosine hydrolase (TH), forkhead box A2 (FoxA2), and dopamine receptor 2 (Drd2).

In some embodiments, downregulated genes in a sorted nuclei population may also be used as evidence of the identity of the cell type of the nuclei. For example, dopamine receptor D1 (Drd1) and glutamate decarboxylase (Gad) are not known to be expressed in dopaminergic neurons and therefore should be downregulated in a sorted population of nuclei from dopaminergic neurons.

In some embodiments, Wolframin ER Transmembrane Glycoprotein (Wfs1) and B-Cell CLL/Lymphoma 11B (Ctip2, also known as Bcl11b) may be used to sort nuclei of cortical cell types layer 2/3 pyramidal neurons and layer 5 and 6 pyramidal neurons from mice, respectively. In some embodiments, ETS Variant 1 (Etvl, also known as ER81) may be used to sort for nuclei of layer 5 pyramidal neurons. Etvl had been previously observed to label both corticostriatal neurons, cortocopontine neurons, and potential others in layer 5 of the cortex. In some embodiments, Wfs1 may be used as a marker for Carbonic Anhydrase 1 (CA1)-positive neurons and Purkinje Cell Protein 4 (Pcp4) may be used as a marker for Carbonic Anhydrase 1 (CA2)-positive dentate gyms.

In some embodiments, Solute Carrier Family 18 Member A3 (VaChT, also known as Slc18a3), Chondrolectin (Chodl), and Estrogen Related Receptor Beta (EsrrB) may be used as markers for nuclei from brainstem motor neurons in mice. Affinity labels specific to VaChT and ErrB label the motor neurons specifically, and Chodl labels everything except for these neurons. The antibody specific to Chodl may be replaced with one that directly labels the brainstem motor neurons.

In some embodiments, rat nuclei are sorted using at least one membrane protein or nuclear associated transcript. For example, nuclei from granule cells may be identified as Itpr negative (Itpr−), Olig2 negative (Olig2−), Sorcs negative (Sorcs−), and NeuN positive (NeuN+). Nuclei from purkinje cells may be identified as Itpr positive (Itpr+) and NeuN+. Nuclei from basket cells may be identified as Itpr+ and medium NeuN negative (med NeuN−). Nuclei from astrocytes may be identified as Sorcs3 positive (Sorcs3+) and med NeuN−. Nuclei from mature oligodendrocytes may be identified as Sorcs3− and NeuN−. Nuclei from a combination of mature oligodendrocytes and OPCs may be identified as Olig2 positive (Olig2+) and high NeuN negative (high NeuN−).

In some embodiments, nuclei from purkinje cells derived from human samples may be identified as Itpr+ and Id2 positive (Id2+) or as FoxP4 positive (FoxP4+) and Itpr1+. In some embodiments, the nuclei of granule cells from human samples were identified as FoxP4+ and NeuN+. In some embodiments, nuclei from mature oligodendrocytes and OPCs may be differentiated by the level of expression of Olig2. For example, low levels of expression of Olig2 (Olig2+ low) identify the nuclei as mature oligodendrocytes, and high levels of expression of Olig2 (Olig2+ high) identify the nuclei as OPCs.

The nuclei sorting strategies described herein may be applied to any species.

B. Profiling Cell Types in the Sorted Nuclei of Different Species

The genes expressed in each cell type define their function, their responses to internal and external cues, and their evolution across species. The cellular profiling technique described herein was demonstrated to be useful for highly accurate, cell-type specific gene expression profiling of neurons and glia from mouse, rat, and human brains.

In Mo, et al. (2015) Neuron 86, 1369-1384, which is hereby incorporated by reference herein in its entirety, nuclei from transgenic mice expressing a tagged nuclear membrane protein through a Cre-loxP system were profiled using RNAseq. Comparison of the RNAseq profiles of nuclei isolated from cell types in transgenic animals and wild type animals from different sources provides evidence that nuclear RNA profiles may be used to determine cellular identity and to measure the relatedness of different cell types. In some embodiments, the transgenic animal may express enhanced GFP (EGFP/L10a fusion protein) in the targeted cell type. In some embodiments, hieracrchical clustering from RNAseq results from nuclei sorted and characterized in Mo et al. and using the cellular profiling technique described herein provides groupings by cell types such as interneurons (e.g., VIP interneurons and parvalbumin interneurons) versus pyramidal cells (e.g., corticopyramidal, corticothalamic, and excitory).

Even classically defined, uniform cerebellar cell types are observed to differ between species by expression of hundreds of orthologous genes, and continued expression of human granule cell expressed genes were also commonly observed in other regions of the mouse brain. In fact, nuclear RNA profiles are sensitive enough to distinguish among different subtypes of neurons, such as mature oligodendrocytes (also referred to as conticopontine pyramidal neurons), and oligodendrocyte progenitor cells or OPCs (also referred to as corticothalamic pyramidal neurons).

1. Differences in the RNA Profile in Sorted Nuclei From Mice

In some embodiments, gene expression was analyzed by RNAseq to create a RNA profile. In some embodiments, results were normalized to the average expression across all samples for each gene. For example, the log 2 fold change in RNAseq results from the nuclei purified by FACS for granule cells, purkinje cells, Bergmann glia, oligodendrocytes, and OPCs may be compared to the normalized RNAseq results for the 250 most variable genes across nuclei from all cell types. In mice, the most variable genes may be selected from 1700047M11Rik, 3110039M20Rik, 2410124H12Rik, 8030451007Rik, 9530059O14Rik, A230077H06Rik, A2m, A730036I17Rik, Aass, Acsm5, Actb12, Adra2b, Afp, Aqp4, Arhgap25, Arx, Atp13a4, Atp1a2, Atp2a3, B230209E15Rik, B3gnt5, Barh12, Bell 1b, Btbd17, Cacng3, Camk1g, Camkv, Car8, Casp12, Casq2, Cbln2, Cbln3, Cckbr, Cd70, Cd9, Cdc42ep1, Cdh19, Chrm1, Chrm3, Chsy3, Clic6, Cm15, Cnpy1, Cob1, Col1a2, Col4a5, Col6a1, Co1galt2, Corin, Coro6, Cpne7, Crym, Csta1, Ctxn3, Cxcl14, Cxcl5, Cxcr4, Cyp27a1, Cyp2j9, D430019H16Rik, Ddn, Ddx3y, Dlgap2, Dlx4os, D1x6os1, Dmp1, E030003E18Rik, Ebf1, Ebf2, Ebf3, Ednrb, Egfr, Egr3, Eif2s3y, Elfn1, Emp2, En2, Enc1, Etnpp1, Eva1a, F3, Fam107b, Fam19al, Fat2, Fbln2, Fezf2, Fgd3, Flrt2, Folh1, Foxg1, Frem1, Gabra6, Galntl4, Gas1, Gda, Gdf10, Gja1, Gjb6, Gjc3, Gli1, Gli3, Glt25d2, Gm11549, Gm266, Gm5083, Gm5089, Gm5468, Gm5607, Gm8179, Gpr3711, Grik1, Grm5, Hepacam, Hes3, Hs3st2, Hs3st4, Htr2a, Icam5, Icosl, Il22, Iltifb, Irx1, Irx2, Irx5, Itih3, Itpripl2, Kank1, Kcnc2, Kcnfl, Kcnj10, Kcnj16, Kcnj4, Kcnq5, Kcnt2, Kcnv1, Kctd12b, Kdm5d, Lama2, Lamp5, Lcat, Ldb2, Lfng, Lgr6, Lhx1, Lhxlos, Lhx5, Linc-md1, Lrrc7, Lyz14, Ma12, March1, Megf10, Meis2, Mertk, Metrn, Mgst1, Miat, Mlc1, Mmp14, Mpped1, Msx2, Mybpc1, Myh6, Neto1, Nid1, Nkx2-2, Npr3, Npy1r, Nrgn, Nrk, Ntsr2, Nup62c1, Oprd1, P2ryl, Paqr6, Pax3, Pcsk6, Pde1a, Pde5a, Pdgfd, Pdzph1, Pih1h3b, Pkp3, Pla2g7, Plekhd1, Plekho2, Plpp3, Plscr1, Plscr4, Ppplr17, Prkag3, Procr, Prr5, Ptk2b, Ptpn5, Ptprzl, Rabllfip1, Rab27b, Robo3, Rtn4r12, Rxfp1, Slpr1, Scube1, Sdc4, Serpinh1, Skor2, Slc14a1, Slc1a3, Slc24a4, Slc2a10, Slc2a4, Slc30a3, Slc39a12, Slc6a7, Slc7a10, Slc9a3, Slco4c1, Smpx, Sod3, Sparc, Stac, Stk17b, Stk32a, Sycp1, Syt10, Tbr1, Tex36, Tlcd1, Tlr3, Tmem132b, Tmem179, Tmem200a, Tnc, Tox3, Tril, Trim30a, Trp53cor1, Ttpa, Uty, Vip, Vsig2, Vstm2b, Wifl, Zfp385c, Zfp831, Zic1, Zic2, Zic3, Zic4, and Zic5 or others identified herein.

In mice, genes whose expression may be used as markers to identify granule cells or their nuclei include genes that have the greatest change in expression compared to normalized expression in unsorted nuclei include: 2510003B16Rik, 4930449E18Rik, 6430548M08Rik, 6530403H02Rik, 9230112J17Rik, Ablim1, Ablim3, Ackr1, Adamtsl8, Adcy1, Aim, Ak4, Als2, Atp1a1, Atp2b3, Barh12, Bcl2115, Boc, Brinp1, Bsn, Btg1, C130030K03Rik, Cacna1c, Cacna1e, Cacna2d1, Cadm3, Cadps2, Calb2, Caln1, Camk4, Camkk2, Car10, Car15, Car4, Cbln1, Cbln3, Ccdc120, Cd300a, Cdh15, Cdh7, Cdh8, Celf4, Cerk1, Cers6, Chgb, Chn2, Chrd, Cnksr2, Cnnm4, Cntn6, Cntnap1, Cntnap4, Cplx2, Crhr1, Crtam, Dab2ip, Des, Dgkd, Diras2, Dlgap3, Dpp6, Dpys14, Dusp5, Eif4e3, Epb41, Epb4114b, Epha3, Ercl, Ets2, Etvl, Exph5, Faap20, Fam135b, Fat2, Fgf14, Fzd7, Gabra6, Gabrb3, Gabrd, Galnt13, Gap43, Ggact, Gm2694, Gm7854, Gm9899, Gm996, Golga7b, Gprc5c, Grik2, Grin2a, Grin2c, Grm4, Ica11, Igfbp5, 1116, Il20rb, Inad1, Itga7, Jph3, Jph4, Kank2, Kbtbd11, Kcnc1, Kcnd2, Kcnh1, Kcnip4, Kcnj12, Kcnj6, Kcnk1, Kcnk10, Kcnk12, Kcnk3, Kcnk9, Kcnt1, Khnyn, Kif26b, Lgi1, Lhfp, Lin7a, Lrrc3b, Lurap1, Mam13, Mapk11, Mapk12, Marveld2, Mctp1, Mir670, Mmp24, Mpp4, Msra, Ndrg3, Ndst3, Nedd41, Negr1, Neto2, Neurl1a, Neurod1, Nhs12, Nrep, Nrip2, Nrn1, Ntn4, Nxn, Olfm1, Olfm3, Pagr1a, Panx2, Pclo, Pcsk2, Pde10a, Pde3b, Pgm211, Pkib, Plch2, P1c12, Plcxd3, Pld5, Ppargc1b, Ppfia4, Pq1c3, Prkce, Prr16, Prss52, Ptchd1, Ptpn22, Pxylp1, Rab15, Rab37, Raly1, Rapgef4, Rbfox1, Rbfox3, Rcan3, Reln, Rbms1, Rims2, Rims3, Rnf112, Rnf152, Ror1, Rps6ka1, Rtn4r, Rtn4rl1, Ryr2, Scn2a1, Se1113, Sema4f, Sergef, Sgpp2, Sgsm1, Sh3g12, Shf, Shisa8, Sidtl1, Slc16a10, Slc17a7, Slc25a22, Slc29a4, Slc2a13, Slc35f3, Slc8a2, Slc9a5, Slit3, Slitrk4, Snap25, Snrk, Specc1, Speg, Sphkap, Sptb, St3ga15, Stap2, Stmn2, Stxbp1, Stxbp51, Sv2b, Svep1, Svop, Syndig11, Syt1, Syt12, Syt4, Tas2r143, Tbata, Tbc1d8, Tenm1, Tesc, Tiam1, Tll1, Tmem163, Tmem178, Tmem181c-ps, Tmem266, Tmem56, Tmem63c, Tmtc4, Trhde, Ubtd2, Unc13c, Uncx, Usp3, Vat11, Vsn11, Wscd2, Xkr6, Xkr7, Zdhhc2, Zfp385b, and Zic2.

In mice, genes whose expression may be used as markers to identify purkinje or their nuclei include that that have the greatest change in expression compared to normalized expression in unsorted nuclei include: 1190002N15Rik, 1700008003Rik, 1700124L16Rik, 2410124H12Rik, 9530052E02Rik, 9530059O14Rik, A330050F15Rik, Abhd3, Adam23, Adamts3, Adgr12, Aff1, Ank1, Ankrd33b, Ankrd53, Anks1b, Apip, Arap1, Arhgap20, Arhgap26, Arhgef33, Arnt1, At12, Atp2a3, Atp2b2, Atp6ap11, Atp6v1b1, Atrn11, Auts2, B3gnt5, Baiap2, Bcl11a, Bean1, Brinp2, Bzrap1, Cacna1a, Cacna1g, Cacna2d2, Calb1, Camk2a, Car1, Car8, Casq2, Ccdc107, Ccdc85a, Cck, Cds1, Cep126, Cep76, Clec21, Clic6, Clstn3, Cntn3, Cntnap5b, Cntnap5c, Coil8a1, Corin, Cpeb1, Cpne9, Csta1, Cyth3, D430036J16Rik, Dach1, Dagla, Defb23, Dgkg, Dgkh, Dgkz, D1g2, Dlx4os, Dmd, Dner, Doc2b, Dpp10, Ebf1, Ebf2, Ece1, Et14, Fam107b, Fam117a, Fam174b, Fam184b, Fam21, Fam78b, Far2, Fbx121, Fgd3, Fh15, Flt3, Fmnl1, Foxp2, Foxp4, Frmpd3, Gabbr2, Garn13, Gfra2, Gm14169, Gm5083, Gm5803, Gng13, Gpr63, Grid2, Grid2ip, Grik1. Grip1, Grm1, H2-D1, Heatr5a, Hes3, Homer3, Hpcal1, Hrh2, Hspal2a, Htrlb, Icmt, Id2, Ifngr2, 1122, Iltifb, Inpp4a, Inpp5a, Itga3, Itpka, Itpr1, Kalrn, Kcnab1, Kcnab2, Kcnh7, Kcnip1, Kcnma1, Kctd12, Kit1, Ksr2, L3mbtl1, Large, Ldhd, Lhx1, Lhxlos, Lhx5, Linc-md1, Lpcat4, Lrfn5, Lrp8, Lrrfip1, Lsmem1, Magoh, Mcemp1, Mdfi, Mir124a-lhg, Mir138-1, Mir3470b, Mtss1, Myh10, Myo10, Nefh, Nefm, Nek2, Neil1, Nexn, Nin1, Nkiras2, Npr1, Nr2f2, Nrk, Nsg1, Nup93, Ociad2, Orai2, Paxbp1, Pcp2, Pcp4, Pde2a, Pde5a, Pde9a, Pih1h3b, Plcb3, Plekhd1, Plekhdlos, Plpp6, Plxdc1, Pnpla3, Polr1b, Ppplr17, Ppp4r4, Prkag3, Prkcg, Prkg1, Prmt8, Psd2, Ptchd4, Ptprr, Rab43, Rbms1, Reep2, Retn, Rgs8, Rmdn3, Rnf19b, Rreb1, Rtel1, Ryr1, Scn4b, Serinc2, Sestd1, Sh2d4b, Shank1, Shisa6, Skor2, Slc16a9, Slc1a6, Slc20a1, Slc9a3, Smpx, Snhgll, Sorll, Sos1, Sox5os3, Sptan1, Sptbn2, Stac, Steap2, Stil, Stk17b, Strip2, Strn3, Stxbp2, Svi1, Sycp1, Syndig1, Syt7, Tenm4, Tex261, Thy1, Tm6sf1, Tmem255a, Trabd2b, Trpc3, Tspan11, Ttll5, Tuba8, Unc5d, Vax2, Vwa5b2, Ywhah, Zbtb46, Zfand4, Zfp385a, Zfp385c, and Znhit1.

In mice, genes whose expression may be used as markers to identify basket cells or their nuclei include that that have the greatest change in expression compared to normalized expression in unsorted nuclei include: 1700024F13Rik, 1700080N15Rik, 9530026P05Rik, A530058N18Rik, Acot10, Adamts15, Adamts16, Adamts2, Adarb2, Adgr13, Adrb2, Agl, AI504432, Aldh18a1, Aldh112, Aldob, Ankrd13b, Ar, Arl4a, Arl4c, Arrdc1, Asgr1, Asic2, Asl, Asns, Atplb1, Atp2b1, Bex1, Bhlhe22, Btbdl1, Bzw2, Clqtnf4, Cabp1, Cacnalb, Cacnald, Cacna2d3, Cacng2, Camklg, Camk2n1, Cars, Ccdc136, Ccdc74a, Cd59a, Cdkll, Cebpb, Cep70, Cgn, Chac1, Chchd7, Chd3os, Chst1, Chst9, Clmp, Cnpy1, Cnr1, Cntn4, Coro6, Cryba2, Csmd1, Csrnp3, Cx3cl1, Cyld, Cyp4x1, Cyp7b1, Dnahl1, Dock7, Efna5, Elav14, Elmod1, Em15, Enppl, Ephb2, Erc2, Esrrg, Fam84a, Fev, Fgfl3, Flrt2, Frmd3, Fuca2, Gabra1, Gabrg2, Gad1, Gad2, Galnt18, Gars, Gdpd5, Gfra4, Gjd2, Glce, Gldc, Gm11780, Gm14204, Gm15631, Gm15663, Gm2762, Gpr12, Gprasp2, Grb10, Gria3, Grid1, Grik3, Grin2d, Grm8, H2afz, H2-B1, Haus4, Hcn1, Hecw1, Hnrnpa0, Hpca, Hpcal4, Hunk, Igsf3, Inhba, Inpp4b, Kcna2, Kcnab3, Kcns2, Kirre1, Kirrel3, Kit, K1h133, Lamb1, Lrrc38, Lsml1, Ly6e, Lypd6, Maged1, Man2a1, March11, Mgat4c, Mgat5, Mir193b, Mir384, Mkx, Mpp7, Msantd4, Mtfp1, Mthfd2, Myo16, Myrip, Mytl1, Nap112, Nars, Ndn, Nef1, Neurod2, Neurod6, Nln, Nmt2, Nos 1, Noslap, Nrxn3, Ntn1, Osbp110, Osbp15, Pam, Parm1, Penk, Pfkp, Pgrmc1, Phactr2, Phf24, Phyhip, Pja1, Pkp4, Pla2g4e, Plch1, Plcxd2, Plppr4, Plvap, Plxna4, Plxnc1, Pnck, Ppp1cc, Prdm8, Prkcd, Prrg3, Ptchd2, Purb, RablOos, Rab3c, Rai2, Rasgrf1, Ras110b, Rec8, Ret, Rmst, Rora, Rph3a, Rp115, Scn9a, Sdk2, Sema3e, Serpini1, Sesn2, Sez6, Sgk1, Sgtb, Shank3, Skor1, Slc12a5, Slc19a2, Slc1a4, Slc24a3, Slc2a3, Slc32a1, Slc4a8, Slc6a7, Slc7a1, Slc7a3, Snph, Socs2, Sod2, Sorbs2, Sorcs3, Spy, Stac2, Stard5, Stc2, Syt13, Tbc1d30, Tbc1d4, Tfap2a, Tfap2b, Tmem117, Tmem132e, Tmem151b, Tmem169, Tmem25, Tram111, Trib3, Trim67, Tro, Trpc5, Trpc7, Tspyl4, Ttc39b, Ttc9, Unc5c, Usp1, Vmn2r2, Wasfl, Wbscr17, Wfs1, Xkr4, Zbtb18, Zcchc16, and Zfp423.

In mice, genes whose expression may be used as markers to identify astrocytes or their nuclei include genes that have the greatest change in expression compared to normalized expression in unsorted nuclei include: 1700066O22Rik, 2810032G03Rik, 3110082J24Rik, 9330188P03Rik, A2m, A330033J07Rik, Abi3bp, Acotll, Acsbg1, Actr3b, Adrala, AI464131, Akt2, Aldh111, Almsl-ps2, Apoe, Aqp4, Arrb1, Atp13a4, Atp1a2, Atp1b2, AU022751, Axl, Baalc, Bcar3, Btbd17, Cables1, Cacnb1, Cacng5, Cacng8, Camk1, Camk2g, Caskin1, Cbs, Ccdc190, Ccdc78, Cd70, Cdc42ep1, Cdc42ep4, Cdh22, Cdh4, Celrr, Clcn2, Clu, Cm15, Cmya5, Cnn3, Cpne2, Ctxn3, Cxcl14, Cyp2d22, Cyp4fl4, D330050G23Rik, Dao, Ddah1, Ddo, Dmpl, E030003E18Rik, Ednrb, Efhd2, Efnb2, Egfr, Elmo2, Elovl2, Emid1, Erich5, Etnpp1, Etv4, Evala, F830045P16Rik, Fads2, Fam107a, Fam173a, Fam20a, Fam43a, Fam92b, Fgd6, Fgfr3, Frem1, Frmpdl, Fxyd1, Fxyd7, Fzd1, Gabra2, Gabra4, Gabrb1, Garem1, Gas213, Gdf10, Gja1, Gjb6, Gli1, Gli2, Glipr2, Gm5089, Gm6277, Gpr153, Grebll, Gria1, Gsap, Gstm1, Hif3a, Hk2, Hopx, Hrh1, Htra3, Icos1, Id4, Igdcc3, Igdcc4, Itih3, Itpkb, Kifc3, Klf15, Lama2, Lcat, Lfng, Lgi4, Lgr6, Lrig1, Lrp3, Lrrc8a, Manlc1, Map2k6, Mertk, Metrn, Mfge8, Micalc1, Mir3093, Mir6375, Mir6390, M1c1, Mmd2, Mpp6, Mro, Msi1, Msx2, Mtl, Mt2, Mt3, Mxra8, Mybpcl, N4bp3, Nat8, Nbll, Ndrg2, Nhsl1, Nkain4, Nrld1, Ntsr2, Nudt14, Nwd1, Oplah, Paqr6, Paqr8, Pax3, Pbxip1, Pde8b, Pdlim4, Phf21b, Phka1, Phkg1, Phyhd1, Pitpnc1, Pitpnm2, Pla2g7, Plcel, Plekho2, Plpp3, Plscr4, Pltp, Plxnb1, Pnky, Pnpla7, Por, Ppmlm, Prex2, Proca1, Prodh, Prr5, Ptch1, Ptch2, Pxmp2, Pyroxd2, Rab34, Rab36, Ramp2, Rash Rbm24, Rdh5, Rfx2, Rfx4, Rgl1, Rgma, Rpph1, Rpusd3, Rras, Slpr1, Sdc4, Sfxn1, Sfxn5, Sh3pxd2b, Shisa9, Sirpa, Slc12a4, Slc13a5, Slc1a2, Slc1a3, Slc25a18, Slc27a1, Slc38a1, Slc38a3, Slc39a12, Slc4lal, Slc4a4, Slc7a10, Slc8b1, Slco4a1, Smad3, Smim23, Sned1, Sod3, Sox9, Sparc, Sparcl1, Stk32a, Synpo2, Syt10, Tapbp1, Tcf711, Tmem198b, Tnc, Tom111, Trafl, Trib2, Tri1, Trp53cor1, Tt113, Tt118, Ttyh1, Ttyh3, Ucp2, Vim, Wwc1, Zfp467, Zfp641, Zic1, Zic4, and Ziml.

In mice, genes whose expression may be used as markers to identify oligodendrocytes or their nuclei include that that have the greatest change in expression compared to normalized expression in unsorted nuclei include: 1500015L24Rik, 1700063D05Rik, 4930474G06Rik, 4933413G19Rik, 5031410I06Rik, 5031439G07Rik, 5430431A17Rik, 9330111N05Rik, 9330117O12Rik, A230001M1ORik, A330049N07Rik, Aatk, Abca8a, Adamtsl4, Adapl, Adipor2, Agpat4, Ankub1, Ano4, Apod, Arc, Arhgap23, Arhgefl0, Arl4d, Arrdc2, Arrdc3, Arsg, Aspa, Asphd1, B3galt5, Bche, Bcl211, Bicd2, Bin1, Bpgm, C030029H02Rik, C630043F03Rik, Car14, Car2, Carns1, Ccdc152, Ccp110, Cdh19, Cdk18, Cdk19, Cep97, Cers2, Chdh, Cldn11, Cnp, Cntn2, Cpm, Cpox, Creb5, Cryab, Cyp2j12, D16Ertd472e, DlErtd622e, D7Ertd443e, Daam2, Ddit4, Ddr1, Degs1, Depdc7, Dnajb2, Dock10, Dock5, Dpyl911, Dusp26, Edi13, Efnb3, Elov17, Endod1, Enpp2, Enpp4, Erbb2ip, Erbb3, Ermn, Fa2h, Fam134b, Fam46a, Fbxo32, Fbxw15, Folh1, Frmd4b, Fth1, Gab1, Galnt5, Galnt6, Gatm, Gbpl1, Gjb1, Gjc2, Glu1, Gm10471, Gm1979, Gm21671, Gm5535, Gm5862, Gm7361, Gm9895, Gngl1, Gng8, Gpr37, Gpt, Grm3, Gstm7, Hapin2, Hebp1, I730030J21Rik, 1133, Inf2, Insc, Josd2, Kcnj2, Kcnk13, Kctd13, Kctd3, Kif13b, K1h12, Klk6, Kndc1, Lap3, Larp6, Lipa, Litaf, Lrrc8b, Lzts2, Mag, Mal, Map6d1, Map7, Mast3, Mast4, Mboat1, Mbp, Mcam, Mobp, Mog, Myold, Myrf, Ndrg1, Neath 1, NF213, NLRB4, IPA14, Nkain1, Nkain2, Nmrall, Olfmll, Opalin, Osbp17, Pacrg, Pacs2, Pak7, Pde4b, Pde8a, Pex51, Phlpp1, Piga, Pigz, Pik3c2b, Pim3, Pip4k2a, Pkd211, Pla2g16, Plc11, Plekhg3, Plekhh1, Plp1, P1s1, Plxnb3, Ppfibp2, Ppplrl4a, Prickle2, Prima1, Prox1, Prr18, Prr51, Prrg1, Psat1, Pstpip2, Ptgds, Ptma, Ptprd, Qdpr, Rasgrp3, Rcbtb1, Rffl, Rhob, Rhou, Rnf220, Rnf7, Rtn4, S1pr5, Sal11, Sccpdh, Secl 1c, Sec1415, Serpinbla, Sez612, Sgk2, Sh3tc2, Shisa4, Shtn1, Slain1, S1c12a2, S1c25a13, S1c38a2, S1c48a1, S1c7a15, Smad7, Sox2ot, Speer4a, Spg20, St18, St6galnac3, Stmn1, Stmn4, Stxbp6, Synj2, Syt12, Tbc1d5, Thumpd1, Tmeff1, Tmeff2, Tmem125, Tmem151a, Tmem229a, Tmem258, Tmem63a, Tmem88b, Tmem98, Tmprss5, Tnfaip6, Tnni1, Tppp, Trf, Trim36, Trim59, Tspan2, Tt117, Tubb4a, Ugt8a, Usp31, Usp54, Vmp1, Xafl, and Zdhhc20.

In mice, genes whose expression may be used as markers to identify oligodendrocyte progenitor cells (OPCs) or their nuclei include that that have the greatest change in expression compared to normalized expression in unsorted nuclei include: 1700086L19Rik, 1810041L15Rik, 5730559C18Rik, 6330403K07Rik, 8030451007Rik, A230077H06Rik, A730017C20Rik, Abcg2, Abhd2, Abtb2, Adam12, Adm, Alcam, Amz1, Arhgap24, Asap3, Ascl1, B3gat2, B9d1, Basp1, Bcas1, Bmp4, Brinp3, C1q11, C1q12, Cacng4, Calcr1, Cav1, Cav2, Ccnd1, Cd200, Cdh13, Cdh24, Cdo1, Cfap20, Chad1, Chst11, Chst2, Chst3, Chst5, Cobl, Col11a2, Co127a1, Csgalnact1, Csnk2a2, Cspg4, Cspg5, Ctxn1, Cysrt1, Dbpht2, Dcc, Dpm3, Dpys13, Dscam, Ebf4, Eid2b, Elfn1, Elfn2, Enpp6, Epb4112, Epn2, Eya1, Fam19a2, Fam3c, Fam89a, Fbn2, Fdps, Fh13, Frrs1, Ftsj2, Fzd9, G0s2, Galnt3, Gfpt2, Gfra1, Gng4, Grm5, Gsxl, H2-K1, Has2, Hiplr, Hrk, Ick, Ifitm7, Igfbp3, Itga9, Itpr2, Kcnh5, Kcnh8, Khdrbs3, K1h15, Lbh, Lhfp13, Limd1, Lims2, Lmcd1, Lpcat2, Lrfn2, Lrrc4c, Lrrtm4, Marcks, Matn1, Matn4, Mex3b, Mfsd2a, Miat, Mir17, Mmp15, Mmp16, Mmp2, Myc1, Myt1, Ncan, Neto1, Neu4, Nova1, Nxph1, O1fm2, O1ig2, Opcm1, Oprl1, Pcdh15, Pcdh17, Pcdh7, Pdgfra, Pdzd2, Pfn2, Phldal, Pmepa1, Ppfibp1, Ppp2r2b, Prr36, Prss23, Prss48, Ptgfrn, Ptpro, Pxdc1, Qpct, Rapgef3, Rasgeflb, Rcn1, Rep15, Rgcc, Rin2, Rlbp1, Rnd2, Rnf122, Rp113, Rprm, S100a3, S100a4, S1pr2, Sapcd2, Sce1, Scrg1, Sema3d, Sema5a, Sema5b, Serpine2, Sertm1, Sh3bp4, Sh3rf1, Slcla1, Slc22a23, Slc35f1, Slc44a5, Slitrk3, Slitrk5, Slitrk6, Snhg5, Snx1, Snx22, Sox10, Sox4, Sox6, Spry4, Sstr1, Sulf2, Susd5, Tac1, Tes, Tgfa, Tmem100, Tmem132b, Tmem176b, Tnr, Tns3, Tox3, Tspan6, Vash1, Vcan, Vmn1r55, Vpreb1, Vstm2b, Vwc2, Xylt1, Zc3hav11, Zdhhc23, Zfp365, and Zfp488.

In some embodiments, one, two, three, or more, including sets, subsets of 4, 5, 6, 7, 8, 9, 10, 11, 12, 13, 14, 15, 16, 17, 18, 19, 20, 25, 30, 40, 50 or more markers listed may be used to identify nuclei of any one or more of granule cells, basket cells, astrocytes, oligodendrocytes, and OPCs from any of humans, mice, rats, or non-human primates. Hierarchical clustering may be used to visualize the degree of similarity among RNAseq profiles.

2. Differences in the RNA Profile in Sorted Nuclei From Rats

In some embodiments, nuclei from rat tissue are sorted into groups of nuclei from granule cells, purkinje cells, basket cells, astrocytes, oligodendrocytes, and OPCs. A gene that is differentially expressed compared to the normalized expression across granule cells, purkinje cells, astrocytes, oligodendrocytes, and OPCs may be used as a marker. For example, expression or lack of expression of at least one of the differentially expressed genes selected from: AABR07001623.1, AABR07001734.1, AABR07006310.1, AABR07006713.1, AABR07006713.2, AABR07006727.1, AABR07013140.1, AABR07026032.2, AABR07030473.1, AABR07030880.1, AABR07046961.1, AABR07047823.1, AABR07049491.1, AABR07052897.1, AABR07058658.1, AABR07061428.1, AABR07070161.1, AABR07070161.6, AABR07070578.1, Abi3, Aqp9, Arhgef26, Arhgef33, Arl4a, B3gnt5, Bgn, C1q11, C1q12, Cacng5, Cadps2, Calb1, Calb2, Car4, Car8, Cav1, Cbln1, Ccnd1, Cdh15, Cdk2, Cep76, Cldn11, Clmp, Col12a1, Col5a3, Cspg4, Cyp2d5, Enpp1, Ermn, Fam107b, Fam89a, Fat2, Gabra6, Gabrd, Gdf10, Gjd2, Gldc, Gli1, Gpr37, Gpr63, Grm8, Hapin2, Hpcal4, Id4, 1116, Itga7, Itga9, Itih3, Itpr1, Kcnh1, Kcnj12, Klk6, Lama3, Lfng, Lgi4, Lims2, Lypd6, Mag, Ma1, March11, Mobp, Mog, Msx2, Mt2A, Nkain4, Opalin, Pdg-fra, Plchl, Plk2, Plxdc1, Pme1, Pou3f2, Ppfibp1, Ppplrl7, Prr51, Prrt2, Qdpr, Rasgrp3, Rbfox3, RGD1561557, RGD1561849, Rlbp1, Ryr1, Slpr1, Scara3, Selplg, Serpine2, Slc1a6, Slc25a18, Slc5a11, Slc7a10, Slc9a3, Snx22, Sorcs3, Sv2b, Tesc, Tmem255b, Tmem63a, Tmem88b, Tnc, and Zfp385c and may be used as a species specific and cell type specific marker.

In rats, genes whose expression may be used as markers to identify granule cells or their nuclei include significantly enriched expression of Fat2 and Rbfox3 compared to nor- malized expression in unsorted nuclei. Genes that may be used as markers to identify purkinje cells or their nuclei include significantly enriched expression of Car8 and Calb1. Genes that may be used as markers to identify Bergmann glia or their nuclei include significantly enriched expression of Aldh1L1 and Slc1a3. Genes that may be used as markers to identify oligodendroctyes (corticopontine pyramidal cells) or their nuclei include significantly enriched expression of Colgalt2. Genes that may be used as markers to identify Bergmann glia or their nuclei include significantly enriched expression of Hs3st4 was observed to be specific to corticothalamic pyramidal cells, while Pde1a and Csmd1 were observed to be expressed in oligodendrocytes and OPCs (both cortical pyramidal cell types).

In some embodiments, expression of Itih3 may be used as a marker of both Bergmann glia, a type of astrocyte, and non-Bergmann glia astrocytes of the cerebellum. Additional markers for the nuclei of the 6 cell types may include: Tescalcin (Tesc) for granule cell nuclei, Carbonic Anhydrase 8 (Car8) for purkinje cell nuclei, March11 for basket cell nuclei, Inter-Alpha-Trypsin Inhibitor Heavy Chain 3 (Itih3) for astrocyte nuclei, Mog for oligodendrocyte nuclei, and Platelet Derived Growth Factor Receptor Alpha (Pdgfra) for oligodendrocyte progenitor cell nuclei.

In some embodiments, the Allen Mouse Brain Atlas in situ hybridization database was used to analyze the localization of the markers to confirm cell type.

In some embodiments, one, two, three, or more, including sets, subsets of 4, 5, 6, 7, 8, 9, 10, 11, 12, 13, 14, 15, 16, 17, 18, 19, 20, 25, 30, 40, 50 or more markers listed may be used to identify nuclei of any one or more of granule cells, basket cells, astrocytes, oligodendrocytes, and OPCs from any of humans, mice, rats, or non-human primates. Hierarchical clustering may be used to visualize the degree of similarity among RNAseq profiles.

3. Differences in the RNA Profile in Sorted Nuclei From Humans

Analysis of samples from sixteen human postmortem brains revealed that the specific molecular consequences of aging, gender, autolysis time of the tissue sample, and stress differ between cell types, although in each case, expression of genes involved in synapse development and maintenance was diminished. A robust and cell-type specific molecular pathway was indicative of a pathophysiological response occurred in the brains of three of sixteen donors. Cerebellar granule cells the three brain samples were observed to exhibit robust induction of a set of 224 genes containing many immediate early genes and were enriched for GO categories (protein folding/refolding, apoptosis, transcrip-tional response to stress, response to external stimuli, ATPase activity, etc.) indicating an acute response to some external influence; yet no shared clinical conditions were apparent for these donors. As stated in the Examples, no correlation with autolysis time and no induction of glial markers indicative of stroke or brain damage has been evident. Although activity dependent gene expression changes have been characterized extensively in cultured mouse granule cells, the response identified in these three human samples was overlapping but distinctive. Results herein guideposts for experimental investigation of model systems or iPS cells aimed at identification of signals that elicited these responses in the human brain. The molecular profiling using the cellular profiling technique described herein can be applied to any species and provides an avenue for investigation of molecular events associated with human cell type function and dysfunction.

In some embodiments, increased expression for Rbfox3 and Fat2 may be used as markers for nuclei from granule cells in humans. Alternatively, increased expression for March11 may be used as a marker for nuclei from basket/ stellate cells in humans. Alternatively, increased expression for Aldh1a1 and Slc1a3 may be used as markers for nuclei astrocytes in humans. Alternatively, increased expression for Mog may be used as a marker for mature oligodendrocytes. Alternateivly, increased expression for Pdgfra and chondroitin sulfate proteoglycan 4 (Cspg4) may be used as markers for OPCs.

In some embodiments, one, two, three, or more, including sets, subsets of 4, 5, 6, 7, 8, 9, 10, 11, 12, 13, 14, 15, 16, 17, 18, 19, 20, 25, 30, 40, 50 or more markers listed may be used to identify nuclei of any one or more of granule cells, basket cells, astrocytes, oligodendrocytes, and OPCs from any of humans, mice, rats, or non-human primates. Hierarchical clustering may be used to visualize the degree of similarity among RNAseq profiles.

C. Directly Defining Human Cell Types

The cellular profiling technique described herein may be also used independently of the cell types that have been characterized in mice because there are differences between neurons from mouse and human, and there may be human-specific neuronal subtypes. Putative cell-type specific genes for sorting were identified by examining the transcriptional profile of unsorted nuclei from a region of interest. In mice, chromosomal associated transcripts (CATs) and polyA+ transcripts that were observed to be expressed at low levels in unsorted nuclei were often expressed at high levels in one or a few cell types. The differences between species were explored for different cell types, and the findings were supported by in situ hybridization and immunofluorescence. Human nuclear RNAs from specific cell types were profiled using the same strategy in the context of cellular profiling method described herein.

IV. Comparative Analysis of Nuclear Profiles

The isolation and transcription profiling nuclei of multiple cell types from mice, rats, and humans are described herein. For example, the cell types originate in basal ganglia, thalamus, cerebellum, or hippocampus tissue. Cell types that originate in the cerebellum include: Purkinje cells, granule cells, Bergmann glia, basket/stellate cells, astrocytes, oligodendrocytes, and cerebellar deep nuclei cells. These samples were sequenced for analysis to determine differences between individuals and across species. In some embodiments, results are validated by in situ hybridization on tissue slices.

The driving force for development of an accurate and efficient nongenetic method for characterization of the molecular properties of defined CNS cell types is to enable direct investigation of human biology. Major differences are observed between gene expression in the same cell type between mice and humans. Given the tremendous explosion of studies identifying the genetic causes of human disease and the astounding demonstrations in both animal models and humans that these can include lesions that involve simple changes in gene dosage, exploration of details of cell types in normal and affected brains is imperative. Therefore, comparative analysis of data obtained in experimental systems using the cellular profiling technique described herein showing human cell type specific characteristics will advance understanding of the large variety of human disorders that impact CNS circuits.

A recent evolutionary model (Arendt, D. (2008). Nat Rev Genet 9, 868-882 and Arendt, et al. (2016) Nat Rev Genet 17, 744-757, each of which are hereby incorporated by reference herein in its entirety) was a helpful consensus definition of cell type for consideration of the data generated using the cellular profiling technique described herein. According to this model, the specific characteristics of homologous cell types can vary as long as they remain defined by a distinctive, shared regulatory apparatus. For example, Purkinje cell, granule cell, or astrocyte gene expression profiles can vary between species, or even in individual cells of a type, without losing their cell type identity. This definition accommodates both functional changes in cell types between species and altered expression of genes within the cell type due to mutations in cis-regulatory sequences. The data herein documents major differences in the expression of orthologous genes in each cell type between rodent and human brains. Hundreds of these differences are cell-type specific and, in granule neurons, most of these genes remain expressed in other regions of the brain. These data demonstrate that the fine-tuned biochemistry of homologous human and mouse CNS cell types differs significantly.

The results presented here contribute two major insights into mammalian brain evolution. First, while they are consistent with previous published examples of cis-regulatory sequence divergence as a mechanism of evolution (Maricic, et al. (2012) Molecular Biology and Evolution 30, 844-852; Prud'homme, et al. (2006) Nature 440, 1050-1053; Weyer et al., Mol Biol Evol. 2016 February; 33(2): 316-322, 2015; each of which is hereby incorporated by reference herein in its entirety), the lack of highly enriched GO categories for most of the cell specific events documented herein suggests strongly that regulatory changes are major drivers of phenotypic variation between homologous cell types in mammalian brain. This is consistent with the evolutionary model presented above, since it allows substantial evolution of the functional properties of the cell while maintaining the core regulatory complex (CoRC) that defines a given cell type (Arendt, et al. (2016) Nat Rev Genet 17, 744-757, which is hereby incorporated by reference herein in its entirety). Second, the expression differences documented herein are large, and the analysis was restricted to high confidence orthologous genes. The data complement a previous study of progenitor cells that reported substantive changes in the expression of human genes that lack mouse orthologues (Florio et al, Science. 2015 Mar. 27; 347(6229):1465-70, which is hereby incorporated by reference herein in its entirety). If taken together, these datasets predict that the expressed differences between mouse and human cell types are extensive, cell-type specific, and phenotypically important.

In certain embodiments of profiling human samples using the methods herein, the correlation coefficients were between samples (r=0.98–1.0) indicating that the results are extremely reproducible, and that that the impact of autolysis time on the expression profile of nuclear RNAs is minor. Initial indications that gender and age impact gene expression differently in CNS cell types indicated that the cellular profiling technique described herein is sufficiently accurate for detailed investigation of both sexually dimorphic human behaviors and the aging of specific brain circuitry. For example, comparative analysis of human brains by cellular profiling technique described herein provides insight into the impacts of aging on cell types that are selectively vulnerable into late-onset human disorders.

A. Identifying Cell Type Specific Functions Differing Among Species

While the organization of the cells in the cerebellum is similar between mouse and human, many differences remain. For example, Purkinje cells are much more spread out and NeuN– cells are expanded in the Purkinje layer in human cells compared to mouse cells, which is evidence that the human cerebellum has a different organization compared to mouse. Additionally, the size of Purkinje cell bodies and nuclei are bigger in human compared to mouse. In some embodiments, RNAseq may be used to compare gene expression between species to identify specifies specific markers. For example, protein tyrosine kinase 2 beta (Ptk2b), solute carrier family 43 member 2 (Slc43a2), glutamate ionotropic receptor kainate type subunit 3 (Grik3), Itpr1, protocadherin 9 (Pcdh9), and RAS guanyl releasing ptotein 1 (Rasgrp1) nuclei from granule, stellate, and glia cells may be used to differentiate between human and mice nuclei. Because the cerebellum is one of the most conserved brain structures across species, more structural and molecular differences are more likely to be observed in other brain regions.

Although heterogeneity may be shown between samples from the same species, the genes most specific to each cell type in different species may be used as unique markers of the cell types. In some embodiments, expression of more than one gene may be used to identify a particular cell type. Genes differentially expressed compared to normalized expression across all cell types, such as granule cells, purkinje cells, astroctyes, oligodendrocytes, and OPCs, may be eliminated from analysis to identify at least one marker for the cell type of interest.

In some embodiments, the most specific genes are calculated using the algorithm for the Specificity Index (SI) as described herein. For example, the most specific genes (ordered by decreasing specificity) in the nuclei of granule cells derived from human samples are Cadps2, Reln, Synpr, Galnt5, Ccm21, Srrm4, Tmem266, Cckbr, Cerk1, Chn2, Grik2, Ma12, Fat2, Adamts16, Lcn8, Fst15, Tll1, Vsnl1, Rit2, Slc8a2, Slc17a7, Zp2, Tspan18, Fgf5, Prag1, Slc6a7, Rims1, Cdh7, Llcam, Mical2, Ptk2b, Kcnh1, Arhgap29, Cdk15, Pde3b, Itga4, Etv1, Tmem178, Chgb, Coll3a1, Rnf152, Kcnk1, 1116, Sstr2, Als2, Barhl1, Scn2a, Cbln1, Dusp5, Ndst3, Lurap11, Kcnj12, Snai2, Ifnlr1, Neurod1, Cdyl2, Ppplrlc, Jkamp, Neurl1a, Trhde, Mfsd9, Xkr7, Barh12, Cbln3, Uncx, Ptchd1, Cblb, Runxlt1, Sphkap, Gabra6, Coro2a, Bmper, Dkk4, Camk4, Unc13c, Trp53i11, Ephb1, Glb113, Mdga1, Kcnc1, Tmem252, Mpp7, Hipk4, Tmem51, Cacnb3, Cyb5a, Tmem2, 6430573F11Rik, Rasgrp1, Rab37, Adarb1, Svop, Pgm5, Mthfdl1, Cdh15, Vwc2, Disp2, Tspan15, Slc26a5, and Lhfp. For example, the most specific genes (ordered by decreasing specificity) in the nuclei of granule cells derived from mouse samples are Gabra6, Grin2c, Fat2, Cadps2, Ptpn22, Chn2, Neurod1, Calb2, Trhde, 1116, Ppfia4, Cbin1, Sidt1, Tmem266, Gabrd, Rein, Kcnj12, Gprc5c, Rims3, Tll1, Cbin3, O1fm3, Slc17a7, Chgb, Kcnh1, Cdh15, Barh12, Dusp5, Kcnc1, Camk4, Des, Cerk1, Svep1, Uncx, Slc8a2, Cacna2d1, Pxylp1, Ptchd1, Se1113, Rtn4r, Cacnale, Patj, Atp2b3, Marveld2, Kcnk10, Rab15, Rapgef4, Rims1, Tmem178, Ak4, Lin7a, Igfbp5, Tesc, Neurl1a, Vat11, Msra, Vsnl1, Rps6ka1, Lhfp, Kcnk3, Ryr2, Exph5, Kif26b, Adamts18, Cntnap4, Tspan18, Mmp24, Cdh8, Ablim3, Cadm3, Ntf3, Pld5, Syndig11, Galnt15, Etv1, Sh2d1a, Scn2a, Panx2, Speg, Bsn, Rnfl12, I12Orb, Slc16a10, Ntn4, Adcy1, Mapk12, Boc, Syt12, Fst15, Tead4, Clcn1, Pde3b, Pgm211, Tmtc4, Abcc8, Olfm1, Nedd41, Lurap1, Krt24, and Als2. For example, the most specific genes (ordered by decreasing specificity) in the nuclei of granule cells derived from rat samples are Tesc, Itga7, Rbfox3, AABR07013140.1, Calb2, Kcnh1, Cdh15, AABR07030880.1, Prrt2, Gabrd, 1116, Scara3, Cbin1, AABR07026032.2, Cadps2, Sv2b, Fat2, Gabra6, Car4, Kcnj12, Nrep, AABR07043098.3, Rtn4r, Shisa8, Se1113, Grb7, Rg13, Dusp5, Chn2, Lamp5, Pagr1, Cemip, Gprc5c, Shf, Wdr66, Tmem44, Reln, Tll1, Slc17a7, Pax6, Capn1, Calhm3, AABR07043098.1, Camk4, Selm, Sema3g, LOC100360491, Diras2, Agb12, Mctp1, Mvp, Tmem51, Vsnl1, Plk5, Mrgprf, LOC100910401, Ak4, Wscd2, Grin2a, Cfap74, Rnf39, Cbin3, Fzd7, Golga7b, AABR07033679.1, Ptpn22, Grin2c, Ablim1, Kcnk1, Arpp21, Clr1, Zscan30, Maf, Rtn4r11, Barh12, Kcnk12, Act16b, AABR07053850.1, Sdc1, Camkk2, Nudcd3, Ccdc155, Cbfa2t3, AABR07037151.1, Etv1, Jph3, Itga11, Rnf182, RGD1560784, Plcxd3, Ablim3, Rims1, Nyx, Uncx, AABR07034445.1, AABR07025051.3, Kcnk10, Kcnk3, Nol3, and Als2.

For example, the most specific genes (ordered by decreasing specificity) in the nuclei of purkinje cells derived from mouse samples are Car8, Calb1, Arhgef33, Atp2a3, Itpr1, Ppplr17, Slcla6, Slc9a3, Trpc3, Casq2, Clic6, Plekhd1, Ryr1, Cacna1g, Pcp2, Sycp1, Pde5a, Tspan11, Gpr63, Neil1, Cep76, Bcll1a, Grid2ip, Htrlb, Pet100, Strip2, Plxdc1, Skor2, Dagla, Garn13, Itpka, Myo10, Gng13, Kcnip1, Trabd2b, Rnf207, Scn4b, Arhgap20, Grip1, Pde9a, Ppp4r4, Cck, Ebf1, Bean1, Tuba8, Smpx, Ebf2, Slc19a1, Ccdc85a, Flt3, Camk2a, Sh2d4b, Homer3, Stkl7b, Clec21, Hrh2, Ksr2, Chtf18, Vax2, Foxp4, Ankrd33b, Cpne9, Corin, 1122, Prkag3, Cep126, S1c20a1, Akain1, Nrk, Pihlh3b, Inpp5a, Lhx1, Sptbn2, Paxbp1, Dner, Doc2b, Tspoap1, Gfra2, Fh15, Dmd, Kcnab2, Serinc2, Car7, Dnah6, Prmt8, Prkcg, Mdfi, Dgkh, Fam117a, Nek2, Fmn11, At12, Cfap161, Lin28b, Cacna2d2, Ptchd4, Pkp3, Shank1, Grid2, Nefh. For example, the most specific genes (ordered by decreasing specificity) in the nuclei of purkinje cells derived from rat samples are: Arhgef33, Car8, Slcla6, Calb1, Ppplr17, Itpr1, Zfp385c, Ryr1, AABR07030473.1, Slc9a3, AABR07006713.1, AABR07006713.2, RGD1561557, Gpr63, AABR07049491.1, AABR07006727.1, Plxdc1, Cep76, Fam107b, B3gnt5, Far2, AC108261.1, Grid2ip, AABR07072628.1, Kcnip1, AABR07006724.1, Trpc3, Phka2, Car7, Fam117a, Hes3, Casq2, Dgkh, Arhgap26, Trabd2b, Nell1, Bcl11a, Col18a1, LOC100125362, Ptchd4, Camk2a, Dyrk4, Kitlg, Kcnab1, Nxn12, Ltk, LOC689927, AABR07056156.1, Cpne8, Htrlb, AABR07033570.1, Icmt, AABR07047598.1, Cstf2t, Grik1, Itpka, LOC100910996, Hpcal1, Efna5, Myo10, Rgs8, Skor2, 1122, Slc12a3, Cpne9, AABR07007980.2, Cacna1g, Doc2b, Sptbn2, LOC108351705, AABR07035926.1, AABR07037943.1, Pcp2, AABR07061860.1, AABR07024820.1, Impg1, Nkiras2, Krtap12-2, Tmem123, AABR07044009.1, Ptprr, Homer3, Garn13, Sos1, Kcnab1, Cntn3, LOC304725, Stk17b, AABR07047604.1, Zdhhc23, Scn4b, AC126640.1, Pde9a, Ptprb, Prkcg, Pcp4, AABR07056374.1, Fstl4, Ppp4r4, and Nup93.

For example, the most specific genes (ordered by decreasing specificity) in the nuclei of basket cells derived from human samples are: Bhlhe22, March11, Kit, Tfap2b, Clmp, Lbx1, Slc38a5, Frmd3, Btbdl1, Lipg, Rab3b, Lrrc38, Galnt14, Cnr1, Tcerg11, Cbln2, Siah3, Stac2, Scgn, Rspo1, Lmcd1, Lp1, Adra1b, Gad2, Chrna3, Socs2, Trpc6, Kcna3, Syn3, Em15, Nefl, Fam84a, Trpc5, KIAA1644, Hrh3, Disp3, Tfap2a, Gjd2, Adamts2, Sorcs3, Ptprk, Timp3, Gjb4, Ehd3, Cxcl12, Actc1, Pnma2, Fam43a, Adam11, Dact2, Rgs16, Slc5a8, Exph5, Cfap221, Myo16, Megfl0, Cacna1d, Pax2, Efna5, Plch1, Gabrg2, Prrt4, Itga5, Sp5, Nefm, Grik3, Cx3cl1, Fbxo24, Lect2, Nefh, Efnb3, Grk3, Mpz, Syt2, Scrt1, Cdc42ep3, Trim67, Grin2b, Rab3c, Plxna4, Fzd8, Elmod1, Smim17, Slc8a3, Nrip3, Plekhg5, Arl4a, Grm8, Cntnap5a, Maats1, Lox12, Arap3, Dcx, Nyap2, Skor1, Pvalb, Ppm1j, Slc5a4a, Tmem132e, and Cygb. For example, the most specific genes (ordered by decreasing specificity) in the nuclei of basket cells derived from mouse samples are: Adamts15, March11, Tfap2b, Socs2, Penk, Bhlhe22, Plch1, Adamts16, Adrb2, Frmd3, Clmp, Cacna2d3, Trpc7, Galnt18, Tbc1d4, Asgr1, Kit, Tfap2a, Fam84a, Gjd2, Grik3, Lrrc38, Chst9, Flrt2, Chac1, Grm8, Esrrg, Slc6a7, Pla2g4e, Stac2, Cabp1, Phf24, Camklg, Btbdl1, Stc2, Sorcs3, Lamb1, Trpc5, Coro6, Slc32a1, Kirre1, Cdkl1, Chst1, Asns, Sp5, Cryba2, Aldh1l2, Kcnab3, Tg, Plxna4, Prkcd, Cgn, Tcte1, Trim67, Osbpl10, Serpini1, Slc7a1, Gpr22, Cntn4, Skor1, Slc7a3, Atplb1, Kcna2, Cebpb, Parm1, Dock7, Em15, Cnih3, Asic2, Hpcal4, Adamts2, Masp1, Plxnc1, Gabrg2, Mtfp1, Ntn1, Ret, Zfp423, Nln, Man2a1, Neurod6, Grin2d, Angptl3, Cnr1, Tmem132e, Apcdd1, Rasgrf1, Hcn1, Scnn1g, Ly6e, Pax2, Rab3c, Rph3a, Rai2, Gad2, Mpp7, Arl4a, Igsf3, Tmem179, and Sorbs2. For example, the most specific genes (ordered by decreasing specificity) in the nuclei of basket cells derived from rat samples are: Plch1, AABR07001734.1, Lypd6, Lama3, March11, Gldc, Grm8, AABR07047823.1, AABR07001623.1, Gjd2, Arl4a, AABR07070578.1, Hpcal4, AABR07061428.1, Col12a1, Enpp1, Sorcs3, Clmp, Plk2, Arhgef26, RGD1561667, Asic2, AABR07026472.1, AC124896.1, Trpc5, AABR07052084.1, AABR07059478.1, Kit, Nt5dc2, AABR07041885.1, Hcn1, Skor1, Prdm8, Phf24, Esrrg, Grik3, Bhlhe22, Mir346, Tmem200a, AABR07003600.7, Scn9a, Inpp4b, Ace, Kcna2, Adra1d, Slc32a1, Cntnap4, Grid1, Trpc7, Begain, AABR07049535.3, Frmpd4, Tfap2b, Cnr1, AABR07054088.3, Zcchc16, Trpv6, Grb10, Pax2, Nrxn3, Tyms, Grid1, Mytl1, Disp3, AABR07063359.1, Btn1a1, Rn60_10_0565.6, AABR07041972.1, Osbpl10, Six4, Mir384, Tbc1d4, Cabp1, AABR07003600.2, AABR07057590.1, Adrb2, Cacna1d, Plxnc1, Dusp22, Hecw1, Gdpd4, rno-mir-344a-1, Lgi2, AABR07060291.2, Adarb2, Angptl, Rspo4, Rn50_7_1158.3, Dcx, AABR07065531.31, Onecut1, Mkx, Rgs4, Kcnc2, Hgf, Fgf13, Itga8, AABR07070578.2, Apcdd1, and Trim15.

For example, the most specific genes (ordered by decreasing specificity) in the nuclei of astrocytes derived from human samples are: Slpr1, Gja1, Lgi4, Efemp1, Etnpp1, Aqp4, Rgma, Lgr6, Lcat, Tri1, Serpini2, Pgghg, Slc1a3, Gfap, Aldh1a1, Pla2g5, Fxyd1, Wdr49, Gli1, Nfatc4, Scara3, Slc4a4, Lama2, Cdc42ep4, Gabrg3, P2ry1, Gabra2, Colec12, Mlc1, Slc7a11, Aldh1l1, Sox9, Lgals3, Mgst1, Gats13, Ahnak, Pipox, Rhoj, Arhgef26, Arhgef28, Srpx, Mt3, Atp1a2, Fxyd7, Lfng, Lamb2, Gdf10, F3, Sdc4, Hspb1, Hes1, Slc12a4, Mertk, C3, AI464131, Id4, Vit, Fjx1, Ccdc80, Adora2b, Ryr3, Mfge8, Plekho2, Elov12, Fam179a, Cebpb, Acss1, Slc13a5, Ednrb, Pltp, 1133, T1r4, Fam198b, Isyna1, Glis3, Dao, Fgfr3, Ncan, Msx2, Spatc1, Pdgfrb, Tubb2b, Fat3, Fam167a, Co122a1, Tcf711, Ndrg2, Nhsl1, Ddit41, Pbxip1, Ras112, Sh3bp2, Apinr, Robo3, Rubcn1, Rab34, Gtf2a11, Fgfr2, Kank2, and Rfx4. For example, the most specific genes (ordered by decreasing specificity) in the nuclei of astrocytes derived from mouse samples are: Gdf10, Slc1a3, Fxyd1, Dao, A2m, Lfng, Lgi4, Mybpc1, Cdc42ep4, Slco4a1, Fam20a, Lcat, Acot11, Vim, Nwd1, Slpr1, Tnc, Rbm24, Acsbg1, Ntsr2, Prex2, Cables1, Gli1, Etnpp1, Pla2g7, Phkg1, Nhsl1, Slc14a1, Plekho2, Gjb6, Plce1, Itih3, Sdc4, Mertk, Prr5, Sparcl1, Id4, Mlc1, Pax3, Gpr153, Abi3bp, Pltp, Fxyd7, Rpusd3, Aqp4, Igdcc3, Fgfr3, Mt3, Atp1a2, Gabrb1, Ndrg2, Ucp2, Plpp3, Frem1, Elov12, Gli2, Efhd2, Zic4, Oplah, Cxcl14, Mfge8, Sox9, Atp13a4, AI464131, Pdlim4, Rfx4, Traf1, Dmp1, Gabra4, Gja1, Etv4, Map2k6, Wwc1, Syt10, Sparc, Tri1, S1c25a18, Aldh1l1, Evala, Mxra8, Lgr6, Rgma, Egfr, S1c39a12, Slc8b1, Glipr2, Ax1, Aass, Hk2, Itpkb, Ramp2, Pyroxd2, Gabra2, Tcf711, Garem2, Wnt6, Dfna5, Fam92b, Plxnb1, and Vamp1. For example, the most specific genes (ordered by decreasing specificity) in the nuclei of astrocytes derived from rat samples are: AABR07070161.1, Itih3, Gdf10, Gli1, S1c25a18, Nkain4, Tnc, Msx2, Slpr1, S1c7a10, Aqp9, Mt2A, Lgi4, Pou3f2, Id4, Cacng5, Cyp2d5, AABR07058658.1, AABR07070161.6, Lfng, AABR07070161.3, Fam107a, Nat8f3, Ctxn3, Aldh1l1, Entpd2, Rbm24, Slcla3, Mlc1, Cxcl14, Hif3a, Fxyd1, Acsbg1, AABR07070161.7, Notch3, 1133, Nwd1, Cdc42ep4, Samd91, Gabrb1, Plpp3, Cxcr4, Rgma, Itm2a, Ednrb, Pdlim4, Sgca, Sncaip, Prodh1, Agt, S1c14a1, AABR07032343.1, AABR07035782.1, Marc1, Fgfr3, AABR07070161.5, AC109886.1, Prr5, Aqp4, Plekho2, AABR07035780.2, Sh2b2, F3, Sparcl1, Evala, Pltp, Gfap, Cyp2d4, Crlf1, Sdc4, Sod3, Dao, Chst1, AABR07001555.1, AABR07063346.1, Mpp6, Ptch2, AABR07031767.1, AC105604.1, Grin2b, Pygm, Etnpp1, S1c15a2, Casp4, Gria1, S1c4a4, Camk2g, Cbs, AABR07035175.1, Ntsr2, Gja1, Aspg, Sfxn5, Ccbe1, Ahnak, Gramd3, Ndrg2, Mt3, Shroom3, and Myh11.

For example, the most specific genes (ordered by decreasing specificity) in the nuclei of oligodendrocytes derived from mouse samples are: Klk6, Mog, Gldn, Cndp1, Gm20425, Tmem98, SlcSal1, Mag, Carns1, Gpr37, Cdk18, Hhat1, Anln, Enpp2, Folh1, Sec1415, Myrf, Plp1, Ma1, Gjb1, Itga2, Cpm, Plpp2, Cntn2, Ermn, Opalin, Abca8b, Lpar1, Pld1, Sall1, Cercam, Dock5, Pi16, Man2a1, Pex51, Tmem63a, Tmem125, Gipr, Sh3tc2, D7Ertd443e, Ke1, Ldb3, Ccdc152, Cldnl1, Synj2, Lrp2, Ninj2, Psrc1, Ndrg1, Actn2, Sgk2, Trim59, Plekhg3, Larp6, Slc45a3, Cnp, Col4a5, Pde8a, Rhobtb1, D16Ertd472e, Qdpr, Enpp6, Rhou, Sema3c, Gsn, Cyr61, Capn3, Hoxd1, Frmd4b, Tmem144, Galnt6, Pkmyt1, Fbxo32, Pla2g16, Dpyd, Sh3gl3, Primal, Rasal1, Fa2h, Fam124a, Treh, Paqr4, Azgp1, Plekhh1, Dapk2, Knop1, Sema3b, Elov11, Shroom4, Car2, Necab1, Aspa, Gab1, Kif6, Hhip, Ugt8a, Iqgap1, Map6d1, Eln, and Pllp. For example, the most specific genes (ordered by decreasing specificity) in the nuclei of oligodendrocytes derived from mouse samples are: Gpr37, Pex51, Hapin2, Apod, Ermn, Prr51, Aspa, Efnb3, Anln, Mog, Plp1, Plekhh1, Tmem63a, 1133, D7Ertd443e, Sec1415, Carns1, Tnfaip6, Galnt6, Galnt5, Ndrg1, Cldn11, Gjc2, Pla2g16, Fth1, Opa-lin, Car2, Dock5, Gm20425, Sall1, Pkd211, Kcnk13, Ppplrl4a, Gatm, Serpinbla, Pde8a, Tnni1, Glu1, Tmprss5, IPA14, Trim59, Ma1, Slc12a2, Qdpr, Litaf, Gjb1, Edi13, Pls1, Mboat1, St6galnac3, Gngl1, Enpp2, Cpm, Pstpip2, Trim36, Klk6, Myold, Tmem98, Synj2, 4933413G19Rik, Mag, Insc, Pigh, Pik3c2b, Ninj2, Trpv3, Car14, Tmem125, Map7, Cdk18, Depdc7, Aatk, Myrf, Cnp, Stmn4, Chdh, Nek4, Frmd4b, Ugt8a, Palm2, Arsg, Ccdc152, Efemp1, Piga, Rftn1, Itgb4, Emilin2, Enpp4, Nkain2, Adamtsl4, Hcn2, Plxnb3, Dpyl911, Arhgap23, Prima1, Gipr, Sh3tc2, Tubb4a, Map6d1, and Kctd13. For example, the most specific genes (ordered by decreasing specificity) in the nuclei of oligodendrocytes derived from rat samples are: Gpr37, Pex51, Hapin2, Apod, Ermn, Prr51, Aspa, Efnb3, Anln, Mog, Plp1, Plekhh1, Tmem63a, 1133, D7Ertd443e, Sec1415, Carns1, Tnfaip6, Galnt6, Galnt5, Ndrg1, Cldn11, Gjc2, Pla2g16, Fth1, Opalin, Car2, Dock5, Gm20425, Sall1, Pkd211, Kcnk13, Ppplrl4a, Gatm, Serpinbla, Pde8a, Tnni1, Glu1, Tmprss5, IPA14, Trim59, Ma1, Slc12a2, Qdpr, Litaf, Gjb1, Edi13, Pls1, Mboat1, St6galnac3, Gngl1, Enpp2, Cpm, Pstpip2, Trim36, Klk6, Myold, Tmem98, Synj2, 4933413G19Rik, Mag, Insc, Pigh, Pik3c2b, Ninj2, Trpv3, Car14, Tmem125, Map7, Cdk18, Depdc7, Aatk, Myrf, Cnp, Stmn4, Chdh, Nek4, Frmd4b, Ugt8a, Palm2, Arsg, Ccdc152, Efemp1, Piga, Rftn1, Itgb4, Emilin2, Enpp4, Nkain2, Adamtsl4, Hcn2, Plxnb3, Dpyl911, Arhgap23, Prima1, Gipr, Sh3tc2, Tubb4a, Map6d1, Kctd13, Mog, Opalin, Mobp, Tmem63a, AABR07006310.1, Hapin2, Klk6, Qdpr, Selplg, Cldnl1, Mal1, Ermn, AABR07046961.1, Abi3, Gpr37, Tmem88b, Rasgrp3, Prr51, SlcSa11, Mag, LOC100362909, Tmem176b, LOC100302465, Cx3cr1, Ctss, Carns1, Tmem125, Tmem176a, Sec1415, Tf, Clqb, Apod, Slpr5, Rn60_5_1374.5, Plp1, Insc, Mbp, P1s1, Tmem98, Anln, Ndrg1, PafahlB1, Pex51, LOC361016, Galnt6, Trim36, AABR07017693.1, Gpatch4, Plekhg3, Hamp, Csflr, Gjc2, Car14, Trim59, AABR07053870.1, Gpr84, Plekhh1, Ghr, Kndc1, Slco2b1, Cd74, Aspa, Trpv3, AABR07008030.1, Aplp1, Tgfbr2, Gjb1, Ptp4a3, Prima1, Pik3c2b, AABR07036035.1, Sal11, Plpp2, Pld4, Fam102b, Cd33, Cdknla, Nkd1, Elov17, Piga, Inf2, Blnk, Enpp4, 1118, Spatal3, Mettl7a, Inpp5d, Myrf, Gjc3, Trim2, AABR07012039.1, AABR07033887.1, Enpp2, Pacs2, Clqa, Trem2, S1c45a3, Hhip, Anxa3, and AABR07022098.1.

For example, the most specific genes (ordered by decreasing specificity) in the nuclei of OPCs derived from human samples are: Fermt1, Lims2, Clq11, Sstr1, Olig1, Bambi, Usp43, B3gnt7, Pdgfra, Clq12, O1ig2, Fmo3, Cspg5, Galr1, Gpc2, Fibin, Cspg4, Coll la1, Bche, Col9al, Afap112, Cldn1, Plpp4, Sox13, Plat, Neu4, D630023F18Rik, Co120a1, Pxylp1, Asic4, Spsb4, Prelp, Gpr34, Best3, Stk32b, Akr1c14, Susd5, Ophn1, Mmp16, Sulf2, Prkg2, Tns3, B3galt4, Fgfbp3, Nkain3, Ntn1, Ascl1, Sema5a, Hrasls, Gal3st4, Ebf4, Tmem132d, Nt5e, Jag1, Megfl1, Ildr2, Plppr1, Dcc, Ntn4, Sox6, Cacng4, Pxdn, Sapcd2, Tnk2, Slc43a3, Adamts6, Vsig8, Itm2a, Marcks11, Alk, Smoc1, Cacna2d3, Tm4sfl, Bgn, Pdgfc, Atp2c2, Aldhla3, Prrx1, Meis3, Cxxc4, Cd27, Sema3e, Adamtsl7, Akr1c20, Arhgap10, Crispld2, Sipa112, Ppplr36, Gng12, Syt17, Midn, Gadd45a, Khdrbs3, Thbs4, Vipr2, Ccnd1, Iffo1, Atoh8, Exosc4, and Pde7b. For example, the most specific genes (ordered by decreasing specificity) in the nuclei of OPCs derived from mouse samples are: Neu4, Clq11, Ppfibp1, 3110035E14Rik, Pdgfra, Rgcc, Susd5, Itga9, Tes, Rprm, Rep15, Cspg4, Matn4, Amz1, 1810041L15Rik, Pxdc1, Tox3, Sh3bp4, Elfn1, Galnt3, Lmcd1, Serpine2, Clq12, Neto1, Grm5, Mmp2, Coll la2, Sema3d, Lims2, Cav1, Sapcd2, Rcn1, Ptpro, Ccndl, Ptgfrn, Ncan, 5730559C18Rik, Lpcat2, O1ig2, Fh13, Tspan6, Rin2, Ascl1, Basp1, Pmepa1, Fzd9, Fam114a1, Abhd2, Ctxn1, Cspg5, Cfap20, Vwc2, Cdo1, Cdh13, Marcks, Gsxl, Sertm1, Slcla1, Matn1, Has2, Lama4, Myc1, K1h15, Kcnh5, Kcnh8, Sema5a, Enpp6, Slc5a7, Cav2, Lbh, Adm, Adam12, S100a4, Mfsd2a, Igfbp3, Midn, Asap3, Prkg2, Rlbp1, Abcg2, Vstm2b, Dock6, Fbn1, Frrs1, Khdrbs3, Slitrk6, Chst11, Ptpn14, Dpys13, Slc44a5, Eya1, Sox6, Phox2a, Coll la1, Swap70, Fam89a, Mrm2, Lypd1, Shisa7, and Pcdh17. For example, the most specific genes (ordered by decreasing specificity) in the nuclei of OPCs derived from rat samples are: Fam89a, Pdgfra, RGD1561849, Rlbp1, Ccnd1, Tmem255b, Clq11, Bgn, Itga9, Ppfibp1, Snx22, Col5a3, Pme1, Cav1, Serpine2, Cspg4, Lims2, AABR07052897.1, Clq12, Cdk2, AABR07010022.1, Cacng4, Matn4, AABR07049948.1, Susd5, Prkg2, Pxdc1, RGD1566029, AABR07003304.1, Sapcd2, Cspg5, Mmp15, Rgcc, Slc22a6, Sema5b, Qprt, Pnlip, Slc6a12, RGD1311892, AABR07003306.1, AABR07044671.1, Rbpj1, Chst5, Traf4, Sox6, Cox6b2, Pcdh15, Cd101, Xylt1, AABR07003304.2, Calcrl, Colla1, Lama4, Elfn1, Ampd3, Fam212b, Slc6a13, Sstr1, Sema3d, AC141997.1, Cpne7, Ptgfrn, Wbscr28, Ryr3, Gpsm2, Neto1, Chst11, Slc22a8, Pstpip2, AABR07044668.1, Bcas1, Igf2, Lbh, Olfm2, Ndnf, Vstm2b, AABR07058656.1, Rep15, Vtn, Eln, Ramp1, Pmepa1, Gpnmb, Ptpro, Limd1, Cdh13, Nrxn2, Mgp, Myt1, Marcks, LOC100362216, AABR07043601.4, LOC102553018, Masp1, Sulf2, Tle6, Fam114a1, Tmem100, Ccnd2, and Rasgeflb.

In some embodiments, the specificity rank was observed to be more conserved between mouse and rat than mouse and human. In some embodiments, Geno Ontology (GO) analysis may be performed for genes considered specific for each cell type or species to determine whether the genes fuction in the same pathway. In some embodiments, changes in expression of cell type or species-specific markers are observed in alternative family members in a given cell type. For example, Pde1c may be used for mouse cell types in the cerebellum or the nuclei thereof and Pde1a expression may be used for human cell types in the cerebellum or the nuclei thereof.

In some embodiments, differences in expression levels of protein tyrosine kinase 2 beta (Ptk2b), solute carrier family 43 member 2 (Slc43a2), glutamate ionotropic receptor kainate type subunit 3 (Grik3), Itpr1, protocadherin 9 (Pcdh9), and Ras guanyl releasing protein 1 (Rasgrp1) are used to differentiate between nuclei from granule, glia, and basket/stellate cells derived from humans and mice.

B. Analyzing Cell Type Specific and Species-Specific Gene Expression of Cross-Species Analysis In some embodiments, the most variable genes are identified from a comparison of the RNAseq results from sorted nuclei from each cell type compared to normalized RNAseq results across the three species. In some embodiments, cell type specific and species specific genes may be identified by the genes having either or both of the largest variation among cell types and the largest variation among analyzed species. In some embodiments, genes observed to have the most variation in expression among species may be further differentiated by cell type. For example, nuclei may have greater differentiation among species than among cell types. In some embodiments, hierarchical clustering may be used to observe the degree of separation provided by each component of variation.

In some embodiments, Pcsk2, Pcsk6, and Pcsk8 are used to categorize nuclei by both cell type and species. Alternatively, Pcsk1 and Pcsk3 are used to categorize nuclei by cell type.

In some embodiments, nuclear structure may be compared to differences across each cell type in gene expression regulation or in disease susceptibility.

C. Effects of Clinical Attributes in Human Samples

In some embodiments, differences in the profiles of nuclei due to clinical attributes may be analyzed to identify markers of the attribute. For example, profile differences were observed in different periods of autolysis time, gender, age, and stress.

Autolysis was observed to only have minor effects on gene expression in previous studies. (Gupta et al., 2012, BMC Genomics 13, 26, which is hereby incorporated by reference herein in its entirety). In some embodiments, expression of at least four genes in the sorted nuclei may be used to define granule cells derived from human samples at varying stages of autolysis. In some embodiments, expression of at least one gene may be used to define basket/stellate cells or glia derived from human samples at varying stages of autolysis. In some embodiments, the level of expression of kinesin family member 19 (Kif19) may be measured to determine autolysis time. For example, a higher level of expression of Kif19 indicates a higher autolysis time, and a lower level of expression of Kif19 indicates a lower autolysis time. The level of expression may be compared to normalized expression across all samples. In some embodiments, a higher level of expression of FosB proto-oncogene, AP-1 transcription factor subunit (FosB) indicates an intermediate autolysis time of between about 5 hours and about 24 hours.

Gender-specific and cell-type specific gene expression may also be identified to determine the effects of gender on gene expression. Xist is a gene on the X-chromosome that is involved in X-chromosome inactivation and expressed exclusively in females. Next, we analyzed whether gender affects gene expression in specific cell types. Tsix, the gene running antisense to Xist, was observed to be expressed only in glia of females. This is an example of gender-specific and cell-type specific gene expression.

In some embodiments, the profiles for nuclei isolated from male and female samples may be compared to determine gender-specific markers. For example, an increase in expression of KDMSD, RPS4Y1, ZFY, DDX3Y, TTTY15, TTTY14, USP9Y, UTY, GYG2P1, NLGN4Y, TXLNGY, LINC00278, PRKY, and/or TTTY10 compared to normalized expression across unsorted nuclei may be used as markers for nuclei from male samples. Further, a decrease in expression of ZFX, PUDP, KDMSC, LOC389906, PIN4, MTRNR2L8, MTRNR2L6, COL4A1, DHFR, LOC101929541, TSIX, MIR6723, and/or XIST may be used as markers for nuclei from female samples. In some embodiments, expression results are further analyzed to identify cell-type and gender-specific markers. For example, increased expression of long intergenic non-protein coding RNA 278 (LINC00278) may be used to differentiate glia from male samples from glia from female samples. Further, an increase in expression of family with sequence similarity 8 member A4, psuedogene (Fam8a4p), arylsulfatase D pseudogene 1 (Arsdpl), and Gyg2p1 compared to normalized expression across unsorted nuclei may be used as markers for nuclei from stellate cells derived from male samples.

To determine whether age effects cell types uniformly, differentially expressed genes may be identified among samples from humans of varying ages. In some embodiments, differences in expression of the following genes in the nuclei: ABCC10, ACAP3, ACHE, ATF6B, ATP6V0B, CACNA2D3, CULT, DNAJB5, EGR1, FZR1, GBAP1, GPR107, GRK5, KCTD21-AS1, KLHL22, LINC00499, LINGO2, LOC100132077, LOC100506990, LOC101927592, MIR9-3HG, MPND, MTRF1, POLR2J3, PPP6R2, PRSS55, PTMS, RNF17, SNAI3-AS1, SPHK2, ST3GAL2, TAOK2, TRDN, WASH7P, ZFPM1, ZNF404, ZNF496, ZNF580, ZNF585A, ZNF607, ZNF84, and ZSCAN29 may be used to determine the age of a subject from which a sample was derived.

In some embodiments, further analysis of the profiles may provide age specific and cell type specific markers. For example, differential expression of the following genes: KCNQ3, SCHLAP1, UGGT2, PLXDC2, ITGB5, DCLK1, AQP7, PTPN3, FAT1, CMTM8, FARP1, PIP4K2A, NEDD4, CATSPERG, LOC101926, 941, WWC2, MPP6, SDK1, NAB2, NTNG2, LMNTD2, PLCH2, PTPRJ, MRAP2, PTMS, CDH23, SYT7, SPRED3, PLXNAL GRK5, ZYX, FGF3, LINC01544, PCYT1B, RHBG, HCN2, ACAP3, MGAT3, C1orf61, SURF2, AHRR, FAM131A, CHGB, PLXNA4, ACHE, DYRK1B, CDK5R2, GDPDS, ZNF703, FHDC1, LOC101927, 078, CREB3L2, AP1S3, DYSF, MAMSTR, KIAA0895L, TP73, PDE3A, LINC00963, ELAVL3, TTYH3, HPN, PTPRE, SLC17A7, GRIN2C, PXN, TMEM130, LRPAP1, GRM4, STEAP3, CHRD, SBNO2, ZDHHC23, GACAT2, MAP6D1, FAM53A, KIAA1549L, SLC38A7, CDK16, CALY, LPCAT4, SLC25A6, SRCIN1, ELMO1, GRAMD4, RIMS3, CPLX2, PIP5K1C, SDC3, CBLN3, PDZD7, VWA5B2, ZNF219, FAM212B, RASIP1, GYS1, ATP6V0B, NKD1, ST3GAL2, PTK7, ACOT7, ATXN7L2, DAO, SYT12, ADAM19, HIP1, GABBR1, SYT3, TP53INP2, KCNK3, TPM4, RNF152, KCNK10, EPB41L1, ABCC10, NAV2, ERGIC1, BAD, KIF3B, RAI2, XKR7, PTK2B, CHST12, TRIM67, DHDDS, NUMBL, KCND3, LRRC1, RAB37, KCNIP2, RAB6B, PC, TCEAL2, MEG8, FMNL3, MAPK4, DGCRS, REEP1, GTPBP2, KIF26B, NRXN2, ZNRF1, C14orf132, FLNB, EFR3B, RBFOX3, PPP2R2C, KLHDC4, PILRA, CLSTN3, CABIN1, NHSL2, LYRM1, KCNA2, SLC38A10, DGKA, TMEM266, FAM135B, ATP2B2, TMEM163, UNCSB, TPM3, MICAL2, GNAO1, GABBR2, KCNK1, USP4, TEX2, PRKAG2, APBA2, SUSD6, HDHD2, NAA20, CRIPT, KNTC1, RPS6KA5, PHF10, PCGFS, DPY19L4, APH1B, ZNF546, ABCA17P, CDH26, CBWD6, ZNF736, CFAP70, UBE4A, TTC32, CFAP53, PXDNL, CPVL, GLIPR1, COL25A1, MTHFD2L, LSMS, LOC100505, 715, NR3C2, TOM1L1, ANKRD42, SLC8A1, -AS1, ATAD2, GAB1, CCDC146, ELMOD1, CFAP74, C1orf146, P4HA2, RANBP3L, OTUD6B, -AS1, EYS, ALS2CR11, LECT1, BHLHE40-AS1, STAB2, PXYLP1, LOC101929, 710, LINC00499, RHOBTB3, CRYBG3, NPY6R, RGS20, C2orf73, YIPF7, BUB1B, CFAP43, LOC102724, 623, LRRC69, STK3, CLICS, CACNA2D3, C2orf27A, LOC105378, 385, BEST3, EPHA6, LOC100506, 393, MEF2C, GTSCR1, ELOVL2, SPATA9, PLSCR4, GCK, LINC01032, MEF2C-AS1, BMS1P21, CASP12, CLMP, ERBIN, TMC3-AS1, CXXC4, DCBLD1, GSTO2, PLOD2, P4HA2-AS1, TTC23L, CPLX3, SOX13, PRDM1, RSPO2, TSG1, MIR31HG, CTB-1202.1, PLCH1, JAML, SEMA3G, LOC101928, 203, GLRA1, SYT16, SYN3, ARHGAP32, MIR646HG, ALCAM, SCGN, LINC01515, and LOC101929415 compared to normalized expression across samples of varying age may be used as markers to identify granule cells.

For example, differential expression of the following genes: ACER3, ACSS3, ADAMTS2, ADAMTS9, ADAMTSL3, ADD2, ADGRL3, AKAP13, ALOX5, ALS2CR11, ARHGEF1OL, ARHGEF6, ASIC1, ASIC2, ATP6V0B, BMP3, BTBD11, C11orf87, C14orf1, C4orf22, C9orf135, CA7, CACNA1D, CACNA2D3, CACNB4, CADM3, CADPS, CALR, CDK15, CFAP46, CLSTN3, CNTN3, CPNE8, CYYR1, DBH, DCC, DDO, DGKH, DISP3, DLG1, DLG4, DMGDH, DNAH6, DNER, E2F3, ECHDC2, ELOVL2, ENPP1, EPHB1, ERC2, FAM135B, FAM46C, FBXL21, FGF5, FHOD3, FKBP5, FRMPD4, GABBR2, GALNT18, GAP43, GBAP1, GDF11, GPR161, GPR63, GREB1, HCN4, HECTD2-AS1, IQSEC3, KCNA4, KIF26B, KRT222, LACTB2-AS1, LHFPL3, LINC00457, LINC00499, LINC01158, LOC105377448, LOC285692, LOC653602, LPCAT4, MARC2, MARCH11, MASP1, MEGF10, MTHFSD, MYRIP, NHS, NOS1, NPL, NPY6R, NTNG1, NXNL2, PAQR6, PARM1, PCP4, PEBP4, PHACTR2-AS1, PHKA1, PLPPR4, PLXNA4, PRKCG, RGMB, RNF212, RNF215, RORA, RPH3A, RPS6KA5, SCN2B, SEPSECS, SEPSECS-AS1, SHANK1, SHANK2, SLC12A5, SLC17A4, SLC25A29, SLC26A8, SLC35F4, SLC8A3, SPARCL1, SPHK2, SPON2, ST6GAL2, ST6GALNAC5, STAT5A, STK33, SV2C, SYT17, TEX9, TFAP2B, THSD7B, TMEM178B, TRAFS, TRIM67, TTC23L, TUNAR, UBASH3B, UNCSD, ZNF124, and ZYG11A compared to normalized expression across samples of varying age may be used as markers to identify basket cells.

For example, differential expression of the following genes: ADAMTS7, ANKRD33B, AOX1, C1orf95, CACNG4, CACNG8, CAPN9, CRTAC1, DACH1, EFHD2, EGF, ETS1, FRAS1, IMPA2, LINC00499, LINC00844, LINC01208, LOC101927078, LOC102724360, PKDCC, PLXNA4, PRRS, RHCG, ROBO2, SEMASB, SHROOM2, SLIT2, TRDN, TXNIP, VWASA, and WNT7B compared to normalized expression across samples of varying age may be used as markers to identify glia.

In some embodiments, gene expression in nuclei

D. Selecting Markers and Targets

In some embodiments, analysis of altered expression associated with sorted nuclei occurs between gene orthologs among different species. For example, expression of 1:1 orthologs are compared to ensure that results are due to altered expression rather than differences in gene annotation among species.

In some embodiments, further analysis may be performed to ensure that altered expression is not due to differences in annotation among species. For example, only genes having a 1:1 ortholog may be used to determine expression levels. Analysis may be additionally limited to genes greater than 1kb in length and/or having a less than 2-fold difference in length among species, such as mouse, rat, and human. In some embodiments, a cell type specific gene or species specific gene may be selected from the 250 most variable genes across mouse, rat, and human nuclei including: 1810041L15Rik, 2810459M11Rik, 3110035E14Rik, A2m, Adamts15, Adra1a, AI593442, Aldh1a1, Anln, Apcdd1, Apod, Aqp4, Arhgef33, Ascl1, Asgr1, Aspa, Atp1a2, Atp2a3, B3gnt5, B3gnt7, Bcl11a, Bhlhe22, C1q11, C1q12, Cacna1g, Cacng4, Calb1, Camklg, Car8, Carns1, Casq2, Cbln2, Ccdc152, Ccdc180, Ccnd2, Cd82, Cd9, Cdh19, Cdhr1, Cldn11, Clec7a, Clmn, Cmtm5, Cntn3, Cntnap5a, Cob1, Col5a3, Col6a1, Cpm, Cryab, Cspg4, Csrp1, D7Ertd443e, Ddx3y, Dock5, Dpyl912, Ebf2, Echdc2, Efna5, Enpp2, Erbb3, Ermn, Etnpp1, Fa2h, Fam46a, Fgfr2, Flrt2, Fmo3, Folh1, Foxh1, Fsip2, Fxyd1, Fxyd7, Gad2, Gal3st1, Galnt5, Galnt6, Galr1, Gdf10, Gfap, Gja1, Gjb1, Gjc2, Gldn, Gli1, Glp2r, Glu1, Gm136, Gnb3, Gngl1, Gpr37, Gpr3711, Gpr63, Gpx2, Gramd3, Grb14, Gria3, Grik3, Grm1, Grm5, Gsn, Hapin2, Hepacam, Hhat1, Hspalb, Htrlb, Id4, Igsf11, I122, I133, Insc, Itgb8, Itih3, Itpr1, Kcnc2, Kcnj10, Kif19a, Kit, Kit1, Klk6, Leng9, Lfng, Lgi4, Lims2, Mag, Mak, Ma1, March11, Marcks11, Mcam, Mff, Mfge8, Mlc1, Mog, mt-Co1, mt-Nd4, Mybpc1, Myot, Myrf, Ndrg1, Nell1, Neto1, Neu4, Ninj2, Nkx2-2, Notch1, Nrk, Olig1, Olig2, Opalin, Pax3, Pcp2, Pdc, Pdgfra, Pdzd3, Penk, Pex51, Pgghg, Phyhip, Pkp3, Pla2g16, Plch1, Plekhd1, Plekhg3, Pllp, Plp1, Plpp3, Plpp4, Plscr1, Plxnb3, Pmp2, Pmp22, Ppfibp1, Ppplrl4a, Ppplr17, Prex1, Prex2, Prima1, Prkcg, Prr5, Prrg3, Prrx1, Ptchd4, Ptprk, Ptprz1, Pttg1, Pvalb, Pxdc1, Qk, Rapgef3, Rassf2, Rbp2, Rbpj1, Rgcc, Rgma, Ryr1, S100b, Slpr1, Sall1, Sec1415, Serpine2, Shisa6, Skor2, Slc1a3, Slc1a6, Slc26a3, Slc32a1, Slc4a4, SlcSal1, Slc9a3, Slitrk6, Socs2, Sorcs3, Sox10, Sox2, Sox6, Sox8, Stag3, Stk32a, Sulf2, Susd5, Tcea17, Tfap2b, Thbs2, Tmem125, Tmem132d, Tmem63a, Tmem98, Tnc, Tnfrsfl3c, Tns3, Trabd2b, Tri1, Trpc3, Trpc7, Tshb, Tspan11, Tspan2, Tuba8, Tubb2b, Txnip, Ube2b, Ugt8a, Upp1, Vstm2b, Wfdc1, Xrra1, Zcchc24, Zeb2, and Zfp3611.

V. Modulating Identified Targets

In some embodiments, at least one gene selected from one of Tables 2-4 is associated with at least one disease, disorder, or condition. A gene or expression thereof associated with a disease disorder or condition may also be referred to as a disease target. In some embodiments, a method of treating the disease, disorder, condition comprises using a therapeutic modality to modulate expression of the disease target. In some embodiments, therapeutic modality targets at least one transcript selected from Tables 2-4. In some embodiments, therapeutic modality targets at least one protein selected from Tables 2-4. In some embodiments, therapeutic modality is pharmaceutical composition such as a small molecule drug or an RNA interference (RNAi) molecule (such as siRNA), gene therapy, or cell therapy.

VI. Definitions

The following is a non-limiting list of term definitions.

As used herein, the term "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, 0.9%, 0.8%, 0.7%, 0.6%, 0.5%, 0.4%, 0.3%, 0.2%, 0.1%, or less in either direction (greater than or less than) of the stated reference value unless otherwise stated or otherwise evident from the context (except where such number would exceed 100% of a possible value).

As used herein, the term "antibody" refers to an immunoglobulin molecule capable of specific binding to a target, such as a polynucleotide, polypeptide, protein etc., through at least one antigen recognition site, located in the variable region of the immunoglobulin molecule. The term "antibody" encompasses not only intact (e.g., full-length) polyclonal or monoclonal antibodies, but also antigen-binding fragments thereof (such as Fab, Fab', F(ab')2, Fv), single chain (scFv), mutants thereof, fusion proteins comprising an antibody portion, humanized antibodies, chimeric antibodies, diabodies, linear antibodies, single chain antibodies, multispecific antibodies (e.g., bispecific antibodies) and any other modified configuration of the immunoglobulin molecule that comprises an antigen recognition site of the required specificity, including glycosylation variants of antibodies, amino acid sequence variants of antibodies, and covalently modified antibodies. An antibody includes an antibody of any class, such as IgD, IgE, IgG, IgA, or IgM (or sub-class thereof), and the antibody need not be of any particular class.

As used herein, the term "cell specific profiling" refers to using the nuclear transcriptome to accurately define cellular identity.

As used herein, the term "chromosomal associated transcript (CAT)" refers to transcripts held at the chromosome while being synthesized.

As used herein, the term "diseased tissue" or "diseased sample" refers to a sample taken from a subject experiencing a disease state.

As used herein, the term "DNA probe" or "RNA probe" refers to a fragment of DNA or RNA (usually 100-1000 bases long) which hybridizes to nucleotide sequences that are complementary to the sequence of the probe. The probe may be radioactively, fluorescently, or chemically (e.g. biotin) labeled for visualization.

As used herein, the term "drug target" or "targets for therapeutics" refers to a nucleotide sequence that may be acted on by a drug or therapeutic to modulate gene expression in a cell type.

As used herein, the term "factor" refers to a nucleotide sequence that is hybridized by a DNA or RNA probe or is specifically bound by an antibody to allow accurate sorting of nuclei of a particular cell type.

As used herein, the term "gene expression" or "expression" refers to the level of one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; (4) folding of a polypeptide or protein; and (5) post-translational modification of a polypeptide or protein.

As used herein, the term "cellular profiling technique" refers to non-genetic methodology for molecular profiling of a population of a cell type in post-mortem tissue.

As used herein, the term "polyA transcript" refers to a chain of adenine nucleotides that is added to a messenger RNA (mRNA) molecule during RNA processing to increase the stability of the molecule.

As used herein, the term "label" refers to one or more markers, signals, or moieties which are attached, incorporated, or associated with another entity, which markers, signals or moieties are readily detected by methods known in the art including radiography, fluorescence, chemiluminescence, enzymatic activity, absorbance, and the like. Detectable affinity labels include radioisotopes, fluorophores, chromophores, enzymes, dyes, metal ions, ligands such as biotin, avidin, streptavidin and haptens, quantum dots, and the like. Detectable affinity labels may be located at any position in the entity with which they are attached, incorporated or associated. For example, when attached, incorporated in or associated with a peptide or protein, they may be within the amino acids, the peptides, or proteins, or located at the N- or C-termini.

As used herein, the term "most specific gene(s)" refers to a gene(s) having a lower Specificity Index (SI) value compared to the SI value of other analyzed genes, which is calculated using the algorithm described in Example 1.

As used herein, the term "tissue sample" refers to an aliquot or portion taken from a source and provided for analysis or processing. In some embodiments, a sample is from a biological source such as a tissue, cell, or component part (e.g. a body fluid, including but not limited to blood, mucus, lymphatic fluid, synovial fluid, cerebrospinal fluid, saliva, amniotic fluid, amniotic cord blood, urine, vaginal fluid, and semen). In some embodiments, a sample may be or comprise a homogenate, lysate, or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. In some embodiments, a sample is a or comprises a medium, such as a nutrient broth or gel, which may contain cellular components, such as proteins or nucleic acid molecule. In some embodiments, a sample is subjected to one or more processing (e.g., separation, purification, etc.) steps to prepare a sample for analysis or other use.

As used herein, the term "transgenic animal" refers to an animal having a foreign gene inserted into its genome.

As used herein, the term "translating ribosomal affinity purification (TRAP)" refers to the method that defines the molecular signature of diverse cell types in a single tissue derived from a transgenic animal.

Described herein are methods for molecular profiling of a population of a cell type in post-mortem tissue. The details of one or more embodiments of the invention are set forth in the accompanying description below. Although any materials and methods similar or equivalent to those described herein can be used in the practice or testing of the present invention, the preferred materials and methods are now described. Other features, objects and advantages of the invention will be apparent from the description. In the description, the singular forms also include the plural unless the context clearly dictates otherwise. Unless defined otherwise, all technical and scientific terms used herein have the same meaning as commonly understood by one of ordinary skill in the art to which this invention belongs. In the case of conflict, the present description will control.

The present invention is further illustrated by the following non-limiting examples.

EXAMPLES

Example 1

Experimental Procedures

The following experimental procedures were used to perform the experiments described in Examples 2-23 herein.
A. Buffer Preparation The buffers were prepared as described in Kriaucionis et al., Science, 324 (5929): 929-930 (2009). RNase free water was used if included in Buffer involved in the protocol for isolating RNA, otherwise MilliQ water was used.

Buffer A used in the examples herein is 60% iodixanol (Optiprep, Sigma-Aldrich, St. Louis, MO; Catalog no. D1556-250ML). Buffer A was kept covered in foil until used. Buffer B as used in the examples herein contains 900 mM KCl, 30mM MgCl$_2$, 120 mM Tricine-KOH (pH 7.8). Buffers A and B were stored at room temperature (RT).

Buffer C used in the examples herein contained 50% iodixanol (5 volumes Buffer A and 1 volume Buffer B), 0.5 mM spermidine, 0.15 mM spermine, EDTA-free protease inhibitor cocktail (Roche Holding AG, Basel, Switzerland; distributed by Sigma-Aldrich, St. Louis, MO; Catalog no. 11836170001), 1 mM DTT, and 200 units/mL Superasin (Thermo Fisher Scientific, Waltham, MA; Catalog no. AM2696). Buffer D used in the examples herein contained 0.25 M sucrose, 150 mM KCl, 5 mM MgCl$_2$, 20 mM Tricine-KOH (pH 7.8), 0.5 mM spermidine, 0.15 mM spermine, EDTA-free protease inhibitor cocktail, 50 µL of 1 mM DTT, 200 units/mL Superasin, and 400 units/mL RNasin (Promega, Madison, WI; Catalog no. N2515).

Buffer E used in the examples herein contained 27% iodixanol (1.174 volume Buffer C to 1 volume Buffer D). Wash/Block buffer used for analysis in the examples herein contained 3% BSA in PBS with 0.05% TritonX-100; BSA obtained from Jackson ImmunoResearch Laboratories, Inc., Code no. 001-000-162. The Wash buffer for RNA used in the examples herein contained 50ng/mL RNase-free BSA in PBS, with 0.05% TritonX-100, 1mM DTT, and 100 units/mL of Superasin. The Block buffer for RNA used in the examples herein contained the Wash buffer for RNA supplemented with an additional 50 ng/mL BSA. The Cushion buffer used in the examples herein contained 500 µL of Buffer D, 250 µL of 50% Glycerol, and 5 µL of 10% NP-40.
B. Nuclei isolation Nuclei isolation was adapted from the protocol described in previous publications (Kriaucionis, et al. (2009) Science 324, 929-930 and Mellen, et al. (2012) Cell 151, 1417-1430, each of which is hereby incorporated by reference herein in its entirety). For mouse experiments, cortex and cerebella were dissected as described previously. All tissue from C57BL/6J animals were flash frozen using liquid nitrogen. Tissue from mice developed for use in the bacTRAP method were freshly dissected and directly used for homogenization. Rat and human tissue were obtained frozen. All frozen tissues were thawed on ice for a minimum of 30 minutes before use. To isolate nuclei, fresh or thawed tissue were transferred to 5mL of homogenization medium (0.25 M sucrose, 150 mM KCl, 5 mM MgC12, 20 mM Tricine pH 7.8, 0.15 mM spermine, 0.5 mM spermidine, EDTA-free protease inhibitor cocktail, 1mM DTT, 20 U/mL Superase-In RNase inhibitor, 40 U/mL RNasin ribonuclease inhibitor). Tissue were homogenized by 30 strokes of loose (A) followed by 30 strokes of tight (B) glass dounce. Homogenate was supplemented with 4.6 mL of a 50% iodixanol solution (50% Iodixanol/Optiprep, 150 mM KCl, 5 mM MgC12, 20 mM Tricine pH 7.8, 0.15 mM spermine, 0.5 mM spermidine, EDTA-free protease inhibitor cocktail, 1 mM DTT, 20 U/mL Superase-In RNase inhibitor, 40 U/mL RNasin ribonuclease inhibitor), and laid on a 27% iodixanol cushion. Nuclei were pelleted by centrifugation 30 min, 10,000 rpm, 4° C. in swinging bucket rotor (SW41) in a Beckman Coulter XL-70 ultracentrifuge. For mouse, rat, and human cytoplasmic fractions, 175 uL of the top layer was added to 175 uL QIAGEN® Buffer RLT and stored at −80° C. The nuclear pellet was resuspended in homogenization buffer.

C. Antibodies

Primary and secondary antibodies were diluted in Block Buffer. Secondary antibodies were purchased from Life Technologies or Jackson Immunoresearch and were used at 1:500 dilution. Primary antibodies and the dilution factors are shown in Table 5. In the Table, NeuN stands for Neuronal Nuclei Antigen, Itpr stands for Inositol 1,4,5-Trisphosphate Receptor Type 1, Sorcs3 stands for Sortilin Related VPS10 Domain Containing Receptor 3, EEAT1 stands for Excitatory Amino Acid Transporter 1, and Olig2 stands for Oligodendrocyte Transcription Factor 2.

TABLE 5

| Antibodies | | | | |
| --- | --- | --- | --- | --- |
| Antigen | Species | Vendor | Cat. # | Dilution |
| NeuN | Rabbit | Abcam | ab177487 | 1:250 |
| NeuN | Mouse | Millipore | MAB377 | 1:250 |
| Itpr1 | Mouse | Abcam | ab190239 | 1:500 |
| Sorcs3 | Goat | Thermo | PA5-48023 | 1:250 |
| EEAT1 | Rabbit | Abcam | ab416 | 1:250 |
| Olig2 | Goat | R&D | AF2418 | 1:250 |

The cell type specificities for antibodies used for isolating all cell types are shown in Table 6. Unless indicated, NeuN refers to the rabbit antibody.

TABLE 6

| Antibody Specificities | | | | | |
| --- | --- | --- | --- | --- | --- |
| | Granule | Purkinje | Basket | Astrocyte | Oligodendrocytes (progenitor & mature) |
| Mouse | Itpr1, Sorcs3, Olig2, NeuN | Itpr1, NeuN | Sorcs3, NeuN | EEAT1, NeuN (mouse) | Olig2, NeuN |
| Rat | Itpr1, Sorcs3, Olig2 | Itpr1, NeuN | Itpr1, NeuN | Sorcs3, NeuN | Olig2 (progenitors only), NeuN, Sorcs3 |
| Human | Itpr1, NeuN (also used for glia cells) | Not applicable | Itpr1, NeuN (also used for glia cells) | Itpr1, Olig2, NeuN | Olig2, NeuN |

D. Nuclei Fixation and Staining

After isolation, nuclei were fixed by adding formaldehyde (formaldehyde without methanol; Electron Microscopy Sciences, Hatfield, PA; Catalog no. 15710) to 1% final concentration and incubated at room temperature for 8 minutes with gentle rotation. The formaldehyde was quenched by adding glycine to a final concentration of 125 mM. The sample was incubated at room temperature for 5 minutes with gentle rotation. The sample was spun for 4 minutes at 1000 g in 4° C. to pellet the nuclei. The supernatant was poured out and the pellet was resuspended in Buffer D. The sample was again spun for 4 minutes at 1000 g at 4° C. The supernatant was poured out, and the pellet was resuspended in wash buffer (PBS, 0.05% TritonX-100, 50 ng/mL BSA, 1 mM DTT, 10 U/uL Superase-In RNase Inhibitor). The nuclei were then transferred to a new tube, and then spun for 4 minutes at 1000 g at 4° C. The supernatant was poured out, and the nuclei were resuspended in block buffer and allowed to block with gentle rotation at room temperature (RT) for 30 minutes. Antibodies were added to nuclei in block buffer and incubated at RT for 1 hour with gentle rotation. Alternatively, this incubation step was performed at 4° C. overnight (O/N).

A small aliquot of the nuclei was taken at this stage to be used as an unstained control for flow cytometry. The nuclei were pelleted for 3 minutes at 1000 g at 4° C. and washed with wash buffer (PBS, 0.05% TritonX-100, 50ng/mL BSA, 1 mM DTT, 10 U/uL Superase-In RNase Inhibitor). This was repeated two more times. Following the last wash, a 1:500 dilution of the appropriate secondary antibodies in block buffer was added. The nuclei were covered with foil and incubated at RT for 30 minutes with gentle rotation. Following the incubation, the nuclei were pelleted for 3 minutes at 1000 g at 4° C. and washed with wash buffer. This was repeated two more times. The pellet was then resuspended in an appropriate amount of block buffer for analysis or sorting. If immediate analysis was not planned, the nuclei were stored on ice.

E. Flow Cytometry Analysis/Sorting

DyeCycle™ Ruby (dcRuby) (Thermo Fisher Scientific, Waltham, MA; Catalog no. V10273) was added to samples: 1-2 μL per mouse cerebellum and 5-7 μL for 200 mg of human tissue, which was based on the number of nuclei in the sample, volume of buffer, and whether the nuclei were from mouse or human. Variation in the concentration of dcRuby was allowed depending on the voltage on the flow cytometer.

Prior to flow cytometry, nuclei were co-stained with DyeCycle™ Ruby to a 20 μM final concentration. Nuclei were analyzed using a BD LSRII (BD Biosciences, San Jose, CA, USA) flow cytometer using the 488 nm, 561 nm, and 640 nm lasers. Nuclei were sorted using a BD FACS Aria cell sorter using the 488 nm, 561 nm, and 635/640 nm lasers. All samples were first gated using DyeCycle™ Ruby to determine singlets. Analysis was performed using FACS Diva (BD) or FlowJo software. QIAGEN® Buffer RLT (unfixed samples) or QIAGEN® Buffer PKD (fixed samples) were added to the sorted nuclei and the samples were stored at −80° C.

Following sorting, the nuclei were stored for RNA isolation. For storage, proteinase K digestion buffer (QIAGEN® AllPrep® FFPE RNA kit, QIAGEN®, Catalog no. 80234) was added to the sorted nuclei and the resulting mixture was stored at −80° C.

Measurements of forward-scattered light (FSC) were plotted against measurements of side-scattered light (SSC), and gating was performed on the general scatter. The dcRuby intensity was plotted linearly and voltage was adjusted for singlets. Singlets were gated. The samples were plotted based on the colors used and populations were gated based on expected staining pattern. The percentage of the gated population was compared to the expected percentage of the cell type of interest.

F. RNA and DNA Isolation and Purification

The QIAGEN® AllPrep® FFPE kit was utilized to isolate both DNA and RNA from the same sample. Isolation was performed according to the kit protocol, except for the following modification: prior to the 80° C. heating step, the RNA was incubated at 65° C. for 30 minutes and then 70° C. for an additional 30 minutes.

RNA from cytoplasmic fractions or fresh nuclei were purified using the QIAGEN® RNeasy® Micro kit with on-column DNase digestion. RNA from fixed nuclei were purified using the protocol QIAGEN® RNeasy® FFPE kit with the following modifications—after Proteinase K digestion, RNA was spun at max speed for 15 minutes. The supernatant was removed and incubated at 65° C. for 30 minutes, 70° C. for 30 minutes, and 80° C. for 15 minutes. An on-column DNase digestion was performed in place of the in-solution DNAase digestion. RNA quantity was determined using the QUBIT® RNA HS Assay kit and RNA quality was determined using Agilent 2100 Bioanalyzer with RNA 6000 Pico chips.

Purified DNA and RNA were quantified using QUBIT® (Thermo Fisher Scientific, Waltham, MA; Catalog no. Q32854 and Q32855). Purified RNA samples were also run on AGILENT® Bioanalyzer chip (Agilent Technologies, Santa Clara, CA; Catalog no. 5067-1513) for quantification and sizing. DNA was stored at −20° C. and used for sequencing or epigenetic analysis. RNA was stored at −80° C. and used for cDNA synthesis.

G. cDNA Production Using Nugen Ovation® RNAseq V2 Kit and Library Production cDNA was generated from purified nuclear RNA using the Nugen Ovation® RNAseq V2 kit according to the kit protocol. The final cDNA was purified using the QIAGEN® MinElute® Reaction Cleanup Kit (Catalog no. 28206) according to the Nugen Ovation® RNAseq V2 kit protocol. cDNA quality was assessed using an AGILENT® TapeStation using a D1000 ScreenTape (Agilent Technologies; Santa Clara, CA; Catalog no. 5067-5582, ScreenTape Catalog no. 5067-5583). A 1:40 dilution of the cDNA was prepared for qPCR and enrichment or depletion of expected markers was checked. The cDNA was quantified using NanoDrop™

Libraries were prepared using the Illumina TruSeq DNA LT Library Preparation Kit or the NEBNext Ultra DNA Library Prep Kit for Illumina with NEBNext Multiplex Oligos for Illumina. The quality of the libraries was assessed using the Agilent 2200 TapeStation system with D1000 High Sensitivity ScreenTapes. Libraries were sequenced at The Rockefeller University Genomics Resource Center on the Illumina HiSeq 2500 machine to obtain 50 bp single-end reads or on the Illumina NextSeq 500 to obtain 75 bp paired-end reads. All datasets have been deposited in GEO: accession-numbers-pending.

H. Oxidative Bisulfite (oxBS) Conversion Reaction

Genomic DNA (gDNA) is isolated from sorted nuclei as described in the User Guide for the TrueMethyl® Whole Genome Kit from Cambridge Epigenetix Limited.

I. Immunofluorescence

Mice were deeply anesthetized and transcardially perfused with phosphate buffered saline (PBS) followed by 4% formaldehyde (w/v) in PBS. Brains were dissected and post-fixed overnight at 4° C., cryoprotected in 30% sucrose in PBS, OCT TissueTeck embedded, and cut with a Leica CM3050 S cryostat into 20 μm sections that were directly mounted on slides. Slides were stored at −20° C. Antigen retrieval was performed by immersing slides into sodium citrate buffer (10 mM sodium citrate, 0.05% Tween 20, pH 6.0) at 95-100° C. and simmering for 10 minutes in the microwave. The slides were cooled to room temperature and then washed with PBS. Immunofluorescence was performed by blocking for 30 minutes in IF Block Buffer (3% BSA in PBS with 0.1% TritonX-100), incubated with primary antibody overnight, washed 3 times with PBS, incubated with secondary antibody for one hour, washed with PBS, stained with DAPI solution (1 ug/mL in PBS) for 15 minutes, washed two times with PBS, and cover-slipped with Prolong Diamond mounting media. For some samples, Tyramide signal amplification was performed as follows: slides were incubated with secondary antibody conjugated to horseradish peroxidase for 1 hour, washed 3 times with PBS, incubated with Cy3 in Amplification Buffer from the TSA Cyanine 3 detection kit for 10 minutes, washed with PBS, and DAPI stained as above. All steps were performed at room temperature. Slides were imaged on a Zeiss LSM700 confocal microscope using the same acquisition settings for mouse and human slides. Brightness and contrast adjustments were made in ImageJ post-acquisition with the same adjustments applied to mouse and human images. In addition to the antibodies listed above for nuclei staining, the following primary antibodies in Table 7 were used for immunostaining.

In Table 7, GFAP stands for Glial Fibrillary Acidic Protein, Mog stands for Myelin Oligodendrocyte Glycoprotein, Mag stands for Myelin Associated Glycoprotein, Pde1a stands for Phosphodiesterase 1A and Pde1c stands for Phosphodiesterase 1C.

TABLE 7

| | | | | | | | | | |
|---|---|---|---|---|---|---|---|---|---|
| Antigen | Species | Vendor | Cat. # | Dilution | Antigen | Species | Vendor | Cat. # | Dilution |
| GFAP | Goat | Abcam | ab53554 | 1:500 | Pde1a | Goat | Acris | TA311317 | 1:200 |
| Mog | Goat | Thermo | PA5-47319 | 1:500 | Pde1c | Rabbit | Santa Cruz | sc-376474 | 1:200 |
| Mag | Rabbit | Cell Signaling | 9043S | 1:500 | | | | | |

Antibodies described herein may be produced, tested, and/or characterized using a variety of methods. Such methods may be used to determine a variety of characteristics that may include, but are not limited to, antibody affinity; specificity; and activity (e.g. activation or inhibition of cellular signaling pathways, or other cellular or biological activities).

Once an antibody molecule of the present disclosure has been produced by an animal, a cell line, chemically synthesized, or recombinantly expressed, it can be purified (i.e., isolated) by any method known in the art for the purification of an immunoglobulin or polypeptide molecule, for example, by chromatography (e.g., ion exchange, affinity, particularly by affinity for the specific antigen, Protein A, and sizing column chromatography), centrifugation, differential solubility, or by any other standard technique for the purification of proteins. In addition, the antibodies of the present disclosure or fragments thereof can be fused to heterologous polypeptide sequences described herein or otherwise known in the art, to facilitate purification.

The affinity between an antibody and a target or ligand (such as an antigen used to generate a given antibody) may be measured in terms of KD using one or more binding assays known in the art. Depending on the desired target for a given antibody, varying KD values may be desirable. High affinity antibodies typically form ligand bonds with a KD of about $10^{-5}$ M or less, e.g. about $10^{-6}$ M or less, about $10^{-7}$M or less, about $10^{-8}$M or less, about $10^{-9}$M or less, about $10^{-10}$ M or less, about $10^{-11}$M or less or about $10^{-12}$M or less. J. DNA and RNA probes Alternatively or used in conjunction to antibodies, RNA and DNA probes may be designed and produced according to David et al. Biotechniques 30, 769-772, 2001 using polymerase chain reaction (PCR) to produce antisense fragments of the region of interest in the genome.
K. Real Time PCR and Primer List Independent RNA samples were purified from the cytoplasmic fraction from mouse and human cerebellum, and purified RNA was converted to cDNA and amplified using the Nugen Ovation® RNAseq System V2 as described above. Quantitative real-time PCR was performed using TAQMAN® probes and LIGHTCYCLER® 480 Probe Master mix on a LIGHTCYCLER® 48011 system (Roche). Two biological replicates were used for both mouse and human, and three technical replicates were performed for each biological replicate. Cq values were calculated using second derivative maximum method in the LIGHTCYCLER® 480 software. Normalization was performed with the delta Cq method with the geometric mean of three housekeeping genes: Actin Beta (Actb), Glyceraldehyde-3-Phosphate Dehydrogenase (GAPDH), and RNA Polymerase II Subunit A (Polr2a). Technical replicates were averaged (arithmetic mean) before performing statistical analysis using a two-tailed t-test assuming equal variance. Primers are listed in Table 8. In Table 8, and as used herein, the genes referred to are Actb, GAPDH, Polr2a, Von Willebrand Factor C Domain Containing 2 (Vwc2), Coiled-Coil Domain Containing 175 (Ccdc175), Clavesin 2 (Clvs2), Pde1a, Pde1c, Endothelin Converting Enzyme 1 (Ece1), CNKSR Family Member 3 (Cnksr3). Also given in the Table are the mouse and human IDs from Integrated DNA Technologies (IDT) and Thermo Fisher (Thermo).

TABLE 8

| | | | | | | |
|---|---|---|---|---|---|---|
| Gene | Mouse Source | Mouse ID | Mouse Exons | Human Source | Human ID | Mouse Exons |
| Actb | IDT | Mm.PT.58.33257376.gs | 4-5 | IDT | Hs.PT.56a.41086380.g | 4 |
| Gapdh | Thermo | Mm03302249_g1 | 7-7 | IDT | Hs.PT.58.589810.g | 10-10 |
| Polr2a | IDT | Mm.PT.58.10668225.g | 27-28 | IDT | Hs.PT.58.1609228.g | 27-28 |
| Vwc2 | IDT | Mm.PT.58.28838117 | 3-4 | IDT | Hs.PT.58.4006889 | 3-4 |
| Ccdc175 | IDT | Mm.PT.56a.30819491 | 19-20 | IDT | Hs.PT.58.40158488 | 19-20 |
| Clvs2 | IDT | Mm.PT.58.29272566 | 4-5 | IDT | Hs.PT.58.28152553 | 4-5 |
| Pde1a | IDT | Mm.PT.58.9352231 | 13-14 | IDT | Hs.PT.58.25631488 | 13-14 |
| Pde1c | IDT | Mm.PT.58.12812140 | 11-12 | Thermo | Hs01095682_m1 | 12-13 |
| Ece1 | IDT | Mm.PT.58.41658219 | 19-20 | IDT | Hs.PT.58.19105582 | 18-20 |
| Cnksr3 | IDT | Mm.PT.58.14312874 | 12-13 | IDT | Hs.PT.58.19494243 | 12-13 |

L. Software Used for Analysis

Data processing steps made use of Linux tools in addition to custom perl scripts. In addition to standard Linux commands (e.g. awk, cut, sort, uniq), the following packages were used: Trim Galore! (v0.4.1) for adapter trimming of ATACseq samples, STAR (v2.4.2a) and Bowtie2 (v2.1.0) for read alignment, SAMtools (v0.1.19-44428cd) for indexing and removal of duplicates, igvtools (v2.3.32) for generating files for browser visualization, and featureCounts (v1.5.2) for read summarization. Data analysis was performed using R Studio (v 1.0.143, R: v3.4.0). In addition to base R (for data wrangling, Pearson correlations, hierarchical clustering, etc.) and custom R functions, use of the following packages was extensive: tidyverse (v1.1.1, which contains ggplot2, reshape2, etc.) for data wrangling and visualization, DESeq2 (v1.16.1) for raw count normalization, differential expression analysis, and principle components analysis, gplots (v3.0.1) and pheatmap (v1.0.8) for heatmaps, RColorBrewer (v1.1-2) for color palettes, and clusterProfiler (v3.4.3) for GO analysis.

M. ATACseq library Construction and Sequencing

Nuclei from mouse, rat and human cerebellum were isolated as described above, and 50,000 were washed in ice-cold PBS. ATACseq libraries were prepared as described previously in Buenrostro, et al. (2013). Nat Methods 10, 1213-1218 and Buenrostro, et al. (2015). Curr Protoc Mol Biol 109, 21.29.1-29.9, both of which are hereby incorporated by reference in their entireties, with the following modifications from Chen, et al. (2016). Nature Methods. 13(12):1013-1024, which is hereby incorporated by reference in its entirety: nuclei were resuspended in ice cold lysis buffer, omitting incubation step on ice and centrifuged. Libraries were generated using the Nextera DNA Library Preparation Kit. Transposition reaction was performed for 30 minutes at 37° C. using Tn5 transposase from Nextera. 2004, of a reverse-crosslinked solution (50 mM Tris-Cl, 1 mM EDTA, 1% SDS, 0.2 M NaCl, 5 ng/ml proteinase K) was added and the mixture was incubated at 65° C. at 1000 rpm shaking in a heat block overnight, then purified with QIAGEN® MINELUTE® kit. DNA fragments were purified and size selected using AMPure XP beads to yield 100-700 bp fragments. ATACseq libraries from mouse and human cerebellum were sequenced on the Illumina HiSeq2500 to obtain 50 bp paired-end reads, and libraries generated from rat cerebellum were sequenced on Illumina NextSeq500 to obtain 75 bp paired-ended reads. All libraries were sequenced to yield at least 55M reads per sample.

N. ATACseq Read Mapping and Visualization

Adapter sequences were trimmed and reads were filtered depending on quality using Trim Galore! (trim_galore—stringency 3—fastqc— paired*_R1_2.fastq.gz*_R2_2.fastq.gz). Reads that passed O. RNAseq Read Mapping, Visualization, and Read Summarization RNAseq reads were aligned using STAR (Dobin, et al. (2013). Bioinformatics 29, 15-21, which is hereby incorporated by reference herein in its entirety) and genome assemblies from ENSEMBL. In addition to default STAR parameters, the following parameters were used for single end (—outFilterMismatchNmax 999—outFilterScoreMinOverLread 0—outFilterMatchNminOverLread 0—outFilterMatchNmin 35—outFilterMismatchNoverLmax 0.05) and paired-end data (—outFilterMismatchNmax 999—alignMatesGapMax 1000000—outFilterScoreMinOverLread 0—outFilterMatchNminOverLread 0—outFilterMatchNmin 60—outFilterMismatchNoverLmax 0.05). Aligned bam files were converted to tdf format for visualization using igvtools. Raw counts were generated using featureCounts (Liao, et al. (2014) Bioinformatics 30, 923-930, which is hereby incorporated by reference herein in its entirety). Refseq or ENSEMBL gene model annotations for whole genes were downloaded using the UCSC Table Browser tool. Refseq (Zhao, et al. (2015). BMC Genomics 16, 97, which is hereby incorporated by reference herein in its entirety) annotations were used. ENSEMBL was chosen for annotation for within species comparisons. For comparative analysis across species, ENSEMBL annotation was used for all species in order to match the list of orthologous transcripts obtained from ENSEMBL. The following parameters were used in addition in addition to the default in featureCounts: for paired-end data, fragments are counted instead of reads (–p), chimeric fragments are not counted (–C). For comparative analysis across species, reads are allowed to be assigned to more than one matched metafeature (–O) in order to avoid problems when genes overlap in one species but not in another. For within-species comparisons, reads that map to more than one matched meta-feature are not counted (default). Annotations are shown in Table 9.

TABLE 9

| Genome/Gene Annotations | | | | | |
|---|---|---|---|---|---|
| Purpose | Program | Species | Annotations | Source | Genome |
| Genome alignment | STAR/Bowtie2 | Mouse | ENSEMBL | ENSEMBL | mm10 |
| Genome alignment | STAR/Bowtie2 | Rat | ENSEMBL | ENSEMBL | rn6 |
| Genome alignment | STAR/Bowtie2 | Human | ENSEMBL | ENSEMBL | hg38 |
| Read quantification | featureCounts | Mouse | Refseq | UCSC | mm10 |
| Read quantification | featureCounts | Rat | ENSEMBL | UCSC | rn6 |
| Read quantification | featureCounts | Human | Refseq | UCSC | hg38 |
| Ortholog read quantification | featureCounts | Mouse | ENSEMBL | ENSEMBL | mm10 |
| Ortholog read quantification | featureCounts | Rat | ENSEMBL | ENSEMBL | rn6 |
| Ortholog read quantification | featureCounts | Human | ENSEMBL | ENSEMBL | hg38 | the filter were aligned using Bowtie2 (Langmead, et al. (2012). Nat Methods 9, 357-359, which is hereby incorporated by reference herein in its entirety) to hg38, mm10 or custom rat genome. Duplicate reads were removed using SAMtools (Li, et al. (2009) Bioinformatics 25, 2078-2079, which is hereby incorporated by reference herein in its entirety). For data visualization, tdf files were generated using igvtools.

P. Generation of Ortholog Annotations

The method for generating annotations for mouse, rat, and human orthologs, and mouse-human high confidence orthologs may be summarized as follows: 1) ortholog annotation across species were downloaded from ENSEMBL BioMart (release 88), 2) filtered to include only: high confidence pairs (ENSEMBL ortholog confidence=0), 1:1 orthologs (transcript that is annotated to be orthologous to more than one transcript in another species), genes greater than 1kb in total length (including untranslated regions), and genes that change by less than 2-fold in length across species. For each gene, the longest orthologous transcript was used for annotation.

Because the rat genome is incompletely annotated, almost 3,000 more genes were identified as orthologous between mouse and human, than among genes that are orthologous among mouse, human, and rat.

Q. Gene Count Normalization, Differential Expression Analysis, and Principle Components Analysis Raw gene count tables were loaded into R and differential expression analysis was performed using DESeq2 (Love, et al. (2014). Genome Biology 15, 550, which is hereby incorporated by reference herein in its entirety). For age and autolysis time, numerical covariates were used for modeling. Statistically significant genes were defined as having an adjusted p-value of less than 0.01. Fold change cutoffs were not used unless otherwise noted. The rlog function was used to generate normalized counts for downstream analysis (e.g. heatmaps, clustering). The plotPCA function was used to perform principle components analysis. No methods were used to remove batch effects clustering based on expected biology was observed throughout, and never by batch. For example, clustering was observed by cell type between Egfp+ and nuclei sorted using cellular profiling technique described herein despite numerous differences: date of preparation, tissue state (fresh vs. flash frozen and thawed), nuclei state (unfixed vs. fixed), nuclei processing (none vs. antibody stained), library prep kits (Illumina vs. NEB), sequencer (HiSeq 2500 vs NextSeq 500), and read type (50 bp single end vs. 75 bp paired end).

R. Hierarchical Clustering

Hierarchical clustering was performed using normalized gene counts produced by the rlog function from DESeq2 (Love, et al. (2014) Genome Biology 15, 550, which is hereby incorporated by reference herein in its entirety). Unless specified, the top 250 most variable genes across samples, as computed by the rowVars function, were used for clustering. Default parameters (Euclidean distance and complete linkage) were used with the dist and hclust functions to produce clusters.

S. Specificity Index Algorithm

The specificity index (SI) algorithm was previously developed to find genes that are specific in a dataset of interest as compared to other datasets (Dougherty, et al. (2010) Nucleic Acids Res 38, 4218-4230, which is hereby incorporated by reference herein in its entirety). Because the algorithm in Dougherty was designed for microarray data, it was adapted to accept RNAseq data as input. A feature was added that incorporates information from biological replicates for calculations. Fpkms were calculated from raw counts to avoid biases toward long genes, and genes less than 1 kb were excluded to avoid biases from extremely short genes. Next, fpkm values were logged, and log 10(fpkm) values were bottomed out at −2 to avoid biases from long, non-expressed genes. To take into account sample replicates, the mean and standard deviation were calculated for all genes within a cell type.

SI values are calculated as described previously, but instead of using mean gene expression values as input, sample were randomly selected from a normal distribution with the mean and standard deviation of gene expression. This process was performed 1000 times and final ranks were averaged across all iterations. For analysis of the distribution of highly specific genes in the mouse cerebellum, images for each gene from the Allen Mouse Brain Atlas (Lein, et al. (2007) Nature 445, 168-176, which is hereby incorporated by reference herein in its entirety) were examined. Genes that were not in the Atlas at the time of analysis, or genes that showed no staining in any region of the brain were excluded from analysis. The percentage of genes showing proper distribution for the cell type analyzed were calculated and presented herein.

T. GO Analysis

Significant differentially expressed genes were split into up- and down-regulated (or mouse and human enriched) genes and gene ontology enrichment analysis for granule cells, basket cells, and glia was performed using clusterProfiler (Yu, et al. (2012) Journal of Integrative Biology 16, 284-287, which is hereby incorporated by reference herein in its entirety). Significant ontologies were defined as having a q-value of less than 0.01 (default). GO analysis results including significant ontologies were gathered for the three domains (biological process (BP), molecular function (MF), cellular component). For simplicity of visualization, only biological process ontologies were used. Additionally, when many ontologies were found, the simplify function was used to remove redundant terms for visualization. Network based enrichment maps were generated using the enrichMap function. To simplify visualization of the enrichment maps, groups of related ontologies were summarized into one label.

Example 2

Defining Cellular Identity Using Nuclear Transcriptomes

Nuclei may be sorted using antibodies specific to constitutive endoplasmic reticulum (ER) proteins or membrane proteins synthesized in the ER. First nuclear RNA was isolated from GFP+ nuclei as described in Example 1. To enrich for ER transcripts translated near the nuclear membrane in wild-type mice, a polyA pulldown of nuclear transcripts was performed. Most of these transcripts were not observed to be nuclear but were fully mature nucleic acid transcripts being translated in the ER surrounding the nucleus. Not all transcripts for membrane proteins are found in this nuclear polyA+ fraction, but knowledge of the ones that are synthesized proximal to the nucleus resulted in a dramatic increase in the number of factors that can be targets for nuclei labeling. After performing immunofluoresce, staining was observed in the ER around the nucleus, which confirms that a nucleus may be labeled using an antibody against a membrane protein.

The initial strategy for isolating 3 cell types from the cerebellum included antibody-binding using Itpr1 (Inositol 1,4,5-Trisphosphate Receptor Type 1; an intracellular receptor of the endoplasmic reticulum (ER)) as a target to label Purkinje cells, NeuN (a gene encoded by a member of the RNA-binding FOX protein family; NeuN is a neronal antigen commonly used as a biomarker of neurons) as a target to label granule cells, and GFAP (Glial Fibrillary Acidic Protein; one of the major intermediate filament proteins of mature astrocytes used to distinguis astrocytes from glial cells) as a target to label glia to confirm the presence of these types of cell in the sample. Then, a combination of results for Itpr1 and NeuN was used to isolate all 3 populations.

Nuclei originating from a cell type of interest were isolated from tissues of transgenic mice that had been previously profiled using the TRAP method to determine whether the nuclear transcriptome may be used to accurately define cellular identity. The profiling results for the transgenic animals developed for use with the TRAP method were based on the fact that the GFP-tagged ribosomal subunit is assembled in the nucleolus. Using immunofluorescense, GFP was observed to be distributed primarily in the cytoplasm of tissue slices of cerebellum tissue from a transgenic animal with Purkinje cell protein 2 (pcp2)-GFP expressed exclusively in Purkinje cells, but was also observed in one spot (the nucleolus) in the nucleus. Further, staining results showed the isolated nuclei from the cerebellum of the pcp2-GFP animals to be labeled with DAPI, and one out of the seven nuclei was observed to be a Purkinje nucleus (GFP+).

Example 3

Using Flow Cytometry to Profile Cells Derived From Transgenic Animals Developed for Use in the TRAP Method Flow cytometry results for EGFP+ nuclei from each of the five cell lines derived form transgenic animals developed for use in the TRAP method is shown in Table 10.

TABLE 10

| | | | FACS purification results | | |
| Region | Cell Type | BAC Driver | Strain | Gender | Percentage |
|---|---|---|---|---|---|
| Cerebellum | Granule | NeuroD1 | JP241 | Female | 91.1% |
| Cerebellum | Granule | NeuroD1 | JP241 | Female | 90.5% |
| Cerebellum | Granule | NeuroD1 | JP241 | Female | 90.5% |
| Cerebellum | Purkinje | Pcp2 | DR168 | Both | 0.54% |
| Cerebellum | Purkinje | Pcp2 | DR168 | Both | 0.39% |
| Cerebellum | Purkinje | Pcp2 | DR168 | Both | 0.32% |
| Cerebellum | Purkinje | Pcp2 | DR168 | Both | 0.36% |
| Cerebellum | Bergmann Glia | Sept4 | DS152 | Male | 1.92% |
| Cerebellum | Bergmann Glia | Sept4 | DS152 | Male | 1.85% |
| Cerebellum | Bergmann Glia | Sept4 | DS152 | Male | 1.84% |
| Cerebellum | Bergmann Glia | Sept4 | DS152 | Male | 1.91% |
| Cortex | Corticopontine Pyramidal | Glt25d2 | DU9 | Female | 0.99% |
| Cortex | Corticopontine Pyramidal | Glt25d2 | DU9 | Female | 1.68% |
| Cortex | Corticopontine Pyramidal | Glt25d2 | DU9 | Female | 1.33% |
| Cortex | Corticothalamic Pyramidal | Ntsr1 | TS16 | Female | 2.33% |
| Cortex | Corticothalamic Pyramidal | Ntsr1 | TS16 | Female | 3.15% |
| Cortex | Corticothalamic Pyramidal | Ntsr1 | TS16 | Female | 2.94% |

Additional flow cytometry was performed on the nuclei isolated from 5 different transgenic mouse lines that had been previously profiled using the TRAP method. From the prior profile generated by the TRAP method, Purkinje Cell Protein 2 (Pcp2) was targeted to identify nuclei originating from Purkinje cells, and about 0.4% of the nuclei were observed to be Pcp2 positive. Neurod1 (Neuronal Differentiation 1) was targeted to identify nuclei originating from granule cells, and about 91% of the nuclei were observed to be Neurod1 positive. Sept4 (Septin 4) was targeted to identify nuclei originating from Bergmann glia, and about 2% of the nuclei were observed to be Sept4 positive. Glt25d2 or Colgalt2 (Collagen Beta(1-O)Galactosyltransferase 2) was targeted to identify nuclei originating from layer 5 cortical-pontine pyramidal neurons, and about 0.5% of the nuclei were observed to be Glt25d2 positive. Neurotensin Receptor 1 (Ntsr1) was targeted to identify nuclei originating from layer 6 corticothalamic projecting pyramidal neurons, and about 1.8% of the nuclei were observed to be Ntsr1 positive.

Values in Table 10 were based on a conservative gating of positive populations for sorting during flow cytometry, while the percentages in the previous paragraph were based on less conservative analysis of the flow data.

Example 4

Profile Expression of Cell Lines Derived From Transgenic Animals Developed for Use in the TRAP Method To determine whether nuclear RNA profiles are sensitive enough to distinguish among different subtypes of neurons, RNAseq was used to generate nuclear expression profiles from FACS purified EGFP+ nuclei from transgenic mouse lines expressing the EGFP-L10a ribosomal fusion protein separately targeted to five different cell types—cerebellar Purkinje cells, granule cells, Bergmann glia, corticopontine pyramidal neurons, or corticothalamic pyramidal neurons. Neurod1, Pcp2, and Sept4 were known to drive expression in granule cells, Purkinje cells, and Bergmann glia of the cerebellum, respectively. Colgalt2 (alternatively referred to as Glt25d2) and Ntsr1 were known to drive expression in corticopontine and corticothalamic pyramidal cells of the cortex. The known markers were confirmed to be specific for the nuclei of each cell type.

Table 11 provides a summary of nuclear RNAseq datasets from the transgenic mice developed for use in the TRAP method.

TABLE 11

| | | | Summary of nuclear RNAseq datasets | | |
|---|---|---|---|---|---|
| Marker | NeuroD1 | Pcp2 | Sept4 | Glt25d2 | Ntsr1 |
| Cell Type (abbreviation) | Granule cells (Granule) | Purkinje cells (Purkinje) | Bergmann glia (Glia) | Corticopontine pyramidal (Oligo) | Corticothalamic pyramidal (OPC) |
| Location | Cerebellum | Cerebellum | Cerebellum | Cortex | Cortex |
| Percentage of nuclei | 95% | 0.1% | 1-2% | 0.5% | 2-3% |
| Replicates | 3 | 4 | 4 | 3 | 3 |

Hierarchical clustering of nuclear RNAseq data was performed for the nuclei of the five cell types presented in Table 11. Additionally, three published nuclear RNAseq datasets from Mo et al. (Neuron 2015) were included in the hierarchical clustering: excitatory neurons from Camk2a-cre animals (labeled excit), PV interneurons from PV-cre animals (labeled pv), and VIP interneurons from VIP-cre animals (labeled vip). The pyramidal neurons were observed to be clustered together.

Expression calculated by RNAseq results was normalized to the average expression across all samples for each gene.

The log 2 fold change in RNAseq results from the nuclei purified by FACS for each of the five cell types compared to the normalized RNAseq results for the 250 most variable genes are shown in Table 12. The log 2 change in expression was calculated for 3 replicates for the nuclei from each cell type. Negative values indicate reduced expression in the nuclei of the cell type compared to the normalized value across nuclei from all cell types analyzed, and a positive value indicates increased expression compared to the normalized value across nuclei from all cell types analyzed.

TABLE 12

| | | | | | | | | | | | | | | | | | |
|---|---|---|---|---|---|---|---|---|---|---|---|---|---|---|---|---|---|
| | | | | Log2 fold change of expression of the 250 most variable genes across all samples | | | | | | | | | | | | | |
| | | | | | | Log2 Fold Change in Expression (by cell type) | | | | | | | | | | | |
| Gene | Granule | | | Purkinje | | | | Glia | | | | Oligo | | | OPC | | |
| 1700047M11Rik | −0.62 | −2.99 | −2.2 | −2.19 | −1.75 | −0.31 | −1.25 | 6.9 | 6.9 | 6.46 | 6.31 | −2.87 | −1.1 | −1.28 | −1.32 | −1.2 | −2.35 |
| 3110039M20Rik | −3.65 | −3.24 | −3.64 | −3.19 | −3.41 | −3.23 | −3.39 | −3.59 | −3.46 | −3.44 | −3.51 | 3.33 | 3.64 | 3.87 | 4.08 | 4.11 | 4.02 |
| 2410124H12Rik | −2.58 | −2.07 | −2.58 | 8.84 | 8.64 | 9.21 | 8.21 | 0.42 | −2.28 | −2.26 | −2.37 | −1.89 | −1.58 | −2.03 | −0.36 | 0.19 | −1.18 |
| 8030451O07Rik | −2.98 | −3.12 | −2.98 | −2.39 | −2.66 | −0.71 | −2.64 | −2.89 | −2.72 | −2.7 | −2.8 | 3.8 | 2.88 | 3.86 | 1.49 | 1.71 | 0.93 |
| 9530059O14Rik | −3.52 | −2.76 | −3.68 | 3.29 | 3.14 | 3.36 | 3.09 | −3.85 | −3.5 | −3.75 | −3.8 | 2.06 | 1.73 | 2.12 | 0.87 | 0.68 | 0.85 |
| A230077H06Rik | −2.64 | −3.47 | −3.35 | −2.82 | −1.94 | −2.29 | −2.18 | −3.28 | −3.13 | −3.11 | −2.72 | 2.57 | 2.64 | 2.87 | 0.89 | 0.89 | 0.68 |
| A2m | −2.8 | −0.99 | −2.35 | −0.05 | −0.04 | 0.55 | 0.09 | 9.35 | 9.52 | 9.77 | 9.67 | −1.41 | −2.37 | −1.91 | −2.96 | −2.86 | −3.13 |
| A730036I17Rik | 0.12 | 0.46 | −2.07 | 5.83 | 5.85 | 5.86 | 5.57 | −1.11 | −1.79 | −1.77 | −1.87 | 0.42 | −0.32 | −2.21 | −1.42 | −1.32 | 0.01 |
| Aass | −2.31 | −3.05 | −2.87 | −1.17 | −0.43 | −0.6 | −0.12 | 5.41 | 6.18 | 6.68 | 5.61 | 0.3 | 0.52 | −1.32 | −1.67 | −1.97 | −2.31 |
| Acsm5 | −1.95 | −2.12 | −1.95 | −1.28 | −0.54 | −0.21 | −1.57 | 6.77 | 7.89 | 7.43 | 7.34 | −1.08 | −2.09 | −1.23 | −1.25 | −1.14 | −1.45 |
| Actbl2 | −1.69 | −1.85 | −1.69 | −1 | −1.32 | −1.06 | −1.29 | 7.18 | 6.67 | 7.16 | 5.73 | −1.72 | −1.82 | −1.83 | −0.97 | −0.86 | −1.17 |
| Adra2b | −1.7 | −1.85 | −1.69 | 4.51 | 6.18 | 6.2 | 5.16 | −1.6 | −1.43 | −1.41 | −1.5 | −1.73 | 1.75 | −1.83 | −1 | −0.9 | 0.58 |
| Afp | −1.42 | −1.58 | −1.41 | 6.44 | 6.19 | 6.27 | 6.61 | −1.31 | −1.1 | −1.07 | −1.19 | −1.45 | −1.55 | −1.56 | −0.67 | −0.56 | −0.87 |
| Aqp4 | 0.13 | −0.52 | −0.75 | −2.36 | −1.2 | −0.97 | −0.89 | 5.81 | 6.1 | 5.82 | 6.36 | −0.61 | 0.01 | −0.35 | −2.45 | −2.19 | −2.17 |
| Arhgap25 | −2.01 | −2.35 | −2.41 | −2.97 | −2.15 | −1.83 | −1.74 | −0.83 | −2.8 | −2.46 | −2.34 | 3.17 | 1.78 | 2.24 | 4.63 | 4.55 | 4.48 |
| Arx | −2.19 | −2.35 | −2.18 | 2.21 | −1.83 | −1.6 | −1.81 | −2.09 | −1.9 | −1.88 | −1.98 | −2.22 | 0.47 | −2.33 | −1.52 | −1.43 | −0.71 |
| Atp13a4 | −2.53 | −0.42 | −2.89 | −1.06 | −0.7 | −0.3 | −0.53 | 6.36 | 5.86 | 6.12 | 6.29 | −1.87 | −0.62 | −1.72 | −1.01 | −1.58 | −1.24 |
| Atp1a2 | −0.99 | −0.57 | −1.69 | −2.85 | −1.78 | −2.01 | −2.09 | 6.15 | 6.62 | 6.58 | 7.29 | 0.13 | −0.84 | −0.72 | −1.85 | −2.25 | −1.88 |
| Atp2a3 | 0.18 | 0.54 | 0.44 | 7.15 | 7.32 | 7.28 | 7.66 | 1.37 | 0.54 | 1.32 | 0.9 | −3.65 | −2.55 | −3.72 | −2.11 | −2.37 | −2.7 |
| B230209E15Rik | −3.56 | −3.95 | −3.98 | 0.28 | 0.71 | 0.61 | 0.54 | −3.68 | −3.26 | −3.64 | −3.33 | 3.78 | 3.26 | 3.43 | 3.45 | 3.5 | 3.38 |
| B3gnt5 | −0.94 | −1.11 | −2.46 | 6.27 | 6.33 | 5.6 | 5.64 | 1.13 | −0.2 | 1.51 | 0.99 | −0.31 | −0.16 | −2.86 | −1.12 | −1.41 | −1.58 |
| Barhl2 | 4.96 | 5.98 | 5.26 | −0.58 | −0.97 | −0.65 | 1.27 | 1.81 | 1.21 | 4.08 | 2.94 | −2.25 | −2.34 | −2.35 | 0.05 | −1.47 | −1.74 |
| Bcl11b | −3.39 | −3.72 | −2.42 | −1.51 | −1.41 | −1.59 | −1.34 | −3.01 | −3.26 | −3.24 | −2.99 | 3.33 | 2.94 | 3.33 | 2.99 | 2.91 | 2.79 |
| Btbd17 | 0.62 | 0.75 | 0.21 | −1.78 | −2.77 | −2.54 | −2.11 | 5.27 | 5.84 | 5.46 | 5.46 | −3.12 | −0.51 | −1.36 | −1.75 | −1.16 | −1.24 |
| Cacng3 | −0.91 | −3.2 | −4 | −3.25 | −2.83 | −2.25 | −2.88 | −3.67 | −3.71 | −3.69 | −3.75 | 4 | 3.62 | 4.05 | 3.07 | 3.01 | 3 |
| Camk1g | −1.58 | −2.95 | −2.36 | −2.93 | −3.17 | −2.97 | −3.15 | −3.37 | −2.76 | −2.74 | −3.29 | 2.96 | 2.98 | 3.14 | 0.98 | 0.72 | 0.33 |
| Camkv | −2.9 | −3.63 | −3.52 | −3.03 | −3.27 | −3.08 | −2.79 | −3.07 | −3.32 | −3.3 | −0.23 | 2.19 | 2.85 | 2.41 | 2.11 | 2.05 | 2.25 |
| Car8 | 0.24 | 0.61 | 0.05 | 7.76 | 6.99 | 7.72 | 7.86 | 0.52 | 1.18 | 1.73 | 1.21 | −2.65 | −3.24 | −1.78 | −3.27 | −2.61 | −2.95 |
| Casp12 | −1.17 | −0.68 | −1.69 | −1.28 | −0.06 | −0.86 | −0.83 | 5.25 | 5.13 | 5.62 | 5.34 | 2.41 | −1.36 | −1.02 | −0.73 | 0.48 | 0.01 |
| Casq2 | −0.62 | 0.27 | −1.18 | 7.08 | 6.93 | 7.27 | 7.03 | 1.4 | −0.51 | −0.02 | 0.15 | −3.84 | −3.2 | −3.06 | −1.25 | −1.9 | −1.98 |
| Cbln2 | −2.98 | −3.12 | −2.97 | −2.38 | −2.65 | −2.43 | −2.63 | −2.89 | −2.72 | −2.7 | −0.78 | 1.98 | 2.26 | 1.92 | 0.95 | 1.65 | 1.09 |
| Cbln3 | 5.83 | 6.65 | 6.72 | 0.86 | 1.97 | 2.1 | 1.47 | 3.71 | 3.26 | 4.06 | 4.02 | −3.97 | −3.49 | −3.8 | −3.56 | −3.49 | −3.33 |
| Cckbr | −3.75 | −3.26 | −3.48 | −3.35 | −3.55 | −2.97 | −3.17 | 0.23 | −0.4 | −0.84 | −1.17 | 2.94 | 3.06 | 3.1 | 2.86 | 2.95 | 2.99 |
| Cd70 | 2.34 | −2.35 | −2.18 | −1.55 | 0.35 | −0.56 | −0.29 | 6.44 | 5.51 | 6.72 | 6.66 | −2.22 | −1.55 | −2.33 | −1.52 | −1.42 | −1.7 |
| Cd9 | −2.1 | −3.44 | −2.09 | −1.73 | −1.68 | −3.2 | −1.65 | 7.18 | 7.87 | 8.03 | 7.61 | 1.33 | 0.21 | 0.64 | −1.19 | −2.06 | −1.15 |
| Cdc42ep1 | −0.64 | 1.99 | −1.25 | −2.01 | −2.3 | −2.06 | −2.27 | 5.13 | 5.88 | 6.11 | 5.71 | −1.61 | −2.15 | −2.78 | −1.98 | −0.97 | −2.16 |
| Cdh19 | −2.17 | −1.88 | −2.74 | −0.72 | −1.47 | −0.2 | −0.17 | 5.93 | 6.62 | 5.95 | 5.77 | 0.58 | 0.79 | 0.08 | −2.07 | −0.91 | −1.26 |
| Chrm1 | −3.42 | −3.34 | −3.71 | −3.28 | −3.11 | −2.88 | −2.41 | −3.34 | −1.94 | −2.68 | −2.99 | 2.79 | 3.18 | 2.88 | 3.02 | 2.99 | 3.2 |
| Chrm3 | −1.32 | −0.96 | −2.16 | −3.02 | −3.15 | −2.76 | −2.65 | −3.58 | −3.6 | −3.28 | −2.83 | 3.23 | 2.34 | 2.98 | 2.98 | 3.14 | 3.23 |
| Chsy3 | −3.34 | −3.77 | −3.69 | −2.39 | −2.35 | −1.74 | −1.86 | −3.17 | −3.02 | −1.58 | −3.57 | 3.61 | 2.95 | 3.49 | 3.44 | 3.66 | 3.69 |
| Clic6 | 0.32 | −0.16 | −1.77 | 6.67 | 6.57 | 7.14 | 6.33 | −1.27 | 0.66 | −0.41 | −0.35 | −0.66 | −2.11 | −1.54 | −2.08 | −1.52 | −2.92 |
| Cml5 | −2.31 | −1.74 | −2.3 | −1.66 | −1.94 | −0.7 | −1.92 | 6.87 | 7.06 | 7.34 | 7.13 | −0.25 | −1.69 | −2.45 | −1.63 | −1.53 | −1.81 |
| Cnpy1 | 5.29 | 5.38 | 5.54 | −0.56 | −0.1 | 0.51 | 0.62 | 4.32 | 4.48 | 4.27 | 4.01 | −2.88 | −2.46 | −2.99 | −2.96 | −1.9 | −2.26 |

TABLE 12-continued

Log2 fold change of expression of the 250 most variable genes across all samples Log2 Fold Change in Expression (by cell type)

| Gene | Granule | | | Purkinje | | | | Glia | | | | Oligo | | | OPC | | |
|---|---|---|---|---|---|---|---|---|---|---|---|---|---|---|---|---|---|
| Cobl | -2.3 | -3.21 | -2.61 | -2.36 | -2.19 | -2.09 | -2.31 | -3.14 | -3.33 | -3.48 | -3.26 | 3.85 | 3.78 | 4.23 | 2.89 | 3.06 | 2.62 |
| Col1a2 | -2.48 | -2.66 | -3.01 | -1.68 | -1.08 | 0.09 | -2.01 | 5.31 | 5.23 | 5.55 | 5.59 | 3.34 | 1.56 | 0.85 | -1.64 | -2.29 | -1.44 |
| Col4a5 | -2.98 | -2.19 | -2.7 | 3.94 | 4.08 | 4 | 3.82 | 2.59 | 2.85 | 2.31 | 2.77 | 0.58 | 0.27 | -0.95 | -0.93 | -2.08 | -2.25 |
| Col6a1 | -2.81 | -0.42 | -3.25 | -2.71 | -2.05 | -2.75 | -2.94 | -3.18 | -3.02 | -3.01 | -1.6 | 2.93 | 3.27 | 2.87 | 2.93 | 2.65 | 3.08 |
| Colgalt2 | -3.22 | -3.3 | -3.64 | -2.3 | -2.3 | -2.27 | -2.4 | 1.98 | 1.9 | 1.95 | 1.72 | 5.27 | 5.16 | 5.37 | -0.84 | -0.85 | -0.66 |
| Corin | -0.8 | -1.36 | -2.1 | 5.71 | 5.7 | 5.91 | 5.53 | -2.04 | -1.08 | -1.97 | 0.16 | -1.36 | -1.43 | -1.39 | -1.54 | -1.4 | -2.04 |
| Coro6 | -1.16 | -3.84 | -3.76 | 0.68 | 0.57 | 0.48 | 1.01 | -3.72 | -3.29 | -3.6 | -3.66 | 2.02 | 2.16 | 1.88 | -0.29 | -1.09 | -1.13 |
| Cpne7 | -3.14 | -2.81 | -3.14 | -2.33 | -2.32 | -1.79 | -1.2 | -2.58 | -2.67 | -3.01 | -2.73 | 1.9 | 2.83 | 2.51 | 1.3 | 1.23 | 1.18 |
| Crym | -3.25 | -2.95 | -2.78 | -2.68 | -2.38 | -2.1 | -2.92 | -3.16 | -3 | -2.98 | -3.07 | 3.98 | 4.01 | 4.06 | 4.28 | 4.3 | 4.19 |
| Csta1 | 0.79 | -2.34 | 0.52 | 6.35 | 5.83 | 6.19 | 6.07 | -2.96 | -0.68 | -2.76 | -1.85 | -1.33 | -1.12 | -0.29 | -1.19 | -1.53 | -1.13 |
| Ctxn3 | 0.22 | -1.98 | -0.04 | -2.5 | -0.85 | -2.55 | -1.71 | 5.53 | 5.32 | 6.08 | 5.13 | -1.61 | -1.15 | -2.14 | 1.01 | 0.95 | 1.62 |
| Cxcl14 | -3.23 | -2.63 | -1.8 | -2.66 | -2.92 | -2.07 | -2.33 | 3.67 | 4.22 | 3.93 | 4.59 | -1.27 | -0.28 | 0.11 | -0.8 | -2.54 | -1.8 |
| Cxcl5 | -0.88 | -1.95 | -1.79 | -1.15 | -1.46 | -1.21 | -1.43 | 6.37 | 6.19 | 4.89 | 4.19 | -1.83 | -1.92 | -0.55 | 0.05 | -1.01 | 0.85 |
| Cxcr4 | -2.01 | -1.4 | -2.01 | -1.4 | -1.66 | -1.44 | -1.64 | 5.66 | 4.95 | 6.7 | 7.52 | -2.05 | 1.06 | -2.15 | -1.37 | -0.14 | -1.54 |
| Cyp27a1 | -2.29 | -3.02 | -2.86 | 5.25 | 5.43 | 5.22 | 5.08 | 1.72 | 1.09 | 2 | 1.09 | 0.16 | -1.58 | -2.09 | -2.22 | -1.31 | -2.4 |
| Cyp2j9 | -1.54 | -3.54 | -2.34 | -0.8 | -2.11 | 0.51 | -0.66 | 7.77 | 8.43 | 8.05 | 8.42 | -1.64 | -0.66 | -1.09 | -2.32 | -2.57 | -2.56 |
| D430019H16Rik | -2.93 | -2.81 | -2.62 | -2.22 | -2.55 | -2.28 | -1.21 | -3.27 | -3.12 | -3.1 | -2.71 | 2.39 | 2.98 | 3.23 | 2.77 | 3.02 | 2.88 |
| Ddn | -3.04 | -3.17 | -3.03 | -2.45 | -2.72 | -2.5 | -2.7 | -2.95 | -2.79 | -2.77 | -2.86 | 1.54 | 2.39 | 1.85 | 3.34 | 3.31 | 3.11 |
| Ddx3y | -3.5 | -3.61 | -3.76 | 2.13 | 2.25 | 1.66 | 2.46 | 3.94 | 3.14 | 3.67 | 3.3 | -3.78 | -3.83 | -3.83 | -2.9 | -2.24 | -2.8 |
| Dlgap2 | -3.15 | -3.89 | -3.66 | -1.12 | -1.23 | -1.02 | -1.31 | -3.89 | -4.04 | -3.96 | -3.88 | 2.59 | 2.07 | 2.65 | 2.29 | 2.27 | 2.34 |
| Dlx4os | -0.68 | -1.54 | 1.18 | 5.5 | 5.88 | 5.72 | 5.37 | 1.87 | -2.39 | -2.37 | -2.47 | -2.06 | -2.79 | -1.8 | 0.45 | 0.62 | 1.53 |
| Dlx6os1 | -2.17 | -3.15 | -3.01 | -1.75 | -1.7 | -1.81 | -2.68 | -2.4 | -2.76 | -2.74 | -2.83 | 1.5 | 1.34 | 2.2 | -1.27 | 0.47 | 0.16 |
| Dmp1 | -2.89 | -1.58 | -2.88 | -1.43 | -1.81 | -2.3 | -1.32 | 6.91 | 6.83 | 7.37 | 6.73 | 0.8 | -3.01 | 0.39 | -0.25 | -2.12 | -1.16 |
| E030003E18Rik | -3.25 | -3.58 | -3.24 | -1.48 | -1.81 | -1.09 | -2.18 | 5.27 | 4.7 | 5.38 | 4.57 | 1.54 | 1.6 | 1.77 | -0.13 | 0.37 | -0.57 |
| Ebf1 | 3.07 | 2.93 | 2.55 | 6.1 | 5.65 | 6.17 | 5.55 | -1.4 | -0.25 | -1.2 | -0.74 | -0.46 | -0.79 | -1.1 | -2.9 | -2.99 | -2.9 |
| Ebf2 | -0.86 | -2.2 | -1.25 | 6.5 | 6.35 | 6.76 | 6.13 | 0.45 | 0.14 | 1.04 | -0.17 | -0.12 | -0.8 | -0.03 | -2.36 | -2.6 | -1.47 |
| Ebf3 | 0.46 | -1.99 | 0.7 | 5.27 | 5.19 | 5.23 | 5.22 | 0.44 | -0.42 | -0.96 | 0.26 | 0.06 | -0.18 | -1.42 | -1.46 | -2.68 | -2.38 |
| Ednrb | -2.41 | -1.31 | -2.06 | -2.56 | -1.17 | -2.01 | -1.65 | 7.99 | 8.28 | 8.28 | 8.63 | -1.72 | -1.09 | -0.85 | -1.4 | -2.02 | -1.48 |
| Egfr | -2.9 | -2.59 | -2.5 | -3.03 | -2.94 | -2.21 | -2.15 | 4 | 3.78 | 4.25 | 3.82 | 0.87 | -0.82 | -0.61 | -0.7 | 0.47 | 0.59 |
| Egr3 | -2.89 | -3.44 | -3.32 | -2.17 | -1.48 | -2.83 | -3.01 | -3.25 | -3.09 | -3.07 | -3.16 | 2.31 | 3.02 | 2.48 | 2.69 | 3.3 | 3.39 |
| Eif2s3y | -3.93 | -3.98 | -3.73 | 2.7 | 2.92 | 2.67 | 3.04 | 3.51 | 3.23 | 3.93 | 2.86 | -3.94 | -3.97 | -3.98 | -3.25 | -3.53 | -3.7 |
| Elfn1 | -2.78 | -2.95 | -3.05 | -2.93 | -1.59 | -1.8 | -2.33 | -2.2 | -2.67 | -2.74 | -2.85 | 3.36 | 2.82 | 4.02 | 0.17 | -0.14 | -0.3 |
| Emp2 | -1.62 | -2.6 | -2.14 | -1.24 | -1.24 | -0.2 | -0.77 | 5.46 | 5.12 | 4.95 | 5.37 | -1.32 | -3.31 | -0.78 | -0.29 | 0.1 | -0.59 |
| En2 | 4.67 | 5.17 | 5.02 | 0.06 | 0.88 | 0.17 | 1.32 | 3.06 | 3.5 | 3 | 3.89 | -2.76 | -2.84 | -2.85 | -2.07 | -1.98 | -1.49 |
| Enc1 | -2.15 | -2.98 | -2.79 | -2.61 | -2.91 | -3.16 | -3.32 | -3.52 | -3.39 | -3.38 | -3.45 | 2.7 | 3.25 | 3 | 2.78 | 3.24 | 3.18 |
| Etnppl | 0.92 | -3.15 | -1.54 | -2.86 | -0.47 | -1.89 | -2.17 | 7.33 | 7.3 | 6.62 | 7.46 | -2.26 | -1.11 | -0.84 | -1.33 | -2.02 | -2.03 |
| Eva1a | -3.44 | -2.68 | -3.43 | -1.61 | -1.1 | 0.05 | -0.78 | 6.26 | 5.46 | 5.7 | 5.47 | 0.45 | -0.51 | 0.81 | -1.57 | -1.43 | -1.83 |
| F3 | -2.6 | -3.9 | -4.03 | -2.62 | -2.25 | -2.86 | -2.14 | 6.66 | 7.01 | 7.57 | 7.39 | 1.31 | -0.04 | 0.22 | -0.47 | -0.68 | -1.21 |
| Fam107b | 1.1 | 1.18 | 0.74 | 5.97 | 5.57 | 6.23 | 5.9 | -2.54 | 0.31 | -0.07 | -0.51 | -1.69 | -2.04 | -1.69 | -2.66 | -2.78 | -2.5 |
| Fam19a1 | -3.32 | -3.65 | -3.6 | -1.74 | -1.76 | -1.43 | -1.5 | -3.25 | -3.39 | -2.26 | -2.12 | 5.06 | 4.36 | 5.09 | 1.48 | 1.72 | 1.36 |
| Fat2 | 6.74 | 7.11 | 7.14 | 0.45 | 0.51 | 1.17 | 0.88 | 2.25 | 1.78 | 2.7 | 2.22 | -1.97 | -2.75 | -2.44 | -2.44 | -2.15 | -1.64 |
| Fbln2 | -2.62 | -2.48 | -3.11 | -1.42 | -1.81 | -2.58 | -2.78 | -3.03 | -2.29 | -2.85 | -2.94 | 1.17 | 2.18 | 1.96 | 2.85 | 2.58 | 2.74 |
| Fezf2 | -2.84 | -2.98 | -2.83 | -2.24 | -2.51 | -2.29 | -2.49 | -2.75 | -2.58 | -2.56 | -2.65 | 3.1 | 3.94 | 3.54 | 2.5 | 2.52 | 2.3 |
| Fgd3 | -3.56 | -3.63 | -1.45 | 4.52 | 4.27 | 4.54 | 4.19 | -2.23 | -2.09 | -2.53 | -2.48 | -1.14 | -0.14 | -0.7 | -1.7 | -1.56 | -2.55 |
| Flrt2 | -2.72 | -3.91 | -3.83 | -2.17 | -2.12 | -1.9 | -2.26 | -3.49 | -2.25 | -1.96 | -2.52 | 2.91 | 2.71 | 3.07 | 3.43 | 3.69 | 3.49 |
| Folh1 | 0.34 | -3.14 | -2.54 | -3.11 | -0.95 | 1.25 | -0.59 | 8.44 | 7.91 | 7.9 | 7.57 | 0 | -1.44 | -0.83 | -3.08 | -2.99 | -2.36 |
| Foxg1 | -3.33 | -3.06 | -3.32 | -2.78 | -3.04 | -2.83 | -3.02 | -3.25 | -3.1 | -3.08 | -3.16 | 2.66 | 2.83 | 2.7 | 2.99 | 3.25 | 3.06 |
| Frem1 | -1.23 | -0.74 | -2.48 | -2.1 | -2.09 | -1.67 | -1.97 | 4.85 | 4.71 | 4.54 | 4.41 | -0.16 | 0.09 | 0.13 | -2.53 | -1.69 | -1.99 |
| Gabra6 | 7.01 | 7.08 | 7.52 | 1.09 | 2.13 | 1.79 | 1.72 | 3.55 | 3.09 | 3.46 | 3.66 | -3.78 | -3.83 | -3.54 | -3.25 | -2.63 | -2.94 |
| Galnt14 | -2.29 | -3.02 | -3.33 | -1.39 | -1.17 | -0.5 | -1.19 | -2.65 | -3.95 | -3.38 | -3.57 | 3.2 | 2.97 | 3.25 | 0.47 | 0.64 | 0.25 |
| Gas1 | -2.56 | -3.27 | -3.11 | -2.49 | -0.94 | -1.82 | -1.66 | 6.99 | 7.31 | 7.56 | 7.4 | -0.91 | -1.07 | -1.09 | -1.71 | -2.36 | -0.93 |
| Gda | -1.49 | -1.95 | -2.4 | -2.7 | -2.23 | -2.29 | -1.93 | -3.68 | -3.38 | -2.94 | -2.62 | 3.19 | 3.22 | 3.64 | 3.78 | 3.86 | 3.96 |
| Gdf10 | -0.34 | -0.83 | -0.59 | -3.39 | -2.66 | -1.11 | -1.88 | 9.43 | 9.69 | 10.04 | 9.95 | -2.08 | -2.61 | -3.66 | -2.5 | -2.11 | -2.73 |
| Gja1 | -2.54 | -2.96 | -2.38 | -0.77 | -1.66 | -1.22 | -1.82 | 8.38 | 8.84 | 9.06 | 9.06 | 0.36 | -0.42 | -1.59 | -1.69 | -1.79 | -1.78 |
| Gjb6 | -3.04 | -2.46 | -0.96 | -3.33 | -2.28 | -1.03 | -2.4 | 6.97 | 6.6 | 7.11 | 6.96 | 0.96 | 0.75 | 0.2 | -2.81 | -1.87 | -1.95 |
| Gjc3 | -1.5 | -1.23 | -0.56 | -1.47 | -1.07 | -1.29 | -1.36 | 7.86 | 7.96 | 8.03 | 7.82 | -1.2 | -1.72 | -0.9 | -2.41 | -2.42 | -1.98 |
| Gli1 | -2.36 | -1.06 | -0.79 | -1.72 | -2 | -1.77 | -1.97 | 5.82 | 6.3 | 6.05 | 5.39 | -2.39 | -2.48 | -1.34 | -1.69 | -1.59 | -1.87 |
| Gli3 | -3.13 | -3.65 | -2.04 | -1.19 | -1.84 | -0.59 | -1.25 | 6.35 | 5.79 | 6.39 | 5.21 | 0.47 | -0.57 | -0.17 | -1.24 | -1.55 | -1.26 |
| Glt25d2 | -3.33 | -3.45 | -2.9 | 3.96 | 4.21 | 3.8 | 3.79 | -3.25 | -2.6 | -3.08 | -2.69 | 2.66 | 0.95 | 1.69 | 1.93 | 1.49 | 2.02 |
| Gm11549 | -3.08 | -3.22 | -3.08 | -2.5 | -2.77 | -2.55 | -2.74 | -3 | -2.24 | -2.81 | -2.9 | 3.46 | 3.35 | 3.22 | 4.11 | 4.53 | 4.35 |
| Gm266 | -2.29 | -2.46 | -1.52 | -1.66 | 0.58 | -1.71 | 0.19 | 6.31 | 5.65 | 6.23 | 4.89 | -2.32 | -1.69 | -1.25 | -0.61 | 0.53 | -1.8 |
| Gm5083 | -2.64 | 0.35 | 0.66 | 8.14 | 7.82 | 7.37 | 7.8 | -2.54 | -1.55 | -2.32 | 0.83 | -2.67 | -2.77 | -0.35 | -1.95 | -0.89 | -2.14 |
| Gm5089 | 1.21 | 1.23 | 1.53 | -1.5 | -1.26 | -0.98 | -0.84 | 5.3 | 4.88 | 5.12 | 5.1 | 0.13 | -1.22 | -1.64 | -1.45 | -1.06 | -2.14 |
| Gm5468 | -3.09 | -2.79 | -3.47 | -1.77 | -1.95 | -3.01 | -1.92 | -3.4 | -3.26 | -2.46 | -2.35 | 2.65 | 2.34 | 2.23 | 4.28 | 4.34 | 4.52 |
| Gm5607 | -2.96 | -3.49 | -3.37 | -2.84 | -1.76 | -2.31 | -1.93 | 3.49 | 3.44 | 3.75 | 3.93 | -1.2 | -1.71 | 0.33 | -1.3 | -2.1 | -2.06 |
| Gm8179 | -2.09 | -3.69 | -3.01 | -2.29 | -1.48 | 0.32 | -1.44 | -3.54 | -3.41 | -3.39 | -3.46 | 3.46 | 2.37 | 3.01 | 3.03 | 3.03 | 2.79 |
| Gpr37l1 | -0.67 | -0.8 | -1.02 | -0.04 | 0.73 | 0.32 | 0.46 | 7.4 | 7.37 | 7.49 | 8.1 | -2.75 | -2.53 | -3.31 | -3.3 | -3.21 | -3.22 |
| Grik1 | -2.49 | -2.75 | -2.59 | 4.78 | 4.31 | 4.85 | 4.5 | -3.37 | -2.77 | -1.61 | -2.54 | -1.2 | -0.56 | 0.23 | -1.81 | -1.62 | -1.77 |
| Grm5 | -2.95 | -3.04 | -2.52 | -2.72 | -3.2 | -2.54 | -2.82 | -2.12 | -3 | -2.41 | -1.51 | 3.92 | 3.4 | 3.88 | 2.82 | 3.04 | 2.97 |
| Hepacam | -1.02 | -1.05 | -2.29 | -2.37 | -2.32 | -2.08 | -1.75 | 6.43 | 6.54 | 7.01 | 7.02 | -0.61 | -0.69 | -1.09 | -2.08 | -1.73 | -2.13 |
| Hes3 | -1.33 | -1.42 | -2.03 | 6.39 | 6.46 | 6.58 | 6.89 | -2.9 | -1.63 | -1.6 | -2.8 | -0.73 | -0.8 | -0.81 | -1.56 | -0.93 | -2.52 |
| Hs3st2 | -1.35 | -2.3 | -1.67 | -2.95 | -3.12 | -2.21 | -3 | -3.81 | -3.3 | -3.4 | -2.6 | 3.43 | 2.91 | 3.39 | 3.41 | 3.29 | 3.11 |
| Hs3st4 | -1.83 | -2.44 | -3.01 | -2.54 | -2.86 | -2.93 | -2.83 | -2.94 | -2.51 | -3.58 | -3.76 | 2.06 | 1.83 | 2.39 | 5.07 | 5.24 | 5.32 |
| Htr2a | -3.62 | -3.21 | -2.85 | -2.33 | -2.67 | -1.17 | -1.49 | -2.95 | -2.75 | -3.01 | -3.49 | 2.72 | 3.13 | 3.24 | 1.43 | 1.96 | 0.91 |

TABLE 12-continued

Log2 fold change of expression of the 250 most variable genes across all samples Log2 Fold Change in Expression (by cell type)

| Gene | Granule | | | Purkinje | | | Glia | | | | | Oligo | | | OPC | | |
|---|---|---|---|---|---|---|---|---|---|---|---|---|---|---|---|---|---|
| Icam5 | -2.06 | -3.39 | -3.26 | -2.71 | -2.42 | -2.76 | -2.95 | -3.19 | -3.03 | -3.01 | -3.1 | 2.7 | 3.38 | 2.97 | 3.04 | 2.85 | 2.79 |
| Icosl | -0.14 | -3.08 | -1.26 | -2.31 | -1.16 | -0.8 | -2.56 | 4.73 | 5.78 | 5.62 | 6.01 | 0.44 | -0.13 | -3.05 | -0.68 | -0.88 | -1.74 |
| Il22 | -1.83 | -1.12 | -1.82 | 6.23 | 6.67 | 5.84 | 6.76 | 0.21 | -1.55 | -1.53 | 1.32 | -1.86 | -1.96 | -1.97 | -1.13 | -1.02 | -1.33 |
| Iltifb | 0.2 | 1.08 | -0.28 | 7.43 | 7.47 | 6.43 | 7.24 | -2.27 | -0.68 | -0.27 | -2.16 | -1.17 | -2.5 | -2.51 | -1.68 | -0.53 | -0.37 |
| Irx1 | -0.62 | -1.8 | -1.63 | -0.94 | -1.26 | -1 | 1.01 | 6.28 | 6.97 | 6.68 | 5.97 | -1.67 | -1.76 | -1.77 | -0.91 | -0.8 | -1.11 |
| Irx2 | -1.3 | -1.45 | -1.3 | -0.59 | -0.91 | -0.65 | -0.89 | 5.89 | 5 | 4.5 | 7.92 | -1.33 | -1.42 | -1.43 | -0.56 | -0.45 | -0.76 |
| Irx5 | -1.26 | -1.43 | -1.25 | -0.55 | -0.86 | -0.61 | -0.84 | 6.78 | 5.39 | 5.31 | 5.12 | -1.29 | -1.4 | -1.4 | -0.52 | -0.42 | -0.72 |
| Itih3 | -1.03 | -1.71 | -3.09 | -2.47 | -1.34 | -0.72 | -0.85 | 7.36 | 7.97 | 7.78 | 7.8 | -1.69 | -1.23 | -3.23 | -2.44 | -2.34 | -2.62 |
| Itpripl2 | -2.59 | -2.74 | -0.75 | -1.96 | -2.24 | -2.01 | -0.97 | 3.72 | 5.54 | 4.53 | 5.63 | 3.16 | 1.08 | 0.47 | -1.06 | -0.93 | -0.81 |
| Kank1 | -1.2 | -2.76 | -3.47 | 3.64 | 3.72 | 3.91 | 3.61 | 3.67 | 3.34 | 3.2 | 3.16 | -1.44 | -1.6 | -1.05 | -1.86 | -1.9 | -2.07 |
| Kcnc2 | -3.06 | -3.94 | -3.28 | -1.63 | -1.69 | -1.76 | -2.05 | -3.64 | -3.83 | -3.42 | -2.45 | 2.35 | 2.04 | 2.47 | 1.53 | 1.91 | 1.67 |
| Kcnf1 | -3.17 | -3.3 | -2.69 | -2.6 | -2.87 | -2.65 | -2.85 | -3.09 | -2.93 | -2.91 | -3 | 2.64 | 3.57 | 3.04 | 3.15 | 3.53 | 3.5 |
| Kcnj10 | -0.43 | -1.24 | -0.8 | -1.92 | -1.35 | -1.41 | -1.69 | 7.22 | 7.44 | 7.58 | 7.74 | -1.81 | -1.54 | -2.32 | -1.87 | -2.23 | -2.87 |
| Kcnj16 | -2.65 | -3.22 | -2.82 | -2.63 | -1.85 | -2.05 | -1.26 | 8.02 | 8.42 | 9.13 | 8.66 | -0.18 | -1.47 | -1.8 | -0.62 | -0.94 | -0.92 |
| Kcnj4 | -3.25 | -2.97 | -3.25 | -2.08 | -2.96 | -2.75 | -2.02 | -1.92 | -3.02 | -1.29 | -3.09 | 2.64 | 2.99 | 2.59 | 2.8 | 3.08 | 3.11 |
| Kcnq5 | -1.99 | -2.99 | -2.33 | -2.94 | -2.91 | -2.45 | -2.7 | -2.84 | -2.85 | -3.07 | -3.45 | 3.98 | 3.21 | 3.95 | 1.78 | 2.14 | 1.96 |
| Kcnt2 | -3.04 | -3.97 | -3.7 | -2.8 | -2.59 | -2.8 | -2.71 | -3.1 | -3.68 | -3.41 | -3.26 | 3.83 | 3.56 | 3.86 | 3.87 | 4.16 | 4.02 |
| Kcnv1 | -2.9 | -1.6 | -3.33 | -2.79 | -3.05 | -2.84 | -3.02 | -3.26 | -2.59 | -3.09 | -3.17 | 3.39 | 3.09 | 3.39 | 4.45 | 5.1 | 4.73 |
| Kctd12b | -2.28 | -2.44 | -2.27 | -1.64 | -0.88 | -1.69 | 0.46 | 6.46 | 6.53 | 4.27 | 5.81 | 1.51 | -0.88 | -2.41 | -1.61 | 0.15 | -0.84 |
| Kdm5d | -3.67 | -3.61 | -3.88 | 1.75 | 1.7 | 2.17 | 2.34 | 3.03 | 3.26 | 3.79 | 3.43 | -3.89 | -3.74 | -3.59 | -3.52 | -2.77 | -3.31 |
| Lama2 | -2.78 | -2.52 | -3.46 | -1.63 | -0.66 | -0.75 | -1.15 | 5.63 | 5.46 | 5.81 | 5.14 | 0.88 | -0.63 | -0.05 | -1.08 | -0.77 | -0.96 |
| Lamp5 | -0.76 | -3.68 | -0.6 | -2.6 | -2.91 | -3.15 | -1.97 | -3.52 | -2.98 | -3.37 | -3.45 | 3.64 | 3.93 | 3.58 | 2.65 | 2.86 | 2.66 |
| Lcat | -1.74 | -0.24 | -0.91 | -2.33 | -1.59 | -2.14 | -1.07 | 6.63 | 7.33 | 7.06 | 7.6 | -1.79 | -2.6 | -2.88 | -1.33 | -1.32 | -1.74 |
| Ldb2 | -1.15 | -1.3 | -1.47 | -2.82 | -2.85 | -2.73 | -2.74 | -2.52 | -3.71 | -3.56 | -2.82 | 3.92 | 3.54 | 4.08 | 2.66 | 2.95 | 3.03 |
| Lfng | -1.33 | -3.04 | -2.88 | -2.25 | -0.38 | -1.5 | -1.78 | 6.67 | 6.99 | 7.17 | 7.03 | -0.1 | -0.59 | -2.06 | -2.21 | -2.12 | -2.4 |
| Lgr6 | -2.01 | -1.32 | -3.31 | 0.85 | -1.13 | -1.69 | -1.45 | 6.89 | 6.65 | 7.07 | 7.39 | -2.06 | -1.53 | -2.97 | -1.25 | -0.31 | -0.77 |
| Lhx1 | 3.35 | 4.51 | 3.83 | 4.89 | 4.82 | 4.54 | 4.98 | 1.4 | 0.21 | -0.71 | -1.65 | -2.59 | -2.68 | -2.69 | -1.91 | -1.82 | -2.09 |
| Lhx1os | 4.03 | 3.81 | 3.8 | 7.59 | 7.08 | 7.22 | 7.24 | -0.59 | -0.66 | 0.73 | -2.7 | -3.44 | -3.52 | -3.52 | -2.8 | -2.7 | -2.37 |
| Lhx5 | -1.29 | -0.67 | 0.73 | 5.36 | 5.06 | 4.62 | 5.17 | -1.14 | 2.77 | 2.28 | -0.51 | -0.9 | -1.05 | -0.76 | -0.62 | -0.48 | -1.38 |
| Linc-md1 | -2.34 | 0.53 | -2.33 | 8.05 | 7.97 | 7.74 | 7.98 | -1.4 | -2.04 | -2.01 | -2.12 | -0.26 | -2.47 | -1.73 | 0 | -1.55 | -1.83 |
| Lrrc7 | -2.15 | -2.36 | -1.95 | -2.49 | -2.54 | -2.24 | -2.57 | -3.33 | -3.2 | -3.22 | -3.46 | 3.49 | 2.95 | 3.6 | 3.14 | 3.22 | 3.16 |
| Lyzl4 | -0.09 | -0.84 | -1.73 | -2.74 | -3.43 | -3.25 | -3 | -3.26 | -2.6 | -3.46 | -3.17 | 3.57 | 3.11 | 3.89 | 3.44 | 2.9 | 2.41 |
| Mal2 | -3.22 | -2.95 | -3.21 | -3.04 | -2.32 | -2.81 | -2.66 | -1.2 | -2.93 | -2.11 | -3.02 | 2.95 | 3.51 | 3.05 | 3.24 | 3.86 | 3.55 |
| March1 | -3.03 | -3.16 | -3.46 | -2.38 | -2.12 | -1.84 | -2.14 | -2.85 | -2.61 | -2.6 | -2.16 | 3.33 | 2.88 | 3.4 | 3.41 | 3.57 | 3.53 |
| Megf10 | -0.89 | -0.08 | -1.93 | -2.23 | -1.27 | -1.01 | -1.29 | 5.87 | 5.43 | 6.03 | 5.97 | -0.26 | -0.76 | -0.61 | -1.82 | -2.06 | -1.66 |
| Meis2 | -1.84 | -3.74 | -3.52 | -2.43 | -2.47 | -2.09 | -2.37 | -2.99 | -3.3 | -2.75 | -2.87 | 4.23 | 3.8 | 4.29 | 4.23 | 4.44 | 4.53 |
| Mertk | -2.35 | -2.89 | -2.5 | -2.14 | -2.44 | -1.49 | -1.39 | 5.43 | 4.91 | 5.19 | 4.92 | 1.77 | 0.93 | 0.94 | -2.53 | -2.06 | -1.73 |
| Metrn | -0.86 | -1.32 | -0.85 | -1.19 | -2.34 | -2.11 | -0.72 | 6.38 | 6.28 | 6.18 | 5.89 | -2.08 | 0.03 | -2.83 | -1.15 | -1.93 | -2.21 |
| Mgst1 | -1.37 | -1.61 | -2.53 | -1.88 | -1.34 | -0.48 | -0.8 | 5.66 | 6.39 | 7.26 | 7.27 | 0.89 | -0.79 | -1.01 | -1.85 | -1.76 | -1.16 |
| Miat | -2.51 | -2.92 | -4.04 | -3.57 | -3.15 | -3.85 | -3.22 | -4.02 | -2.99 | -3.96 | -3.99 | 3.13 | 3.03 | 3.17 | 2.84 | 2.66 | 2.91 |
| Mlc1 | 0.19 | -2.12 | -0.65 | -1.5 | -0.6 | -1.58 | -1.55 | 6.67 | 7.29 | 6.95 | 7.65 | -2.87 | -1.88 | -1.73 | -2.97 | -2.88 | -3.14 |
| Mmp14 | -2.16 | -2.92 | -2.15 | -1.33 | -0.12 | 1.33 | 0.07 | 5.36 | 5.53 | 4.96 | 5.93 | 0.31 | -0.79 | -1.66 | -2.11 | -2.02 | -1.53 |
| Mpped1 | -3.91 | -3.96 | -3.53 | -3.22 | -2.78 | -2.5 | -2.64 | -2.06 | -3.3 | -3.77 | -3.57 | 3.81 | 3.53 | 3.74 | 3.2 | 3.11 | 3.24 |
| Msx2 | -2.75 | -0.55 | -2.74 | -0.76 | 0.35 | -0.83 | 1.38 | 5.54 | 5.77 | 6.65 | 6.09 | -1.44 | -1.15 | -2.29 | -0.35 | -1.1 | 0.04 |
| Mybpc1 | -3.03 | -2.68 | -2.85 | -2.39 | -2.62 | -2.21 | -2.39 | 4.96 | 4.98 | 5.24 | 4.53 | -0.54 | -0.74 | -1.28 | -1.73 | -2.23 | -1.43 |
| Myh6 | -1.01 | -2.79 | -2.63 | -2 | -2.29 | -1.21 | -0.67 | 5.42 | 4.96 | 6 | 5.48 | -0.18 | -0.34 | -0.17 | -1.1 | -1.88 | -2.15 |
| Neto1 | -3.04 | -3.3 | -4.08 | -3.52 | -4 | -2.21 | -3.22 | -2.49 | -3.55 | -3.63 | -3.31 | 4.08 | 3.71 | 4.08 | 4.29 | 4.47 | 4.32 |
| Nid1 | -0.48 | -2.75 | -2.56 | -1.47 | -1.07 | -0.01 | -2.1 | 5.3 | 5.27 | 5.97 | 5.32 | 1.89 | -0.04 | 0.21 | -0.7 | -0.86 | -1.28 |
| Nkx2-2 | -0.39 | -1.46 | -1.24 | 1.22 | -0.76 | -1.5 | -0.73 | 5 | 5.88 | 4.37 | 6.17 | -2.1 | -2.2 | 0.06 | -1.42 | -1.33 | -1.59 |
| Npr3 | -2.56 | -3.22 | -3.06 | -2 | -2.7 | -2.43 | -1.87 | -3.39 | -2.45 | -2.75 | -3.3 | 4.91 | 4.69 | 4.67 | 3.37 | 3.55 | 3.79 |
| Npy1r | -2.49 | -3.51 | -3.4 | -0.48 | -1.36 | -1.99 | -0.74 | -3.33 | -2.7 | -3.16 | -3.25 | 1.67 | 1.89 | 1.85 | 2.62 | 3.15 | 3.36 |
| Nrgn | -3.46 | -3.57 | -3.46 | -2.95 | -2.38 | -2.99 | -3.17 | -3.39 | -2.78 | -3.23 | -2.87 | 2.49 | 2.89 | 2.84 | 3.02 | 2.71 | 2.8 |
| Nrk | -1.88 | -0.43 | -0.33 | 7.87 | 7.64 | 7.31 | 7.48 | -0.27 | -0.49 | -0.17 | -1.43 | -1.39 | -2.21 | -1.34 | -1.2 | -1.62 | -2.4 |
| Ntsr2 | -1.18 | -3.62 | -3.5 | -2.41 | -2.4 | -1.42 | -2.37 | 5.58 | 5.46 | 5.49 | 6.12 | -0.83 | 0.11 | -0.54 | -1.48 | -1.87 | -2.24 |
| Nup62cl | 0.12 | -2.48 | -1.53 | 6.5 | 6.67 | 6.42 | 6.33 | -0.91 | -2.02 | -2 | -0.38 | -2.35 | -0.92 | -2.45 | 0.93 | 0.54 | 0.37 |
| Oprd1 | -3.39 | -3.5 | -2.97 | -2.27 | -2.26 | -1.96 | -1.75 | -3.31 | -2.34 | -2.65 | -2.19 | 2.25 | 2.39 | 2.89 | 2.38 | 2.16 | 2.17 |
| P2ry1 | 0.41 | -3.3 | -0.74 | -2.55 | -1.27 | -0.71 | -2.81 | 5.38 | 6.44 | 6.19 | 5.93 | 0.73 | -1.81 | -1.83 | -1.04 | -0.42 | 0.01 |
| Paqr6 | -1.31 | -1.98 | -2.48 | -1.84 | -2.13 | -1.89 | -0.38 | 6.76 | 5.77 | 6.34 | 6.38 | -2.52 | -1.5 | -0.95 | -1.81 | -1.72 | -0.21 |
| Pax3 | -0.92 | -2.42 | 0.2 | -2.02 | -1.08 | 0.89 | -1.94 | 9.17 | 8.98 | 9.69 | 8.75 | -2.24 | -2.96 | -2 | -1.2 | -0.8 | -1.79 |
| Pcsk6 | -1.66 | -2.09 | -2.44 | 4.47 | 4.38 | 4.64 | 4.38 | 3.08 | 3.08 | 3.06 | 3.12 | -1.72 | -2.43 | -1.61 | -1.72 | -2.07 | -2.11 |
| Pde1a | -2.33 | -3.37 | -3.3 | -2.47 | -2.15 | -2.83 | -2.62 | -3 | -3.58 | -2.1 | -3.69 | 4.29 | 3.71 | 4.27 | 4.01 | 4.21 | 4.22 |
| Pde5a | -1.72 | -1.71 | -2.38 | 4.89 | 4.54 | 4.93 | 4.74 | -2.91 | -1.89 | -2.42 | -0.47 | 0.02 | -1.18 | -2.19 | -2.19 | -2.08 | -1.88 |
| Pdgfd | -1.65 | -2.29 | -2.3 | 0.32 | -0.83 | 0.37 | -0.56 | 5.57 | 5.35 | 5.62 | 5.4 | 2.41 | -0.03 | -0.05 | -1.61 | -1.71 | -1.39 |
| Pdzph1 | -1.13 | -1.9 | -1.36 | 5.35 | 5.2 | 5.86 | 5.48 | -1.53 | -1.26 | -1.69 | -1.38 | -2.12 | -1.33 | -1.86 | -1.21 | -0.56 | -0.62 |
| Pih1h3b | -0.92 | 0.61 | -1.93 | 8.06 | 7.83 | 8.09 | 7.41 | -2.54 | -2.35 | -2.33 | -2.43 | -0.76 | -1.12 | -1.12 | -0.48 | -0.89 | -2.14 |
| Pkp3 | -0.14 | -1.86 | -1.69 | 5.9 | 6.57 | 6.66 | 6.79 | -1.6 | 0.32 | -1.38 | -1.49 | -0.75 | -1.82 | -1.83 | -0.97 | -0.87 | -1.18 |
| Pla2g7 | -1.36 | -1.74 | -1.76 | -2.5 | -1.74 | -1.63 | -2.05 | 6.14 | 6.52 | 6.82 | 7.16 | -0.4 | -1.11 | -0.6 | -2.46 | -1.87 | -1.96 |
| Plekhd1 | -1.03 | -0.41 | -0.97 | 5.51 | 5.35 | 5.56 | 5.43 | 0.18 | -0.21 | -0.76 | -1.5 | -1.57 | -2.29 | -2.3 | -2.61 | -2.31 | -2.65 |
| Plekho2 | -0.01 | 0.12 | -0.5 | -2.1 | -0.41 | -1.22 | -0.44 | 5.92 | 5.77 | 5.45 | 5.41 | -0.06 | -2.98 | -0.41 | -2.06 | -1.94 | -1.61 |
| Plpp3 | -2.3 | -3.08 | -2.36 | -2.26 | -2.83 | -2.01 | -2.19 | 6.9 | 6.86 | 7.38 | 7.29 | 0.46 | -0.4 | -0.57 | -2.04 | -1.62 | -1.7 |
| Plscr1 | -2.56 | -2.72 | -2.55 | -1.92 | -2.2 | 0.11 | -1.36 | 6.83 | 7.21 | 6.18 | 7 | 1.84 | 0.98 | -2.04 | -0.43 | -0.84 | -2.07 |
| Plscr4 | -1.22 | -3.82 | -2.13 | -1.27 | -0.66 | -1.24 | -0.71 | 7.3 | 6.59 | 6.99 | 6.69 | -0.11 | 0.13 | -0.32 | -1.11 | -1.68 | -0.85 |
| Ppp1r17 | 0.41 | 1.4 | 0.3 | 7.02 | 6.72 | 6.77 | 6.83 | 1.89 | 1.23 | 2.02 | 1.22 | -3.43 | -3.5 | -3.51 | -2.79 | -1.59 | -2.97 |
| Prkag3 | -1.98 | -2.15 | -1.97 | 6.98 | 5.99 | 6.04 | 5.86 | -1.88 | -1.69 | 0.3 | -1.77 | 0.62 | 2.59 | -2.12 | -1.3 | -1.2 | -0.42 |

TABLE 12-continued

Log2 fold change of expression of the 250 most variable genes across all samples Log2 Fold Change in Expression (by cell type)

| Gene | Granule | | | Purkinje | | | Glia | | | | | Oligo | | | OPC | | |
|---|---|---|---|---|---|---|---|---|---|---|---|---|---|---|---|---|---|
| Procr | −0.11 | −1.82 | 0.3 | 6.43 | 5.71 | 6.23 | 5.82 | −1.56 | 0.77 | −1.35 | −1.46 | −1.69 | −0.85 | −1.79 | −0.95 | −0.84 | −1.15 |
| Prr5 | −2.89 | −1.59 | −2.88 | −1.6 | −0.8 | −2.38 | −1.93 | 5.31 | 4.73 | 4.47 | 4.54 | −1.24 | −2.18 | −2.99 | −2.3 | −2.21 | −2.47 |
| Ptk2b | −3.04 | −3.53 | −2.99 | −1.34 | −1.25 | −1.33 | −1.38 | −1.52 | −3.78 | −3.29 | −3.29 | 3.42 | 3.28 | 3.61 | 2.8 | 2.85 | 2.83 |
| Ptpn5 | −2.49 | −2.34 | −1.79 | −3.27 | −3.02 | −3.31 | −3.21 | −3.97 | −3.29 | −3.53 | −3.17 | 2.7 | 2.91 | 2.88 | 2.42 | 2.33 | 2.35 |
| Ptprz1 | −2.08 | −1.9 | −1.95 | −2.52 | −2.22 | −2.03 | −2.25 | 5.61 | 5.67 | 5.77 | 5.64 | −1.09 | −0.54 | −0.44 | −1.39 | −1.32 | −1.47 |
| Rab11fip1 | −0.47 | −2.58 | −1.25 | 5.58 | 5.16 | 5.38 | 5.15 | 0.78 | −2.14 | 0.54 | −0.12 | −2.45 | −1.87 | 0.19 | −0.81 | −1.67 | −1.94 |
| Rab27b | −1.52 | −3.63 | −3.38 | −2.44 | −2.3 | −1.64 | −2.88 | −2.39 | −2.26 | −3.48 | −2.84 | 3.18 | 3.13 | 3.24 | 1.88 | 2.19 | 2.05 |
| Robo3 | −3.27 | −3.39 | −2.82 | −2.72 | −2.43 | −2.77 | −2.4 | −3.19 | −3.04 | −2.49 | −3.1 | 3.3 | 3.62 | 3.17 | 2.86 | 2.76 | 1.77 |
| Rtn4rl2 | −2.89 | −3.03 | −2.88 | −2.28 | −1.89 | −0.79 | −2.53 | −2.79 | −2.62 | −2.6 | −2.7 | 3.54 | 3.47 | 3.99 | 0.91 | 1.16 | −0.15 |
| Rxfp1 | −3.55 | −2.28 | −3.54 | −3.06 | −1.92 | −3.1 | −1.89 | −2.82 | −3.34 | −2.89 | −1.76 | 3.77 | 3.02 | 3.29 | 2.25 | 2.54 | 2.59 |
| S1pr1 | −1.93 | −1.33 | −2.32 | −2.18 | −1.53 | −0.28 | −1.82 | 8.26 | 7.76 | 8.58 | 8.08 | −0.67 | −0.84 | −2.9 | −2.36 | −1.8 | −1.81 |
| Scube1 | −0.78 | −3.51 | −3.68 | −2.47 | −2.24 | −2.53 | −2.77 | −3.31 | −1.56 | −1.94 | −3.56 | 3.04 | 3.08 | 3.75 | 2.41 | 2.24 | 2.28 |
| Sdc4 | −0.68 | −1.36 | −0.61 | −0.08 | −0.58 | −0.84 | −0.88 | 7.1 | 6.87 | 7.34 | 7 | −0.78 | −1.24 | −1.11 | −2.99 | −2.56 | −2.88 |
| Serpinh1 | −2.61 | −2.77 | −1.92 | −1.07 | −2.25 | −1.14 | −1.42 | 6.14 | 6.4 | 6.42 | 6.25 | 1.38 | −0.92 | −0.93 | −0.49 | −1.84 | −0.76 |
| Skor2 | −1.02 | −0.75 | −2.03 | 9.62 | 9.31 | 9.36 | 9.2 | −2.62 | −1.65 | −2.41 | −1.28 | −2.76 | −2.2 | −1.03 | −1.11 | −1.93 | −1.37 |
| Slc14a1 | −2.32 | −2.96 | −1.24 | −2.33 | −1.09 | −0.82 | −2.28 | 8.6 | 8.67 | 8.81 | 9 | −0.08 | −1.11 | −2.51 | −2.92 | −1.75 | −2.52 |
| Slc1a3 | −0.86 | −0.84 | −1.04 | −2.52 | −1.36 | −1.3 | −1.72 | 6.89 | 7.07 | 7.21 | 7.43 | −0.41 | −1.2 | −1.09 | −1.38 | −1.54 | −1.93 |
| Slc24a4 | −3.11 | −3.39 | −1.46 | −2.56 | −2.16 | −1.45 | −1.9 | −3.15 | −2.1 | −2.64 | −2.89 | 3.41 | 3.28 | 3.64 | 2.76 | 2.61 | 2.7 |
| Slc2a10 | −1.59 | −1.65 | −3.06 | −0.57 | −1.03 | −0.25 | −1.56 | 6.94 | 8.16 | 8.38 | 8.52 | −0.45 | −2 | −1.61 | −1.62 | −1.49 | −2.58 |
| Slc2a4 | −1.92 | −2.08 | −1.91 | −1.26 | 0.81 | −1.32 | −1.54 | 6.66 | 6.71 | 6.3 | 6.26 | 0.14 | −2.05 | −2.06 | −1.22 | −1.12 | −1.43 |
| Slc30a3 | −2.25 | −0.72 | −3.07 | −2.03 | −1.93 | −3 | −3.17 | −3.39 | −3.25 | −3.23 | −3.31 | 1.93 | 2.53 | 2.13 | 1.02 | 1.33 | 0.59 |
| Slc39a12 | −3.1 | −2.64 | −2.23 | −1.99 | −1.59 | −0.45 | −1.3 | 7.09 | 6.36 | 6.99 | 6.32 | −0.12 | 0.09 | −0.7 | −0.29 | −0.63 | −0.54 |
| Slc6a7 | −3.12 | −3.56 | −2.63 | −2.38 | −2.31 | −2.15 | −1.78 | −3.66 | −2.92 | −1.46 | −3.6 | 2.69 | 2.81 | 2.72 | 2.29 | 2.04 | 2.21 |
| Slc7a10 | −0.49 | −2.87 | 0.07 | −2.6 | −1.37 | −1.26 | −1.86 | 5.18 | 5.25 | 5.47 | 5.34 | −2.73 | −2.07 | −0.83 | −1.46 | −2.48 | −1.17 |
| Slc9a3 | 0.06 | −1.78 | −1.55 | 6.3 | 5.74 | 6.04 | 5.97 | −0.91 | −2.32 | −2.63 | −0.21 | −1.18 | −1.76 | −0.35 | −2.01 | −2.02 | −1.94 |
| Slco4c1 | −2.1 | −3.29 | −2.87 | −2.48 | −2.47 | −2.18 | −2.44 | −2.08 | −2.56 | −2.84 | −2.95 | 3.52 | 3.65 | 3.67 | 3.66 | 3.74 | 3.75 |
| Smpx | −1.6 | −3.15 | −2.78 | 5.51 | 5.06 | 5.24 | 5.02 | 0.01 | 0.4 | 2 | −1.05 | 0.34 | −1 | −0.68 | −0.83 | 0.34 | −0.22 |
| Sod3 | −0.17 | −1.88 | −2.31 | −1.51 | −1.12 | −1.1 | −2.54 | 5.57 | 4.73 | 6.18 | 5.58 | −0.63 | −2.11 | −1.62 | −0.98 | −0.49 | −1.25 |
| Sparc | −0.16 | −1.34 | −1.02 | −0.16 | 0.41 | −0.35 | −0.06 | 5.75 | 6.59 | 6.09 | 7.02 | 0.29 | −0.45 | −1.35 | −2.42 | −3.2 | −2.73 |
| Stac | −0.42 | −2.17 | −2.73 | 6.25 | 6.2 | 6.5 | 5.85 | −3.36 | −2.69 | −3.46 | −3.26 | 1.83 | 1.46 | 1.44 | −2.18 | −1.21 | −1.17 |
| Stk17b | −0.87 | −1.16 | −1.89 | 4.47 | 4.47 | 4.32 | 4.39 | 2.05 | 1.74 | 1.41 | 2.15 | 0.52 | 0.79 | 0.15 | −2.58 | −2.35 | −2.02 |
| Stk32a | −1.75 | −3.56 | −2.78 | −1.83 | −1.31 | −1.02 | −1.55 | 6.44 | 6.07 | 5.9 | 5.51 | −0.71 | 0.01 | 0.89 | −1.59 | −1.88 | −2.55 |
| Sycp1 | −1.38 | −1.98 | −2.69 | 7.86 | 7.73 | 8.13 | 7.87 | −1.72 | 0.47 | −1.14 | −2.56 | −1.87 | −2.5 | −2.51 | −1.22 | −1.37 | −1.22 |
| Syt10 | −3.36 | −2.78 | −2.52 | −2.54 | −1.59 | −2.32 | −2.3 | 4.59 | 4.56 | 4.47 | 4.52 | −0.2 | −0.04 | −0.22 | 1.74 | 1.93 | 2.22 |
| Tbr1 | −3.07 | −1.2 | −1.46 | −0.91 | −2.71 | −2.45 | −2.35 | −3.38 | −3.24 | −3.22 | −3.3 | 2.26 | 2.05 | 1.9 | 4.35 | 4.48 | 4.31 |
| Tex36 | −1.92 | −0.36 | −1.91 | −0.11 | 0.5 | −1.32 | −0.48 | 6.48 | 7.29 | 4.54 | 7.49 | −0.52 | −2.05 | −1.2 | −1.23 | −1.12 | −1.43 |
| Tlcd1 | 0.04 | −3.19 | −0.04 | −2.45 | −0.93 | −1.02 | −2.05 | 4.92 | 5.48 | 5.32 | 5.98 | −1.53 | −2.06 | 0 | −1.68 | −1.56 | −1.92 |
| Tlr3 | −0.83 | 0.39 | −3 | −2.89 | −2.26 | −1.95 | −1.03 | 6.19 | 6.34 | 5.75 | 6.41 | 0.36 | 0.75 | −0.4 | −1.54 | −1.71 | −1.39 |
| Tmem132b | −2.99 | −3.75 | −3.71 | −2.39 | −2.4 | −2.19 | −2.29 | −3.01 | −2.49 | −1.41 | −2.35 | 2.8 | 2.5 | 2.87 | 2.51 | 2.62 | 2.74 |
| Tmem179 | −1.56 | −1.37 | −2.47 | −2.26 | −3.33 | −2.32 | −2.33 | −3.51 | −3.38 | −3.37 | −3.44 | 1.95 | 2.34 | 2.26 | 1.73 | 1.68 | 1.81 |
| Tmem200a | −3.26 | −2.79 | −2.49 | −2.13 | −2.29 | −2.2 | −2.33 | −2.69 | −1.51 | −2.13 | −2.95 | 4.59 | 4.02 | 4.63 | 0.66 | 1.36 | 0.58 |
| Tnc | −3.7 | −1.99 | −2.11 | −1.04 | −1.81 | −1.74 | −1.07 | 6.99 | 6.45 | 6.78 | 6.47 | −0.5 | −1.62 | −3.23 | −1.8 | −1.89 | −1.04 |
| Tox3 | −3.17 | −2.98 | −3.02 | −1.75 | −1.46 | −2.05 | −1.28 | −3.25 | −3.64 | −2.42 | −3.68 | 3.07 | 2.89 | 3.18 | 1.28 | 1.73 | 1.8 |
| Tril | −0.3 | −0.9 | −1.45 | −2.45 | −1.18 | −1.58 | −2.53 | 7.36 | 7.65 | 7.9 | 8.19 | −1.6 | −1.95 | −1.38 | −2.41 | −3.19 | −2.01 |
| Trim30a | −1.53 | −1.65 | −1.85 | −0.9 | −0.98 | −0.78 | −0.67 | −0.38 | −0.06 | 0.26 | 1.78 | 1.87 | 0.43 | 0.75 | 5.84 | 7.25 | 6.61 |
| Trp53corl | −2 | −2.81 | −2.65 | −1.16 | −1.54 | −2.07 | −1.03 | 6.81 | 6.13 | 5.53 | 5.84 | −0.32 | −0.59 | −0.12 | −1.99 | −0.46 | −0.88 |
| Ttpa | −2.62 | −3.26 | −3.11 | 0.87 | 0.92 | 0.4 | −0.38 | 5.11 | 5.15 | 5.18 | 5.04 | −0.74 | −1.66 | −2.77 | −2.5 | −0.9 | −0.43 |
| Uty | −3.8 | −3.75 | −3.8 | 2.74 | 2.95 | 2.84 | 2.84 | 3.75 | 3.14 | 3.31 | 3 | −3.31 | −3.44 | −3.2 | −3.21 | −3 | −3.37 |
| Vip | −2.37 | −2.52 | −2.36 | −1.74 | −1.2 | −1.79 | −1.99 | −2.27 | −2.08 | −2.06 | −2.16 | 1.44 | 2.04 | −0.09 | 0.15 | 1.04 | 0.87 |
| Vsig2 | −3.19 | −3.31 | −3.18 | −2.61 | −2.88 | −2.66 | −2.86 | −0.74 | −2.94 | −2.92 | −3.01 | 3.93 | 3.57 | 4.2 | 3.69 | 3.64 | 3.6 |
| Vstm2b | −3.04 | −2.93 | −3.42 | −2.91 | −2.67 | −2.03 | −1.83 | −2.94 | −3.21 | −3.19 | −3.27 | 2.61 | 2.78 | 2.53 | 0.93 | 1.07 | 0.54 |
| Wif1 | −2.64 | −3.11 | −2.94 | −2.22 | −0.5 | −0.87 | −1.2 | 4.52 | 5.33 | 5.85 | 5.73 | −2.44 | −1.86 | −2.23 | 1.95 | 2.32 | 2.12 |
| Zfp385c | −1.41 | −0.14 | −0.28 | 5.69 | 5.8 | 6.35 | 5.65 | −0.56 | −1.71 | −0.5 | −0.49 | −2.64 | −1.48 | −1.76 | −2.38 | −2.26 | −1.41 |
| Zfp831 | −3.7 | −3.53 | −3.7 | −2.25 | −3.49 | −2.12 | −2.4 | −3.09 | −1.6 | −1.64 | −0.11 | 3.58 | 3.54 | 3.6 | 3.57 | 3.61 | 3.61 |
| Zic1 | 3.69 | 3.86 | 3.86 | 0.22 | 0.16 | 0.03 | 0.16 | 4.28 | 4.27 | 4.39 | 4.54 | 0.41 | −2.13 | −1.29 | −2.62 | −2.51 | −3.27 |
| Zic2 | 3.14 | 3.59 | 3.58 | −1.09 | −0.43 | −0.86 | −0.16 | 3.98 | 4.06 | 4.26 | 4.25 | 0.64 | −0.97 | −1.67 | −1.77 | −1.64 | −2.38 |
| Zic3 | 2.22 | 1.69 | 2.53 | −1.63 | −1.9 | −0.15 | 0.61 | 4.43 | 4.87 | 4.86 | 5.26 | −1.54 | −0.9 | −1.68 | −1.6 | −1.51 | −1.78 |
| Zic4 | 2.90 | 2.82 | 2.69 | −0.22 | −0.88 | −0.71 | −0.58 | 4.55 | 5.33 | 5.14 | 6.17 | 0.33 | −1.94 | −0.68 | −2.78 | −2.04 | −2.38 |
| Zic5 | 3.13 | 3.07 | 2.89 | −0.69 | −1.11 | −1.26 | −0.48 | 4.67 | 4.61 | 3.90 | 5.00 | −0.37 | −1.50 | −1.28 | −1.16 | −1.03 | −2.18 |

The log 2 fold change in expression from the RNAseq results for the same 250 most variable genes genes as found in Table 12 for the RNAseq data from Mo, et al. (2015) Neuron 86, 1369-1384, which is hereby incorporated by reference herein in its entirety, compared the normalized expression for nuclei from all cell types analyzed are shown in Table 13. Negative values indicate reduced expression in the nuclei of the cell type compared to the normalized value across nuclei from all cell types analyzed, and a positive value indicates increased expression compared to the normalized value across nuclei from all cell types analyzed.

TABLE 13

Log2 fold expression change for samples from Mo et al.

| Gene | Log2 fold change in expression Cell Type | | | | | |
|---|---|---|---|---|---|---|
| | excitory | | pv | | vip | |
| 1700047M11Rik | −1.55 | −0.54 | −1.79 | −0.79 | 0.15 | −0.65 |
| 2410124H12Rik | −2.1 | −1.81 | −2.94 | −2.22 | −2.77 | −2.5 |

TABLE 13-continued

Log2 fold expression change for samples from Mo et al.

| Gene | excitory | | pv | | vip | |
|---|---|---|---|---|---|---|
| 3110039M20Rik | 2.25 | 2.33 | 2.14 | 2.12 | 2.95 | 2.91 |
| 8030451O07Rik | 0.55 | 0.2 | 2.73 | 2.43 | 3.99 | 4.02 |
| 9530059O14Rik | 1.87 | 1.95 | 0.43 | 0.28 | -0.42 | -0.44 |
| A230077H06Rik | 2.87 | 3 | 4.46 | 4.25 | 2.72 | 3.11 |
| A2m | -3.03 | -3.41 | -3.47 | -3.67 | -1.63 | -2.86 |
| A730036I17Rik | -2.27 | -1.17 | -2.42 | -0.67 | -1.79 | -1.9 |
| Aass | -1.4 | -1.26 | -0.49 | -0.48 | -1.58 | -1.7 |
| Acsm5 | -2.15 | -0.94 | -1.52 | -2.55 | -2.7 | -1.73 |
| Actbl2 | -1.88 | -1.1 | -2.04 | -2.27 | -0.65 | -0.54 |
| Adra2b | -0.47 | 0.01 | -1.21 | -1.51 | -2.39 | -2.18 |
| Afp | -1.6 | -1.7 | -1.76 | -1.98 | -0.84 | -1.9 |
| Aqp4 | -1.44 | -1.52 | -2.07 | -1.69 | -0.87 | -2.16 |
| Arhgap25 | 2.7 | 3.22 | -0.94 | -0.67 | -0.35 | -0.92 |
| Arx | 0.47 | 0.63 | 6.84 | 7.06 | 5.38 | 4.94 |
| Atp13a4 | -0.71 | -0.61 | -1.81 | -1.75 | -1.49 | -1.77 |
| Atp1a2 | -0.55 | -0.67 | -1.87 | -1.33 | -1.09 | -1.72 |
| Atp2a3 | -2.94 | -2.75 | -3.12 | -2.39 | -3.5 | -2.89 |
| B230209E15Rik | 1.33 | 1.39 | -0.16 | -0.51 | 0.18 | 0.2 |
| B3gnt5 | -2.52 | -2.5 | -3.09 | -2.99 | -1.87 | -2.35 |
| Barhl2 | -2.4 | -2.5 | -2.55 | -2.18 | -2.9 | -2.7 |
| Bcl11b | 1.92 | 2.13 | 2.69 | 2.58 | 0.02 | 0.25 |
| Btbd17 | -0.25 | -0.21 | -1.58 | -1.21 | -0.47 | -1.55 |
| Cacng3 | 3.77 | 3.73 | 1.36 | 1.38 | 1.59 | 1.56 |
| Camk1g | 3.21 | 3.59 | 2.52 | 2.74 | 4.19 | 3.92 |
| Camkv | 3.39 | 3.38 | 2.46 | 2.55 | 3.4 | 3.09 |
| Car8 | -2.99 | -2.81 | -3.22 | -3.15 | -3.52 | -3.66 |
| Casp12 | -0.62 | -1.12 | -3.05 | -3.24 | -3.36 | -3.18 |
| Casq2 | -3.26 | -2.99 | -2.53 | -3.5 | -0.23 | -0.05 |
| Cbln2 | 3.03 | 2.57 | 1.03 | 1.78 | 5.01 | 4.96 |
| Cbln3 | -3.54 | -3.1 | -2.71 | -3.19 | -2.88 | -3.59 |
| Cckbr | 2.87 | 2.83 | 1.64 | 1.86 | -0.47 | -0.93 |
| Cd70 | -2.38 | -2.48 | -1.39 | -2.13 | -0.67 | -1.3 |
| Cd9 | -2.19 | -2.41 | -2.41 | -1.95 | -1.68 | -1.9 |
| Cdc42ep1 | -1.11 | -1.45 | -0.82 | -0.32 | 0.72 | 0.36 |
| Cdh19 | -1.77 | -1.5 | -2.72 | -2.85 | -1.51 | -1.77 |
| Chrm1 | 3.21 | 3.34 | 1.78 | 2.23 | 2.31 | 2.16 |
| Chrm3 | 2.43 | 2.15 | 0.87 | 0.67 | 2.57 | 2.74 |
| Chsy3 | 2.23 | 2.06 | 0.81 | 0.5 | 1.95 | 2.06 |
| Clic6 | -2.36 | -2.19 | -1.78 | -1.44 | -2.77 | -2.37 |
| Cml5 | -0.17 | -0.68 | -1.98 | -1.58 | -0.84 | -1.22 |
| Cnpy1 | -3.04 | -3.38 | -2.61 | -2.55 | -3.69 | -3.03 |
| Cobl | 3.73 | 3.62 | -0.12 | 0.38 | 1.12 | 1.12 |
| Col1a2 | -1.89 | -0.89 | -1.68 | -1.49 | -2.02 | -1.23 |
| Col4a5 | -2.02 | -2.07 | -1.84 | -1.8 | -2.62 | -2.78 |
| Col6a1 | 3.87 | 3.75 | 1.06 | 1.31 | 0.45 | -0.4 |
| Colgalt2 | 0.5 | 0.59 | -1.11 | -1.05 | -0.3 | -0.21 |
| Corin | -1.98 | -1.88 | 0.48 | 0.72 | -0.95 | -0.89 |
| Coro6 | 2.58 | 2.79 | 4.87 | 4.38 | 1.25 | 0.87 |
| Cpne7 | 2.53 | 2.66 | -0.03 | 0.8 | 5.44 | 5.37 |
| Crym | 3.08 | 3.32 | -0.27 | 0.26 | 0.18 | -0.11 |
| Csta1 | -1.12 | -1.19 | -1.13 | -1.65 | -2.13 | -1.37 |
| Ctxn3 | -0.15 | -0.84 | -2.96 | -2.03 | -3.07 | -2.27 |
| Cxcl14 | -0.11 | -0.02 | -1.39 | -0.57 | 5.05 | 4.85 |
| Cxcl5 | -1.98 | -0.77 | -1.34 | -0.62 | -1.1 | -1.54 |
| Cxcr4 | -1.44 | -1.57 | -1.64 | -1.53 | -0.58 | -0.33 |
| Cyp27a1 | -3.04 | -2.28 | -0.55 | 0.08 | -0.91 | -1.05 |
| Cyp2j9 | -2.25 | -1.8 | -2.55 | -1.94 | -1.36 | -1.45 |
| D430019H16Rik | 3.56 | 3.29 | 0.92 | 1.4 | 1.33 | 1.04 |
| Ddn | 3.31 | 3.09 | 2.4 | 2.98 | 1.96 | 1.71 |
| Ddx3y | 1.23 | 1.22 | 1.07 | 1.1 | 1.58 | 1.5 |
| Dlgap2 | 3.16 | 2.89 | 3.64 | 2.96 | 2.07 | 2.22 |
| Dlx4os | 0.17 | -0.48 | -3 | -2.71 | -2.87 | -3.13 |
| Dlx6os1 | -0.46 | 0.44 | 4.73 | 4.42 | 6.7 | 6.77 |
| Dmp1 | -1.85 | -1.58 | -1.85 | -1.43 | -1.01 | -0.57 |
| E030003E18Rik | 0.21 | 0.33 | -2.09 | -1.95 | -1.84 | -2.53 |
| Ebf1 | -2.91 | -2.96 | -2.72 | -2.66 | -3.1 | -2.94 |
| Ebf2 | -2.38 | -1.82 | -3.04 | -2.75 | -2.6 | -2.93 |
| Ebf3 | -2.83 | -1.8 | -2.36 | -2.55 | -0.89 | -0.91 |
| Ednrb | -1.79 | -1.86 | -2.2 | -1.51 | -1.71 | -2.36 |
| Egfr | -1.67 | -1.58 | -1.56 | -1.46 | 4.41 | 4.52 |
| Egr3 | 3.98 | 4.13 | 0.71 | 1.79 | 2.04 | 1.88 |
| Eif2s3y | 1.45 | 1.44 | 1.27 | 1.27 | 1.85 | 1.87 |
| Elfn1 | 1.82 | 1.65 | 1.64 | 1.86 | 5.5 | 5.48 |

TABLE 13-continued

Log2 fold expression change for samples from Mo et al.

| Gene | excitory | | pv | | vip | |
|---|---|---|---|---|---|---|
| Emp2 | -1.3 | -1.25 | -2.59 | -1.65 | 0.9 | 0.99 |
| En2 | -2.9 | -2.99 | -2.52 | -2.78 | -2.4 | -3.17 |
| Enc1 | 4.03 | 4 | 1.1 | 2.17 | 2.18 | 2.03 |
| Etnppl | -1.15 | -0.87 | -1.83 | -1.12 | -1.62 | -1.93 |
| Eva1a | -1.01 | -1.21 | -0.68 | -0.42 | -0.99 | -1.51 |
| F3 | -1.74 | -1.51 | -1.86 | -1.8 | -0.18 | -0.28 |
| Fam107b | -2.55 | -2.31 | -2.76 | -3.05 | 0.1 | 0.05 |
| Fam19a1 | 3.43 | 3.16 | 1.1 | 1.15 | 0.23 | -0.1 |
| Fat2 | -3.2 | -3.01 | -2.49 | -3.17 | -3.82 | -3.87 |
| Fbln2 | 2.93 | 2.65 | -1.34 | -0.38 | 5.38 | 5.19 |
| Fezf2 | 3.33 | 3.36 | 1.43 | 2.33 | 0.68 | -0.33 |
| Fgd3 | -0.42 | -0.95 | 2.86 | 2.6 | 1.97 | 2.16 |
| Flrt2 | 1.94 | 1.63 | 1.09 | 1.01 | 2.16 | 2.01 |
| Folh1 | -1.89 | -1.7 | -2.97 | -1.98 | -1.59 | -2.28 |
| Foxg1 | 2.89 | 2.84 | 2.31 | 2.54 | 3.13 | 2.75 |
| Frem1 | -0.12 | -0.37 | -2.75 | -2.49 | 2.66 | 3.01 |
| Gabra6 | -3.87 | -3.92 | -2.97 | -3.68 | -3.66 | -4.02 |
| Galnt14 | 2.28 | 2.12 | 1.65 | 1.39 | 4.03 | 4.18 |
| Gas1 | -1.79 | -1.93 | -1.11 | -0.74 | 0.2 | 0.03 |
| Gda | 2.69 | 2.48 | -0.31 | 0.12 | 0.47 | 0.5 |
| Gdf10 | -3.14 | -2.66 | -2.37 | -1.6 | -1.27 | -1.58 |
| Gja1 | -2.37 | -2.43 | -3.18 | -2.52 | -1.99 | -2.6 |
| Gjb6 | -0.65 | -0.73 | -1.93 | -1.25 | -1.27 | -1.59 |
| Gjc3 | -2.16 | -2.35 | -2.54 | -1.87 | -1.67 | -2 |
| Gli1 | -0.64 | -0.22 | -1.09 | -0.96 | 1.24 | 1.1 |
| Gli3 | -0.55 | -0.68 | -1.22 | -1.12 | -0.86 | -1.31 |
| Glt25d2 | 0.16 | 0.44 | -0.91 | -1.05 | -1.77 | -2.1 |
| Gm11549 | 3.13 | 2.79 | -0.02 | 0.86 | 0.61 | 0.51 |
| Gm266 | -1 | -0.38 | -2.63 | -1.01 | -0.29 | -1.77 |
| Gm5083 | -2.83 | -1.37 | -2.99 | -3.2 | -1.07 | -1.69 |
| Gm5089 | -2.04 | -2.39 | -2.26 | -1.87 | -1.68 | -2.2 |
| Gm5468 | 2.74 | 2.82 | -0.73 | -0.19 | 2.09 | 2.4 |
| Gm5607 | -1.23 | -0.86 | 3.22 | 3.17 | 3.9 | 3.88 |
| Gm8179 | 3.3 | 2.99 | 1.03 | 0.95 | 0.65 | 0.62 |
| Gpr37l1 | -1.46 | -2.36 | -2.23 | -1.6 | -1.43 | -1.9 |
| Grik1 | -0.35 | -0.61 | 1.85 | 1.62 | 1.93 | 1.96 |
| Grm5 | 1.79 | 1.66 | 1.57 | 1.26 | 1.18 | 1.33 |
| Hepacam | -0.74 | -0.72 | -1.96 | -1.19 | -0.51 | -0.67 |
| Hes3 | -1.2 | -1.77 | 1.31 | 1.24 | -1.84 | -2.99 |
| Hs3st2 | 2.67 | 2.81 | -0.13 | 0.13 | 2.21 | 2.46 |
| Hs3st4 | 3.39 | 3.25 | 0.23 | 0.02 | 1.2 | 1.25 |
| Htr2a | 3.38 | 3.04 | 3.1 | 2.81 | 1.75 | 2.05 |
| Icam5 | 4.24 | 3.93 | 1.32 | 1.48 | 1.88 | 1.31 |
| Icosl | -1.4 | -1.7 | -2.75 | -1.86 | 1.32 | 1.61 |
| Il22 | -1.15 | -0.79 | -2.18 | -1.68 | -2.55 | -1.57 |
| Iltifb | -1.85 | -1.98 | -2.72 | -2.95 | -3.08 | -2.87 |
| Irx1 | -1.82 | -1.92 | -1.98 | -2.21 | -1.61 | -2.13 |
| Irx2 | -1.48 | -1.57 | -1.62 | -1.84 | -1.98 | -1.77 |
| Irx5 | -1.45 | -1.54 | -1.59 | -1.81 | -1.94 | -1.73 |
| Itih3 | -0.87 | -0.28 | -1.83 | -1.44 | -0.82 | -0.91 |
| Itpripl2 | -1.48 | -2.29 | -1.99 | -1.83 | -0.35 | -0.13 |
| Kank1 | -1.92 | -1.89 | -1.86 | -1.72 | -1.45 | -2.03 |
| Kcnc2 | 2.07 | 1.68 | 4.46 | 3.93 | 3.3 | 3.33 |
| Kcnf1 | 2.95 | 2.59 | 0.17 | 1.32 | 2.64 | 2.99 |
| Kcnj10 | -1.23 | -1.38 | -2.08 | -0.94 | -1.29 | -1.61 |
| Kcnj16 | -1.53 | -1.21 | -3.07 | -2.17 | -1.67 | -2.18 |
| Kcnj4 | 2.9 | 2.85 | 2.26 | 2.28 | 0.77 | 0.33 |
| Kcnq5 | 2.85 | 2.57 | 1.39 | 1.16 | 2.66 | 2.86 |
| Kcnt2 | 2.7 | 2.61 | -0.85 | -0.71 | 4.01 | 3.99 |
| Kcnv1 | 3.49 | 3.54 | -0.42 | 0.33 | 0.31 | 0.23 |
| Kctd12b | -0.72 | -1.44 | -1.95 | -1.56 | -1.55 | -1.44 |
| Kdm5d | 1.72 | 1.82 | 1.57 | 1.35 | 1.89 | 2.16 |
| Lama2 | -0.8 | -0.7 | -2.22 | -1.89 | -0.43 | -0.44 |
| Lamp5 | 3.37 | 3.22 | 0.63 | 1.44 | 0.64 | 0.37 |
| Lcat | -0.95 | -1.21 | -1.83 | -1.76 | -0.65 | -0.54 |
| Ldb2 | 2.5 | 2.23 | -0.07 | 0.08 | 1.35 | 1.37 |
| Lfng | -0.69 | -1.29 | -1.26 | -1.43 | 0.11 | -0.67 |
| Lgr6 | -0.68 | -2.11 | -1.18 | -1.66 | -1.57 | -1.85 |
| Lhx1 | -2.74 | -2.82 | -2.87 | -1.8 | -3.16 | -2.99 |
| Lhx1os | -3.14 | -3.24 | -2.34 | -3.08 | -3.63 | -3.78 |
| Lhx5 | -2.82 | -2.36 | -2.97 | -3.17 | -3.28 | -2.6 |
| Linc-md1 | -2.53 | -2.63 | -1 | -1.37 | -2.49 | -2.2 |
| Lrrc7 | 2.37 | 2.25 | 0.77 | 0.71 | 1.88 | 1.94 |

TABLE 13-continued

Log2 fold expression change for samples from Mo et al.

| Gene | excitory | | pv | | vip | |
|---|---|---|---|---|---|---|
| Lyzl4 | 2.91 | 2.79 | -0.11 | 0.31 | 1.14 | 1.21 |
| Mal2 | 2.19 | 2.26 | 0.34 | 0.83 | 1.73 | 1.96 |
| Megf10 | -1.99 | -1.66 | -2.15 | -2.03 | 0.13 | 0.25 |
| Meis2 | 2.97 | 2.92 | -0.48 | -0.19 | 0.08 | -0.45 |
| Mertk | -0.61 | -0.46 | -0.12 | -0.23 | -0.27 | -0.87 |
| Metrn | -1.16 | -2.02 | -0.87 | -0.37 | -0.5 | -0.23 |
| Mgst1 | -1.09 | -2.19 | -2.88 | -1.51 | -1.44 | -1.79 |
| Miat | 4.15 | 4.18 | 2.49 | 2.71 | 2.96 | 3.07 |
| Mlc1 | -0.53 | -1.05 | -1.47 | -0.73 | -0.57 | -0.94 |
| Mmp14 | -0.89 | -0.84 | -1.27 | -1.41 | -0.8 | -1.5 |
| Mpped1 | 3.44 | 3.48 | 3.55 | 3.37 | 0.53 | 0.24 |
| Msx2 | -1.96 | -0.29 | -3.07 | -2.21 | -1.67 | -2.7 |
| Mybpc1 | -1.5 | -1.44 | 2.09 | 1.86 | 2.53 | 2.86 |
| Myh6 | -0.8 | -0.52 | -1.05 | -1.3 | 0.38 | -0.17 |
| Neto1 | 2.36 | 2.38 | 1.78 | 1.74 | 1.56 | 1.58 |
| Nid1 | -1.55 | -1.62 | -2.58 | -2.11 | -1.46 | -1.33 |
| Nkx2-2 | -1.03 | -1.17 | -2.41 | -1.59 | -0.33 | -1.47 |
| Npr3 | 2.74 | 2.64 | 0.35 | 0.7 | -0.77 | -0.91 |
| Npy1r | 2.63 | 2.67 | -1.06 | -0.81 | 4.2 | 4.21 |
| Nrgn | 4.32 | 4 | 2.17 | 3.24 | 2.03 | 1.74 |
| Nrk | -2.45 | -2.76 | -3.32 | -2.3 | -2.03 | -2.27 |
| Ntsr2 | 0.57 | 0.27 | -0.99 | -0.45 | 1.23 | 0.49 |
| Nup62cl | -1.79 | -1.48 | -2.66 | -1.61 | -2.47 | -2.81 |
| Oprd1 | 2.53 | 2.6 | 4.79 | 4.91 | -0.04 | -0.44 |
| P2ry1 | -2.52 | -2.64 | -1.99 | -1.83 | 0.1 | 0.26 |
| Paqr6 | -0.04 | -0.53 | -0.91 | -0.91 | -0.65 | -1.51 |
| Pax3 | -2.45 | -3.57 | -2.89 | -3.43 | -3.12 | -2.85 |
| Pcsk6 | -2.69 | -2.66 | -2.58 | -2.48 | -1.04 | -0.88 |
| Pde1a | 3 | 2.93 | 0.01 | 0.2 | 0.43 | 0.18 |
| Pde5a | -1.7 | -1.76 | 1.77 | 1.47 | 1.63 | 1.52 |
| Pdgfd | -2.27 | -2.19 | -2.06 | -1.84 | -1.86 | -2.4 |
| Pdzph1 | 0.02 | -0.09 | -1.32 | -1.82 | -0.29 | -0.46 |
| Pih1h3b | -1.77 | -1.38 | -2.39 | -2.67 | -1.86 | -1.92 |
| Pkp3 | -0.97 | -1.98 | -2.04 | -2.27 | -1.24 | -2.19 |
| Pla2g7 | -1.9 | -1.7 | 0.47 | 0.44 | -1.36 | -1.43 |
| Plekhd1 | -2.75 | -2.67 | 0.74 | 0.71 | 0.1 | 0.44 |
| Plekho2 | -1.38 | -0.95 | -1.77 | -1.51 | -0.85 | -1.57 |
| Plpp3 | -0.92 | -1.05 | -2.19 | -1.51 | 0.1 | 0.01 |
| Plscr1 | -1.4 | -1.54 | -2.9 | -2.23 | -1.28 | -2.12 |
| Plscr4 | -1.49 | -1.36 | -2.61 | -3.15 | -2.05 | -1.93 |
| Ppplr17 | -3.13 | -3.23 | -3.02 | -3.26 | -2.83 | -2.55 |
| Prkag3 | -2.17 | -1.49 | -2.33 | -1.88 | -2.7 | -1.32 |
| Procr | -1.84 | -1.94 | -1.15 | -2.23 | -2.37 | -2.15 |
| Prr5 | -0.29 | -0.51 | 1.61 | 1.8 | 3.03 | 2.79 |
| Ptk2b | 3.11 | 3.28 | -0.18 | 0.46 | 0.58 | 0.71 |
| Ptpn5 | 3.31 | 3.42 | 2.33 | 2.27 | 3.27 | 3.2 |
| Ptprz1 | -1.89 | -1.82 | -1.02 | -1.04 | 2.1 | 2.17 |
| Rab11fip1 | -0.77 | -0.62 | -1.45 | -1.57 | -1.99 | -1.1 |
| Rab27b | 1.85 | 1.81 | 2.21 | 2.04 | 2.41 | 2.76 |
| Robo3 | 4.83 | 4.38 | 1.63 | 1.77 | 1 | 0.53 |
| Rtn4rl2 | 4.58 | 4.69 | 1.81 | 2.13 | 0.92 | -0.05 |
| Rxfp1 | 2.73 | 2.92 | -0.47 | -0.3 | 3.88 | 3.93 |
| S1pr1 | -1.71 | -1.51 | -2.07 | -1.47 | -1.95 | -2.21 |
| Scube1 | 4.64 | 4.2 | 0.61 | 1.14 | 0.81 | 0.16 |
| Sdc4 | -2.04 | -1.87 | -2.27 | -1.92 | -1.61 | -2.01 |
| Serpinh1 | -0.7 | -1.89 | -1.69 | -1.63 | -1.24 | -1.34 |
| Skor2 | -2.92 | -3.02 | -3.08 | -1.92 | -2.6 | -1.8 |
| Slc14a1 | -2.05 | -1.71 | -2.28 | -1.57 | -1.45 | -2.1 |
| Slc1a3 | -1.58 | -1.6 | -2.56 | -1.97 | -1.73 | -2 |
| Slc24a4 | 3.71 | 3.57 | 0.47 | 0.76 | 0.2 | -0.29 |
| Slc2a10 | -1.27 | -2.22 | -2.56 | -1.88 | -2.32 | -2.31 |
| Slc2a4 | -0.76 | -1.4 | -2.27 | -0.23 | -2.64 | -1.69 |
| Slc30a3 | 4.31 | 4.11 | 3.33 | 3.22 | 2.6 | 2.24 |
| Slc39a12 | -0.99 | -0.93 | -2.54 | -2.71 | -1.76 | -2.35 |
| Slc6a7 | 2.47 | 2.61 | 2.6 | 2.46 | 2.44 | 2.23 |
| Slc7a10 | 0.22 | 0.02 | -0.2 | -0.32 | 0.15 | -0.03 |
| Slc9a3 | -0.81 | -0.85 | -1.76 | -1.65 | -0.28 | -0.1 |
| Slco4c1 | 1.46 | 1.36 | 0.6 | 0.52 | 1.18 | 1.15 |
| Smpx | -1.46 | -2.34 | -2.5 | -1.83 | -2.05 | -2.43 |
| Sod3 | -0.49 | -0.8 | -1.47 | -0.97 | -0.22 | -0.39 |
| Sparc | -2.02 | -2.03 | -2.38 | -1.9 | -2.36 | -2.22 |
| Stac | -0.87 | -0.78 | -2.81 | -2.66 | -0.11 | 0.35 |
| Stk17b | -2.18 | -2.24 | -3.03 | -2.74 | -2.5 | -2.91 |

TABLE 13-continued

Log2 fold expression change for samples from Mo et al.

| Gene | excitory | | pv | | vip | |
|---|---|---|---|---|---|---|
| Stk32a | -1.46 | -1.64 | -2.09 | -1.96 | 1.31 | 1.54 |
| Sycp1 | -0.94 | -1.02 | -1.13 | -3.46 | -1.7 | -1.64 |
| Syt10 | -0.21 | -0.27 | -3.16 | -3.19 | 0.3 | 0.37 |
| Tbr1 | 3 | 2.87 | 0.12 | 1.06 | 0.69 | 0.23 |
| Tex36 | -1.27 | -2.21 | -2.27 | -2.5 | -1.98 | -2.42 |
| Tlcd1 | -0.48 | -0.34 | -0.8 | -0.58 | -0.51 | -0.57 |
| Tlr3 | -2.12 | -1.89 | -1.6 | -1.02 | -1.33 | -1.21 |
| Tmem132b | 2.3 | 2.26 | 1.95 | 1.71 | 2.3 | 2.42 |
| Tmem179 | 2.79 | 2.66 | 3.05 | 3.18 | 2.95 | 2.94 |
| Tmem200a | 2.1 | 1.96 | 0.48 | 0.53 | 2.86 | 3 |
| Tnc | -0.21 | -0.44 | -1.75 | -1.27 | 0.4 | 0.12 |
| Tox3 | 2.2 | 2.09 | 4.44 | 4.03 | 1.03 | 0.97 |
| Tril | -1.53 | -1.56 | -1.81 | -0.79 | -1.17 | -1.32 |
| Trim30a | -2.56 | -2.98 | -3.04 | -2.05 | -2.17 | -3.19 |
| Trp53cor1 | -0.97 | -1.47 | -1.38 | -0.8 | -0.75 | -1.32 |
| Ttpa | -1.41 | -1.3 | 0.19 | 0.37 | -1.18 | -0.98 |
| Uty | 1.01 | 0.9 | 1.21 | 0.89 | 1.15 | 1.16 |
| Vip | -0.3 | 0.73 | 0.14 | 0.56 | 8.04 | 7.9 |
| Vsig2 | 3.35 | 3.37 | 0.35 | 1.05 | -0.17 | -0.26 |
| Vstm2b | 3.08 | 3.17 | 4.4 | 4.34 | 2.82 | 3.19 |
| Wif1 | -2.86 | -2.58 | 0.94 | 1 | -2.51 | -1.82 |
| Zfp385c | -0.62 | -1.68 | -0.25 | -0.27 | -1.84 | -1.81 |
| Zfp831 | 3.08 | 2.85 | -0.08 | 0.42 | 0.1 | -0.25 |
| Zic1 | -3.04 | -3.14 | -3.06 | -2.85 | -2.64 | -3.33 |
| Zic2 | -2.61 | -3.19 | -2.49 | -2.46 | -2.64 | -3.14 |
| Zic3 | -1.74 | -2.53 | -1.94 | -2.8 | -2.04 | -2.73 |
| Zic4 | -2.61 | -2.94 | -3.26 | -2.9 | -3.06 | -2.97 |
| Zic5 | -2.83 | -2.92 | -1.81 | -2.7 | -2.85 | -3.1 |
| | 1.88 | 1.82 | 0.48 | 0.18 | 1.91 | 1.98 |

Additional cell-type specific nuclear transcripts were identified from genes that were observed to have increased expression: Alpha-2-Macroglobulin (A2m) for Sept4-positive cells (Bergmann glia), Pde1a and Colgalt2 for Colgalt2-positive cells (corticopontine pyramidal), Pde1a and Heparan Sulfate-Glucosamine 3-Sulfotransferase 4 (Hs3st4) for Excit-positive cells (excitatory neurons), Pde1a and Hs3st4 for Ntsr1-positive cells (corticothalamic pyramidal), Aristaless Related Homeobox (Arx) and Parvalbumin (Pvalb) for PV-positive cells (parvalbumin interneurons), Vasoactive Intestinal Peptide (Vip) for VIP-positive cells (VIP interneurons), Solute Carrier Family 9 Member A3 (S1c9a3) for Pcp2-positive cells (Purkinje), and Grin2c for NeuroD1-positive cells (granule). Results in the Examples herein provide evidence that nuclear RNA is sufficient to define cell types.

Hierarchical clustering was performed using the genes above across these eight cell types to determine whether nuclear RNA profiles can group the samples based on expected biology. Clustering occurred not only by cell type but also by groups of related cell types. For example, the two classes of interneurons (VIP and PV) clustered with each other, while three types of pyramidal cells (corticopontine and corticothalamic from the data herein and all excitatory from Mo et. al.) clustered together. The robustness of this clustering, even across samples prepared using different methods and from different labs, indicates the utility of nuclear RNA profiles for specifying cellular identity, and for measuring the relatedness of different types of cells.

Example 5

Developing a Method for Isolating Specific Nuclei From Wild-Type Animals

Previous cell profiling techniques required breeding a disease model in a transgenic animal. Some disease models are difficult to breed, and a study of aging would require maintaining specific transgenic strains for years. Such methods were not adaptable to organisms where transgenesis is difficult or unethical, such as humans. Therefore, there is a need to develop a generalizable method that enable molecular studies of defined cell types in wild-type animals.

Figure 2A:
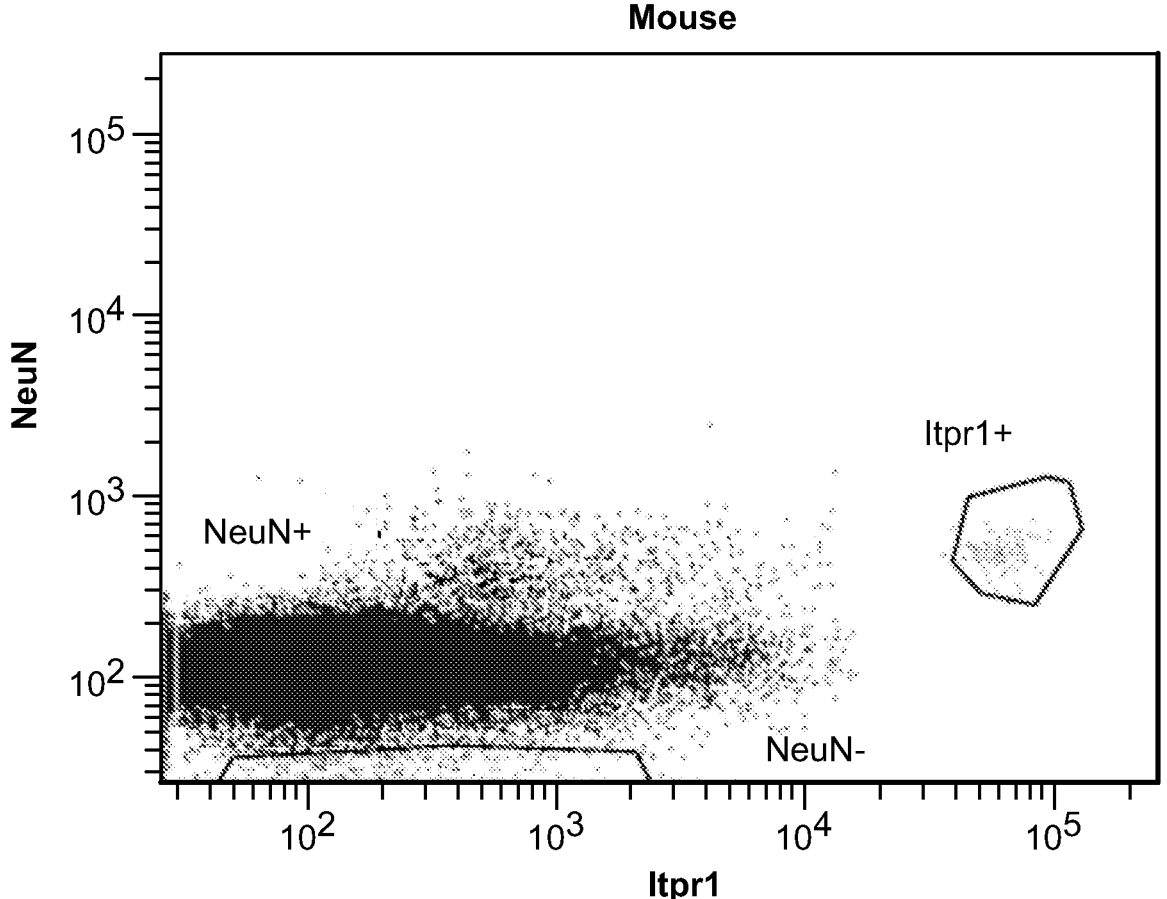
FIG. 2A shows flow cytometry sorting results for 3 cell types from the cerebellum using Itpr1 and NeuN. A combination of Itpr1 and NeuN was used to isolate 3 populations: Purkinje cells, granules cells, and glia. Itpr1 is on the x-axis, and NeuN is on the y-axis. The Itpr1+ population was the nuclei of Purkinje cells, and the NeuN+ population was the nuclei of glia. The NeuN+/Itpr1-nuclei (largest group) represent granule cells.

FIG. 2A shows a sort of nuclei from mouse cerebellum using the strategy described in Example 2. Itpr1 is on the x-axis, and NeuN is on the y-axis. The Itpr1+ population was the nuclei of Purkinje cells, and the NeuN+ population was the nuclei of glia. The NeuN+/Itpr1-nuclei (largest group) represent granule cells.

Figure 2B:
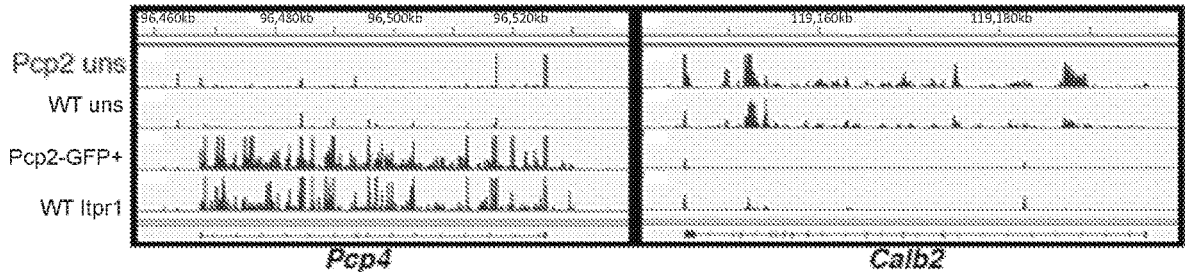
FIG. 2B shows gene expression profiling from RNAseq data comparing sorting of Purkinje nuclear RNA from transgenic animals (GFP sort) to Itpr1+ nuclei. Pcp4 is a Purkinje marker (enriched in sorted Purkinje nuclei compared to cerebellar unsorted nuclei), and Calb2 is a granule cell marker (enriched in unsorted compared to Purkinje).

FIG. 2B shows gene expression profiling from RNAseq data comparing the groups of Purkinje nuclear RNA from transgenic animals from a GFP sort to Itpr1+ nuclei sorted with the cellular profiling technique described herein. Pcp4 is a Purkinje marker, which was observed to be enriched in the Pcp2-GFP+ nuclei and the wildtype (WT) Itpr1+ nuclei compared to cerebellar unsorted nuclei (Pcp2 uns and WT uns). Calb2 is a granule cell marker, which was observed to be enriched in the unsorted samples (Pcp2 unsorted and WT unsorted) compared to the sorted Purkinje nuclei (Pcp2-GFP+ or WT Itpr1+).

Table 14 provides Pearson correlations showing that the number of Purkinje nuclei from GFP and antibody sorts are highly correlated (R=0.99).

TABLE 14

| | Pearson correlations | | | |
| --- | --- | --- | --- | --- |
| Driver | Pcp2 uns | Pcp2– GFP+ | WT uns | WT Itpr+ |
| Pcp2 uns | 1.00 | 0.93 | 0.99 | 0.95 |
| Pcp2– GFP+ | | 1.00 | 0.92 | 0.99 |
| WT uns | | | 1.00 | 0.94 |
| WT Itpr+ | | | | 1.00 |

Antibodies specific to these factors will result in an increase in the number of cell types expressing these factors to be isolated.

Dopaminergic neurons in the midbrain were also stained by a combination of two antibodies: one against transcription factor FoxA1 and the other was against the membrane localized dopamine transporter (DAT). Staining against FoxA1 was observed in the nucleus of dopaminergic neurons. Staining against DAT was observed primarily in axons, although at high magnification, it was also observed in cell bodies, likely being synthesized in the endoplasmic reticulum.

Figure 3A:
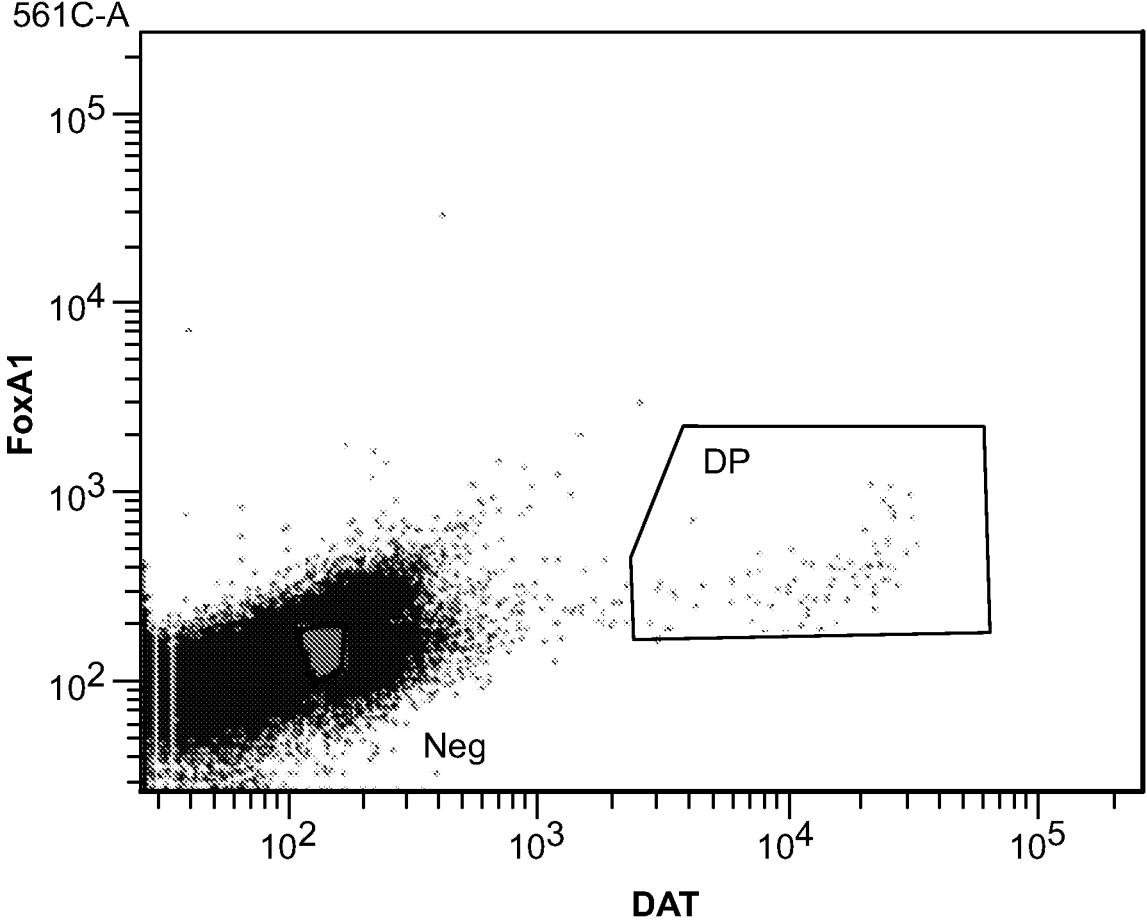
FIG. 3A shows flow cytometry sorting results from nuclei staining and sorting for dopaminergic neurons nuclei.
Figure 3B:
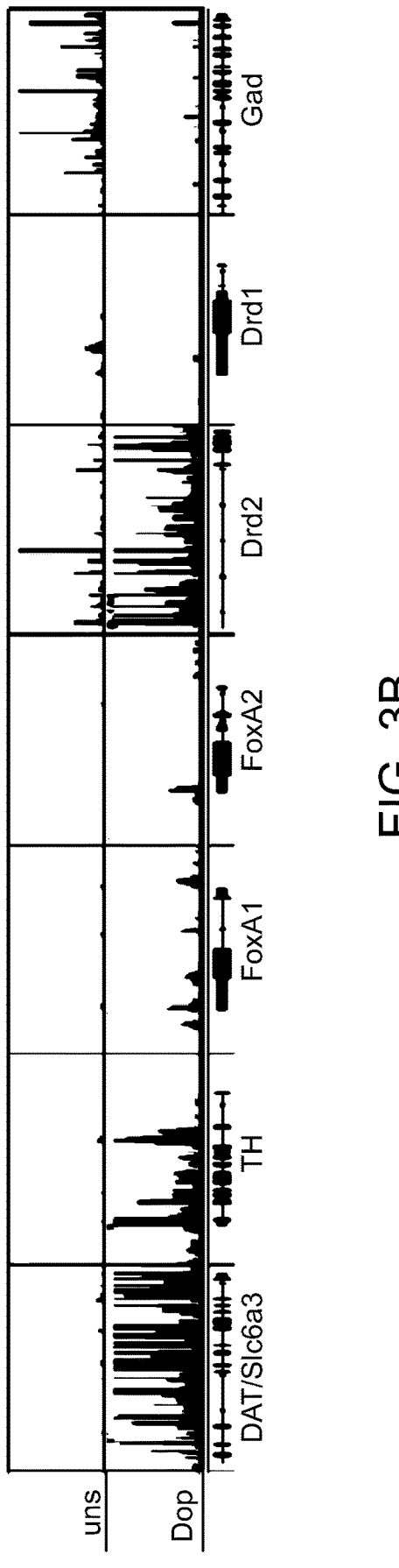
FIG. 3B compares RNAseq tracks from unsorted midbrain nuclei and sorted dopaminergic nuclei.

Nuclei staining and sorting for dopaminergic neuronal nuclei by flow cytometry is shown in FIG. 3A. The double positive (DP) population (positive for FoxA1 and DAT) was isolated for RNAseq analysis. FIG. 3B compares RNAseq tracks from unsorted midbrain nuclei and sorted dopaminergic nuclei. The dopaminergic nuclei were observed to be positive for known markers—Solute Carrier Family 6 Member 3 (DAT, also known as Slc6a3), Tyrosine Hydroxylase (TH), Forkhead Box A1 (FoxA1), Forkhead Box A2 (FoxA2), and Dopamine Receptor D2 (Drd2). Meanwhile, genes that are known to not be expressed in these neurons (Drd1 and Glutamate Decarboxylase (Gad)) were observed to be depleted in the unsorted population. Therefore, dopaminergic neurons were observed to be successfully isolated in mice. This strategy can also be used for human samples.

Wolframin ER Transmembrane Glycoprotein (Wfs1) and B-Cell CLL/Lymphoma 11B (Ctip2, also known as Bcl11 b)

were observed from staining to be putative markers for cortical cell types layer 2/3 pyramidal neurons and layer 5 and 6 pyramidal neurons, respectively. Another putative marker for cortical cell types observed from staining was ETS Variant 1 (Etv1, also known as ER81), which labels layer 5 pyramidal neurons. Etv1 has been previously observed to label both corticostriatal neurons, cortocopontine neurons, and potential others in layer 5 of the cortex. Two putative markers for the hypocampus were also identified by staining: Wfs1 for Carbonic Anhydrase 1 (CA1)-positive neurons and Purkinje Cell Protein 4 (Pcp4) for Carbonic Anhydrase 1 (CA2)-positive dentate gyms.

Putative markers for brainstem motor neurons were observed to be Solute Carrier Family 18 Member A3 (VaChT, also known as Slc18a3), Chondrolectin (Chodl), and EsrrB. Antibodies specific for the 3 genes VaChT, Chodl, and ErrB were observed by in situ hybridization to label this population of neurons in the brain stem. The Allen Brain Atlas gene expression database was used as reference. VaChT and ErrB label the motor neurons specifically, and Chodl labels everything except for these neurons. The antibody specific to Chodl may be replaced with one that directly labels the brainstem motor neurons.

Example 6

Applying Antibody-Sorting Methods to Nuclei From Wild-Type Mice

To determine whether the cellular profiling technique described herein could be used productively for cell type specific studies in wild-type animals, the cellular profiling technique described herein was applied to processed tissue from the mouse cerebellum, a structure that is composed of several classically defined neuronal and glial cell types that exhibit unique morphology and distribution.

Candidate antibodies specificities were chosen from expression profiles from each cell type generated from data obtained from transgenic animals developed for use in the TRAP method expressing an EGFP/L10a fusion protein (Dougherty, et al. (2010) Nucleic Acids Res 38, 4218-4230 and Doyle, et al. (2008) Cell 135, 749-762, each of which is hereby incorporated by reference herein in its entirety). Data were collected from three neuronal cell types (granule, Purkinje, and basket) and two glial cell types (astrocytes and oligodendrocytes) in the cerebellum of wild-type mice.

Immunofluorescence staining was performed on the five distinct cell types in the cerebellum using a similar strategy to that applied to the cells from transgenic animals. The specificities of antibodies used for each cell type to confirm differences among the nuclei were NeuN for granule cells, Itpr1 for Purkinje cells, Sorcs3 for basket cells, Gfap labels for the cell bodies and process of astrocytes, and MOG labels for the cell bodies and process of oligodendrocytes.

To sort, a combination of at least two antibodies was used: NeuN (a splicing factor localized at euchromatin inside the nucleus), which labels neuronal nuclei, and cell-type specific antibodies: Itpr1, an endoplasmic reticulum membrane protein localized at the nuclear membrane, and basket cell marker Sorcs3 and astrocyte marker Eeat1 (also referred to as Glast), which are two cellular membrane proteins labeled in the nuclear membrane. Antibodies against the oligodendrocyte marker and transcription factor Olig2 showed labeling in euchromatin.

In cerebellar tissue, NeuN has been known in the art to label the nuclei of granule neurons, but not Purkinje and basket neurons, or glia. Immunofluorescence results on tissue sections using NeuN confirmed this result. However, staining of nuclei using NeuN revealed that while basket cells, astrocytes, and oligodendrocytes nuclei have lower levels of NeuN as expected, Purkinje nuclei unexpectedly were observed to have elevated levels. This is not due to spectral overlap from the Purkinje specific marker because confocal imaging revealed bright expression of NeuN in Purkinje nuclei in euchromatin—the expected distribution for a splicing factor. Therefore, the exposure of NeuN epitopes was observed to be different in isolated nuclei and tissue sections.

To isolate nuclei from oligodendrocytes, an antibody against the transcription factor Olig2 was used. Immunofluorescence was used to confirm the effectiveness of these antibodies. To isolate nuclei from granule cells, NeuN was used in addition to a combination of Itpr1, Sorcs3, and Olig2 to remove contaminating nuclei from other cell types. Nuclei were counterstained with DAPI, which is also a marker for heterochromatin. FACS results are shown in Table 15.

TABLE 15

FACS results for samples from wild-type mice

| Cell Type | Population | Percentage of Population |
|---|---|---|
| Granule | Itpr1− Olig2− Sorcs3− NeuN+ | 90.5% |

TABLE 15-continued

FACS results for samples from wild-type mice

| Cell Type | Population | Percentage of Population |
|---|---|---|
| Purkinje | Itpr1+ NeuN+ | 0.1% |
| Basket | Itpr1+ med NeuN− | 3.03% |
| Astrocytes | Sorcs3+ med NeuN− | 1.94% |
| Oligodendrocytes | Sorcs3− NeuN− | 1.95% |

Therefore, the sorting strategy used for isolation of nuclei in cell types from the transgenic animals developed for use with the TRAP method was observed to also be effective in nuclei from the same cell types in wild-type mice.

Example 7

Correlation of Results From Different Cell Sorting Methods

Results were analyzed at a genome-wide level by computing the pairwise Pearson's correlation coefficient (r) of normalized gene expression as shown in Table 16 among the GFP+ sorted nuclei samples from animals developed for use in the TRAP method and nuclei samples sorted using the cellular profiling technique described herein. ".g" samples were the GFP+ sorted samples from animals developed for use with the TRAP method, and ".a" samples sorted by the cellular profiling technique described herein.

TABLE 16

Pearson's correlation values

| | Granule.g | | | Purkinje.g | | | | Bglia.g | | | | Granule.a | | |
|---|---|---|---|---|---|---|---|---|---|---|---|---|---|---|
| Granule.g | 1.00 | 0.97 | 0.98 | 0.85 | 0.85 | 0.86 | 0.86 | 0.79 | 0.80 | 0.80 | 0.79 | 0.95 | 0.96 | 0.98 |
| | 0.97 | 1.00 | 0.97 | 0.84 | 0.84 | 0.84 | 0.85 | 0.78 | 0.79 | 0.79 | 0.79 | 0.95 | 0.95 | 0.97 |
| | 0.98 | 0.97 | 1.00 | 0.83 | 0.84 | 0.84 | 0.85 | 0.78 | 0.79 | 0.79 | 0.79 | 0.95 | 0.95 | 0.97 |
| Purkinje.g | 0.85 | 0.84 | 0.83 | 1.00 | 0.98 | 0.98 | 0.99 | 0.78 | 0.79 | 0.79 | 0.78 | 0.85 | 0.85 | 0.85 |
| | 0.85 | 0.84 | 0.84 | 0.98 | 1.00 | 0.99 | 0.99 | 0.79 | 0.80 | 0.80 | 0.79 | 0.86 | 0.85 | 0.85 |
| | 0.86 | 0.84 | 0.84 | 0.98 | 0.99 | 1.00 | 0.99 | 0.79 | 0.80 | 0.79 | 0.79 | 0.86 | 0.86 | 0.86 |
| | 0.86 | 0.85 | 0.85 | 0.99 | 0.99 | 0.99 | 1.00 | 0.79 | 0.80 | 0.79 | 0.79 | 0.86 | 0.86 | 0.86 |
| Bglia.g | 0.79 | 0.78 | 0.78 | 0.78 | 0.79 | 0.79 | 0.79 | 1.00 | 0.95 | 0.94 | 0.94 | 0.80 | 0.79 | 0.81 |
| | 0.80 | 0.79 | 0.79 | 0.79 | 0.80 | 0.80 | 0.80 | 0.95 | 1.00 | 0.95 | 0.96 | 0.81 | 0.80 | 0.81 |
| | 0.80 | 0.79 | 0.79 | 0.79 | 0.80 | 0.79 | 0.79 | 0.94 | 0.95 | 1.00 | 0.95 | 0.81 | 0.80 | 0.81 |
| | 0.79 | 0.79 | 0.79 | 0.78 | 0.79 | 0.79 | 0.79 | 0.94 | 0.96 | 0.95 | 1.00 | 0.80 | 0.79 | 0.81 |
| Granule.a | 0.95 | 0.95 | 0.95 | 0.85 | 0.86 | 0.86 | 0.86 | 0.80 | 0.81 | 0.81 | 0.80 | 1.00 | 0.97 | 0.97 |
| | 0.96 | 0.95 | 0.95 | 0.85 | 0.85 | 0.86 | 0.86 | 0.79 | 0.80 | 0.80 | 0.79 | 0.97 | 1.00 | 0.97 |
| | 0.98 | 0.97 | 0.97 | 0.85 | 0.85 | 0.86 | 0.86 | 0.81 | 0.81 | 0.81 | 0.81 | 0.97 | 0.97 | 1.00 |
| Purkinje.a | 0.82 | 0.80 | 0.80 | 0.96 | 0.96 | 0.96 | 0.97 | 0.76 | 0.76 | 0.76 | 0.75 | 0.85 | 0.84 | 0.83 |
| | 0.81 | 0.79 | 0.79 | 0.95 | 0.95 | 0.95 | 0.96 | 0.75 | 0.75 | 0.76 | 0.74 | 0.84 | 0.84 | 0.82 |
| | 0.88 | 0.87 | 0.87 | 0.96 | 0.96 | 0.96 | 0.96 | 0.79 | 0.79 | 0.79 | 0.78 | 0.88 | 0.88 | 0.89 |
| Basket.a | 0.91 | 0.90 | 0.90 | 0.89 | 0.89 | 0.89 | 0.89 | 0.81 | 0.82 | 0.81 | 0.81 | 0.91 | 0.91 | 0.92 |
| | 0.89 | 0.88 | 0.88 | 0.88 | 0.89 | 0.89 | 0.89 | 0.79 | 0.80 | 0.80 | 0.79 | 0.91 | 0.91 | 0.90 |
| | 0.89 | 0.88 | 0.88 | 0.88 | 0.89 | 0.89 | 0.89 | 0.80 | 0.81 | 0.81 | 0.79 | 0.91 | 0.91 | 0.90 |
| Astrocyte.a | 0.80 | 0.79 | 0.79 | 0.76 | 0.77 | 0.77 | 0.77 | 0.91 | 0.92 | 0.91 | 0.91 | 0.81 | 0.80 | 0.83 |
| | 0.78 | 0.77 | 0.77 | 0.77 | 0.77 | 0.78 | 0.77 | 0.91 | 0.91 | 0.90 | 0.91 | 0.81 | 0.80 | 0.82 |
| Oligo.all.a | 0.85 | 0.84 | 0.84 | 0.82 | 0.83 | 0.83 | 0.83 | 0.84 | 0.85 | 0.85 | 0.84 | 0.86 | 0.86 | 0.87 |
| Oligo.a | 0.82 | 0.81 | 0.80 | 0.81 | 0.81 | 0.82 | 0.82 | 0.83 | 0.84 | 0.83 | 0.83 | 0.85 | 0.84 | 0.84 |
| | 0.81 | 0.80 | 0.80 | 0.80 | 0.81 | 0.81 | 0.81 | 0.82 | 0.83 | 0.83 | 0.82 | 0.84 | 0.84 | 0.83 |
| OPC.a | 0.82 | 0.80 | 0.80 | 0.81 | 0.82 | 0.82 | 0.82 | 0.83 | 0.83 | 0.83 | 0.82 | 0.85 | 0.84 | 0.84 |
| | 0.82 | 0.80 | 0.80 | 0.81 | 0.82 | 0.82 | 0.82 | 0.83 | 0.83 | 0.83 | 0.82 | 0.85 | 0.84 | 0.84 |

| | Purkinje.a | | | Basket.a | | | Astrocyte.a | | Oligo.all.a | Oligo.a | | OPC.a | |
|---|---|---|---|---|---|---|---|---|---|---|---|---|---|
| Granule.g | 0.82 | 0.81 | 0.88 | 0.91 | 0.89 | 0.89 | 0.80 | 0.78 | 0.85 | 0.82 | 0.81 | 0.82 | 0.82 |
| | 0.80 | 0.79 | 0.87 | 0.90 | 0.88 | 0.88 | 0.79 | 0.77 | 0.84 | 0.81 | 0.80 | 0.80 | 0.80 |
| | 0.80 | 0.79 | 0.87 | 0.90 | 0.88 | 0.88 | 0.79 | 0.77 | 0.84 | 0.80 | 0.80 | 0.80 | 0.80 |

663 664

TABLE 16-continued

Pearson's correlation values

| | | | | | | | | | | | | | |
|---|---|---|---|---|---|---|---|---|---|---|---|---|---|
| Purkinje.g | 0.96 | 0.95 | 0.96 | 0.89 | 0.88 | 0.88 | 0.76 | 0.77 | 0.82 | 0.81 | 0.80 | 0.81 | 0.81 |
| | 0.96 | 0.95 | 0.96 | 0.89 | 0.89 | 0.89 | 0.77 | 0.77 | 0.83 | 0.81 | 0.81 | 0.82 | 0.82 |
| | 0.96 | 0.95 | 0.96 | 0.89 | 0.89 | 0.89 | 0.77 | 0.78 | 0.83 | 0.82 | 0.81 | 0.82 | 0.82 |
| | 0.97 | 0.96 | 0.96 | 0.89 | 0.89 | 0.89 | 0.77 | 0.77 | 0.83 | 0.82 | 0.81 | 0.82 | 0.82 |
| Bglia.g | 0.76 | 0.75 | 0.79 | 0.81 | 0.79 | 0.80 | 0.91 | 0.91 | 0.84 | 0.83 | 0.82 | 0.83 | 0.83 |
| | 0.76 | 0.75 | 0.79 | 0.82 | 0.80 | 0.81 | 0.92 | 0.91 | 0.85 | 0.84 | 0.83 | 0.83 | 0.83 |
| | 0.76 | 0.76 | 0.79 | 0.81 | 0.80 | 0.81 | 0.91 | 0.90 | 0.85 | 0.83 | 0.83 | 0.83 | 0.83 |
| | 0.75 | 0.74 | 0.78 | 0.81 | 0.79 | 0.79 | 0.91 | 0.91 | 0.84 | 0.83 | 0.82 | 0.82 | 0.82 |
| Granule.a | 0.85 | 0.84 | 0.88 | 0.91 | 0.91 | 0.91 | 0.81 | 0.81 | 0.86 | 0.85 | 0.84 | 0.85 | 0.85 |
| | 0.84 | 0.84 | 0.88 | 0.91 | 0.91 | 0.91 | 0.80 | 0.80 | 0.86 | 0.84 | 0.84 | 0.84 | 0.84 |
| | 0.83 | 0.82 | 0.89 | 0.92 | 0.90 | 0.90 | 0.83 | 0.82 | 0.87 | 0.84 | 0.83 | 0.84 | 0.84 |
| Purkinje.a | 1.00 | 0.98 | 0.96 | 0.88 | 0.88 | 0.88 | 0.76 | 0.77 | 0.82 | 0.81 | 0.81 | 0.82 | 0.83 |
| | 0.98 | 1.00 | 0.95 | 0.87 | 0.87 | 0.88 | 0.76 | 0.77 | 0.81 | 0.81 | 0.81 | 0.82 | 0.83 |
| | 0.96 | 0.95 | 1.00 | 0.92 | 0.92 | 0.92 | 0.80 | 0.80 | 0.86 | 0.84 | 0.83 | 0.85 | 0.85 |
| Basket.a | 0.88 | 0.87 | 0.92 | 1.00 | 0.99 | 0.99 | 0.82 | 0.81 | 0.88 | 0.85 | 0.84 | 0.87 | 0.87 |
| | 0.88 | 0.87 | 0.92 | 0.99 | 1.00 | 0.99 | 0.80 | 0.80 | 0.86 | 0.85 | 0.84 | 0.86 | 0.87 |
| | 0.88 | 0.88 | 0.92 | 0.99 | 0.99 | 1.00 | 0.80 | 0.80 | 0.87 | 0.85 | 0.84 | 0.86 | 0.87 |
| Astrocyte.a | 0.76 | 0.76 | 0.80 | 0.82 | 0.80 | 0.80 | 1.00 | 0.97 | 0.86 | 0.83 | 0.83 | 0.83 | 0.84 |
| | 0.77 | 0.77 | 0.80 | 0.81 | 0.80 | 0.80 | 0.97 | 1.00 | 0.85 | 0.84 | 0.83 | 0.84 | 0.84 |
| Oligo.all.a | 0.82 | 0.81 | 0.86 | 0.88 | 0.86 | 0.87 | 0.86 | 0.85 | 1.00 | 0.97 | 0.96 | 0.94 | 0.94 |
| Oligo.a | 0.81 | 0.81 | 0.84 | 0.85 | 0.85 | 0.85 | 0.83 | 0.84 | 0.97 | 1.00 | 0.98 | 0.92 | 0.92 |
| | 0.81 | 0.81 | 0.83 | 0.84 | 0.84 | 0.84 | 0.83 | 0.83 | 0.96 | 0.98 | 1.00 | 0.91 | 0.91 |
| OPC.a | 0.82 | 0.82 | 0.85 | 0.87 | 0.86 | 0.86 | 0.83 | 0.84 | 0.94 | 0.92 | 0.91 | 1.00 | 0.96 |
| | 0.83 | 0.83 | 0.85 | 0.87 | 0.87 | 0.87 | 0.84 | 0.84 | 0.94 | 0.92 | 0.91 | 0.96 | 1.00 |

From this analysis, the correlation between different cell types in the cerebellum was observed to be high: r=0.91-0.94, and the correlation across biological replicates was observed to be very high: r=0.98-1. For the gene expression profiles from the EGFP-L10a labeled nuclei from granule cells, Purkinje cells, and Bergmann glia, very high correlations were observed between the genetically defined cell types and cellular profiling defined cell types: r=0.98 for granule cells, r=0.99 for Purkinje cells, and r=0.96-0.97 between Bergmann glia purified from Sept4/EGFP-L10a animals and astrocytes purified by the cellular profiling technique described herein. Since Bergmann glia are a subpopulation of cerebellar astrocytes, it makes sense that these two datasets are not perfectly correlated with each other.

Hierarchical clustering of the samples reveals clustering according to known biology. For example, in the first split, neuronal and glial samples were separated from each other. At the second split, the five cell types separate from each other regardless of whether the nuclei were purified using genetic labeling or antibody labeling. Taken together, results herein demonstrate that the cellular profiling technique described herein allows cell-type specific gene expression profiling in mice without the requirement for transgenic animals.

Example 8

Antibody-Based Sorting of Cell Types in Rats

Nuclei were isolated from rat cerebellum, fixed, and stained using the same antibodies used in mice, and the results were analyzed by flow cytometry. FACS results are shown in Table 17 for nuclei samples from Sprague Dawley rats.

TABLE 17

FACS results for samples from Sprague Dawley rats

| Cell Type | Population | Gender | Percentage |
|---|---|---|---|
| Granule | Itpr1– Olig2– Sorcs3– NeuN+ | Male | 89.700% |

TABLE 17-continued

FACS results for samples from Sprague Dawley rats

| Cell Type | Population | Gender | Percentage |
|---|---|---|---|
| Granule | Itpr1– Olig2– Sorcs3– NeuN+ | Female | 90.100% |
| Purkinje | Itpr1+ NeuN+ | Male | 0.096% |
| Purkinje | Itpr1+ NeuN+ | Female | 0.089% |
| Basket | Itpr1+ med NeuN– | Male | 2.750% |
| Basket | Itpr1+ med NeuN– | Female | 2.390% |
| Astrocytes | Sorcs3+ med NeuN– | Male | 3.140% |
| Astrocytes | Sorcs3+ med NeuN– | Female | 2.870% |
| Oligodendrocytes - Mature | Sorcs3– NeuN– | Male | 2.250% |
| Oligodendrocytes - Mature | Sorcs3– NeuN– | Female | 2.170% |
| Oligodendrocytes - Precursor + Mature | Olig2+ High NeuN– | Male | 0.400% |
| Oligodendrocytes - Precursor + Mature | Olig2+ High NeuN– | Female | 0.420% |
| Cytoplasmic | — | Male | — |
| Cytoplasmic | — | Female | — |

The staining profiles of rat nuclei resembled those of mice. Although there were differences, for example, in the rat cerebellum, NeuN staining resulted in more distinct positive and negative populations than was evident in the mouse cerebellum. As a result, additional populations of nuclei were revealed by flow cytometry analysis, and these were isolated and characterized by RNAseq. Nuclei were isolated from basket cells, astrocytes, and oligodendrocytes by staining with antibodies specific to Sorcs3 and NeuN. This flexibility allowed for purification of all six cell types using four methods of staining. For cell types that were isolated from more than one type of staining, the population identified by RNAseq to be most enriched for known markers and depleted for markers of other cerebellar cell types was chosen.

To determine the group of genes that are specific to each of the rat cell types, differential gene expression analysis (DESeq2) was performed as described in Example 1 to compare the nuclear expression profile for each cell type to unsorted cerebellar nuclei. The log 2 fold change in expression for 120 differentially expressed genes (adjusted p<0.01, fold change >2) between the normalized RNAseq results from the nuclei of the six cells types compared to the RNAseq results for the sorted nuclei from each individual cell type is shown in Table 18. Negative values indicate reduced expression in the nuclei of the cell type compared to the normalized value across nuclei from all cell types analyzed, and a positive value indicates increased expression compared to the normalized value across nuclei from all cell types analyzed. Two replicate samples of nuclei from each cell type was analyzed.

TABLE 18

| | Log2 fold change of gene expression in rat nuclei | | | | | | | | | | | |
| --- | --- | --- | --- | --- | --- | --- | --- | --- | --- | --- | --- | --- |
| | Log2 fold change in expression Cell Type | | | | | | | | | | | |
| Gene | granule | | purkinje | | basket | | astocyte | | oligo | | opc | |
| AABR07001623.1 | −0.64 | −0.53 | −0.42 | −0.64 | 2.32 | 1.15 | 1.30 | −0.53 | −0.42 | −0.64 | −0.53 | −0.42 |
| AABR07001734.1 | −0.72 | −1.26 | 0.64 | 0.81 | 1.53 | 1.18 | 0.85 | 0.22 | −0.77 | −0.84 | −1.41 | −0.23 |
| AABR07006310.1 | −0.34 | −0.33 | −0.64 | −0.94 | −0.33 | 0.12 | −0.72 | 0.05 | 2.25 | 1.70 | −0.93 | 0.12 |
| AABR07006713.1 | −0.64 | −0.56 | 1.88 | 2.18 | −0.56 | −0.48 | 0.52 | −0.56 | −0.48 | −0.64 | −0.19 | −0.48 |
| AABR07006713.2 | −0.33 | −0.66 | 1.76 | 2.15 | −0.50 | −0.29 | 0.34 | 0.07 | −0.88 | −0.44 | −0.07 | −1.15 |
| AABR07006727.1 | −0.47 | −0.38 | 1.83 | 2.39 | −0.38 | −0.56 | −0.07 | −0.38 | −0.56 | −0.47 | −0.38 | −0.56 |
| AABR07013140.1 | 2.02 | 1.94 | −0.44 | −0.51 | −0.40 | −0.58 | −0.71 | −0.86 | −0.44 | −0.71 | 0.46 | 0.22 |
| AABR07026032.2 | 1.67 | 2.33 | −0.65 | −0.37 | −0.21 | −0.08 | −0.94 | −0.21 | 0.07 | −0.94 | −0.57 | −0.08 |
| AABR07030473.1 | −0.76 | −0.82 | 1.87 | 1.75 | 0.43 | 0.65 | −0.47 | −0.13 | −0.78 | −1.01 | −0.82 | 0.11 |
| AABR07030880.1 | 1.76 | 1.89 | −0.53 | −0.90 | 0.18 | −0.02 | −0.52 | −0.59 | 0.31 | −0.90 | −1.20 | 0.51 |
| AABR07046961.1 | −1.10 | −1.11 | −1.10 | −0.91 | −0.27 | −0.45 | 0.55 | 0.21 | 1.78 | 1.53 | 0.48 | 0.38 |
| AABR07047823.1 | −0.36 | 0.02 | −1.24 | −1.15 | 1.91 | 1.20 | 1.08 | 0.63 | −0.74 | −0.36 | −0.77 | −0.23 |
| AABR07049491.1 | −0.38 | −0.45 | 2.00 | 2.25 | −0.45 | −0.21 | −0.38 | −0.45 | −0.39 | −0.38 | −0.45 | −0.70 |
| AABR07052897.1 | −0.46 | −0.67 | −0.57 | −0.46 | −0.67 | −0.57 | −0.46 | −0.67 | 0.19 | 0.30 | 2.12 | 1.93 |
| AABR07058658.1 | −1.32 | −0.35 | −0.55 | −1.32 | 0.14 | 0.15 | 1.59 | 1.95 | 0.34 | −0.10 | 0.21 | −0.74 |
| AABR07061428.1 | −1.02 | −0.93 | −1.10 | −1.02 | 1.70 | 1.37 | 0.52 | −0.14 | 0.57 | 0.23 | −0.93 | 0.74 |
| AABR07070161.1 | −1.04 | −0.81 | −0.81 | −1.04 | 0.20 | 0.32 | 1.64 | 1.98 | 0.21 | −0.56 | −0.51 | 0.41 |
| AABR07070161.6 | −0.40 | −0.79 | −0.29 | −0.40 | −0.79 | 0.49 | 2.40 | 1.55 | −0.29 | −0.40 | −0.79 | −0.29 |
| AABR07070578.1 | −0.90 | −0.15 | −0.69 | 0.10 | 1.55 | 1.16 | 1.25 | 0.89 | −1.30 | −1.29 | −0.48 | −0.14 |
| Abi3 | −0.36 | 0.08 | −0.77 | −1.02 | −0.11 | −0.42 | −0.36 | −0.21 | 2.20 | 1.89 | −0.34 | −0.57 |
| Aqp9 | −0.93 | −0.54 | −0.55 | −1.07 | 0.13 | −0.08 | 1.97 | 1.93 | 0.07 | −0.20 | 0.11 | −0.85 |
| Arhgef26 | −1.01 | −0.70 | −1.34 | −1.33 | 1.28 | 1.28 | 0.91 | 1.01 | 0.00 | −0.57 | −0.20 | 0.66 |
| Arhgef33 | −0.55 | −0.66 | 2.12 | 1.99 | −0.60 | −0.49 | −0.66 | −0.43 | −0.04 | −0.70 | −0.22 | 0.25 |
| Arl4a | −0.61 | −1.62 | 0.04 | 0.68 | 1.51 | 1.33 | 0.61 | 0.20 | 0.28 | −0.09 | −0.79 | −1.54 |
| B3gnt5 | −0.71 | −0.23 | 2.13 | 2.01 | −0.51 | −0.50 | −0.44 | −0.23 | −0.50 | −0.71 | −0.51 | 0.21 |
| Bgn | −0.50 | −0.61 | −0.97 | −0.58 | −0.20 | −0.33 | 0.69 | 0.49 | −0.30 | −1.28 | 1.54 | 2.04 |
| C1ql1 | −0.96 | −0.78 | −0.91 | −0.96 | −0.36 | −0.07 | 0.92 | 0.81 | −0.23 | −0.73 | 1.38 | 1.89 |
| C1ql2 | −0.90 | −0.82 | −0.98 | −0.90 | 0.53 | −0.01 | 0.35 | 0.58 | −0.39 | −0.90 | 1.53 | 1.92 |
| Cacng5 | −0.69 | −0.67 | −0.92 | −0.69 | 0.21 | 0.44 | 2.12 | 1.65 | 0.12 | 0.01 | −0.67 | −0.92 |
| Cadps2 | 1.51 | 2.04 | −0.96 | −1.22 | −0.16 | −0.54 | −0.62 | −0.25 | 0.58 | −0.91 | 0.50 | 0.03 |
| Calb1 | −0.77 | −0.58 | 2.13 | 2.03 | −0.48 | −0.13 | −0.31 | −0.17 | 0.02 | −0.60 | −0.52 | −0.63 |
| Calb2 | 1.90 | 1.91 | −0.49 | −0.80 | −0.61 | −1.03 | 0.31 | 0.45 | −0.10 | −0.98 | −0.30 | −0.26 |
| Car4 | 2.01 | 1.38 | −1.82 | 0.10 | −0.74 | −0.07 | 0.38 | 0.32 | −0.17 | −0.80 | −0.47 | −0.10 |
| Car8 | −0.30 | −0.62 | 1.86 | 2.19 | −0.85 | −0.71 | −0.36 | −0.57 | −0.43 | −0.54 | 0.01 | 0.32 |
| Cav1 | −0.98 | −0.92 | −0.69 | −0.80 | −0.92 | −0.32 | 0.46 | 0.63 | 0.47 | −0.40 | 1.50 | 1.97 |
| Cbln1 | 2.13 | 1.78 | −1.11 | −0.66 | −0.58 | −0.69 | 0.00 | −0.08 | 0.39 | −0.06 | −0.45 | −0.66 |
| Ccnd1 | −0.87 | −0.95 | −0.43 | −0.61 | −0.83 | −0.65 | 0.27 | 0.78 | 0.38 | −0.66 | 1.62 | 1.95 |
| Cdh15 | 2.06 | 1.93 | −1.28 | −0.36 | 0.06 | −0.20 | −0.16 | −0.22 | −0.27 | −0.90 | −0.17 | −0.49 |
| Cdk2 | −0.54 | −0.80 | −0.98 | −0.86 | −1.31 | −0.47 | 0.64 | 0.71 | 0.60 | −0.15 | 1.36 | 1.81 |
| Cep76 | −0.55 | −0.49 | 2.10 | 2.09 | −0.59 | −0.62 | −0.42 | −0.32 | −0.15 | −0.77 | 0.01 | −0.28 |
| Cldn11 | −0.99 | −1.14 | −0.82 | −1.06 | −0.66 | −0.43 | 0.56 | 0.15 | 1.75 | 1.51 | 0.64 | 0.50 |
| Clmp | −0.94 | −0.83 | −1.42 | −1.23 | 1.39 | 1.14 | 1.16 | 0.97 | −0.26 | −0.37 | −0.02 | 0.40 |
| Col12a1 | −0.85 | −0.19 | −1.06 | −1.65 | 1.23 | 1.64 | 0.64 | 0.54 | −0.16 | −0.86 | −0.13 | 0.84 |
| Col5a3 | −0.72 | −0.62 | −1.04 | −1.30 | −0.48 | −0.30 | 0.62 | 0.95 | 0.08 | −0.50 | 1.61 | 1.70 |
| Cspg4 | −1.18 | −1.11 | −1.13 | −1.00 | −0.44 | −0.38 | 0.68 | 0.73 | 0.66 | 0.26 | 1.35 | 1.56 |
| Cyp2d5 | −0.68 | −0.27 | −0.19 | −1.32 | 0.30 | −0.07 | 1.88 | 1.92 | 0.21 | −0.28 | −0.50 | −1.00 |
| Enpp1 | −1.40 | −0.79 | −0.86 | −1.17 | 1.59 | 1.55 | −0.27 | 0.02 | 0.54 | −0.23 | 0.02 | 0.98 |
| Ermn | −0.37 | −0.74 | −0.47 | −0.68 | −0.72 | −0.59 | 0.86 | −0.77 | 1.99 | 1.85 | −0.22 | −0.16 |
| Fam107b | −0.63 | −0.37 | 2.15 | 1.90 | −0.18 | 0.00 | −0.13 | −0.20 | −0.17 | −1.00 | −0.96 | −0.41 |
| Fam89a | −0.69 | −0.28 | −1.02 | −0.61 | −0.41 | −0.65 | 0.56 | 0.95 | −0.65 | −0.73 | 1.85 | 1.69 |
| Fat2 | 1.72 | 2.01 | −1.21 | −1.00 | −0.44 | −0.22 | −0.04 | −0.26 | 0.64 | −0.87 | −0.10 | −0.23 |
| Gabra6 | 1.98 | 1.90 | −0.45 | −0.31 | −0.25 | −0.39 | −0.31 | −0.58 | 0.51 | −0.29 | −0.42 | −1.41 |
| Gabrd | 1.94 | 1.93 | −0.18 | −0.46 | −0.42 | −0.13 | −0.28 | −0.16 | 0.46 | −1.02 | −0.47 | −1.22 |
| Gdf10 | −0.44 | −1.20 | −0.43 | −0.85 | 0.34 | 0.57 | 1.72 | 1.81 | 0.34 | −0.11 | −0.61 | −1.14 |
| Gjd2 | −0.24 | 0.33 | −1.06 | −1.16 | 1.31 | 1.35 | 1.17 | 0.39 | −0.35 | −0.76 | −1.52 | 0.53 |
| Gldc | −1.06 | −0.64 | −1.05 | −0.76 | 1.44 | 1.48 | 0.71 | 0.75 | −0.88 | −0.91 | 0.00 | 0.92 |
| Gli1 | −1.09 | −0.76 | −0.83 | −1.09 | 0.23 | 0.58 | 1.68 | 1.77 | 0.45 | −0.42 | −0.76 | 0.25 |
| Gpr37 | −0.98 | −1.15 | −0.31 | −1.11 | −0.72 | −0.33 | 0.49 | 0.49 | 2.10 | 1.36 | 0.06 | 0.11 |
| Gpr63 | −0.85 | −0.67 | 1.94 | 2.14 | −0.05 | −0.15 | −0.60 | −0.36 | 0.18 | −0.32 | −0.72 | −0.54 |
| Grm8 | −0.84 | −0.47 | −0.66 | −0.90 | 1.68 | 1.62 | 0.40 | 0.64 | −0.72 | −1.22 | −0.35 | 0.82 |
| Hapln2 | −0.76 | −1.26 | −1.22 | −1.02 | 0.17 | 0.30 | 0.87 | 0.43 | 1.66 | 1.50 | −0.40 | −0.26 |
| Hpcal4 | −1.01 | −0.84 | −0.69 | −1.01 | 1.25 | 1.59 | 0.91 | 0.96 | −0.13 | −0.55 | −1.10 | 0.63 |
| Id4 | −1.30 | −0.76 | 0.13 | 0.60 | 0.05 | −0.07 | 1.52 | 2.04 | 0.02 | −0.42 | −1.07 | −0.75 |
| Il16 | 1.46 | 1.87 | −1.25 | −1.24 | 0.20 | −0.56 | −0.03 | −0.02 | 0.42 | −0.42 | 0.65 | −1.08 |
| Itga7 | 1.69 | 1.88 | −1.64 | −0.73 | −0.05 | −0.34 | 0.34 | 0.56 | −0.29 | −0.58 | −0.24 | −0.59 |

TABLE 18-continued

Log2 fold change of gene expression in rat nuclei

Log2 fold change in expression
Cell Type

| Gene | granule | | purkinje | | basket | | astocyte | | oligo | | opc | |
|---|---|---|---|---|---|---|---|---|---|---|---|---|
| Itga9 | -0.70 | -0.67 | -0.98 | -1.06 | -0.88 | -0.63 | 0.37 | 0.59 | -0.02 | 0.51 | 1.75 | 1.73 |
| Itih3 | -0.95 | -0.87 | -1.19 | -0.95 | 0.43 | 0.27 | 1.80 | 1.78 | 0.20 | 0.23 | -0.28 | -0.45 |
| Itpr1 | -0.42 | -0.13 | 2.13 | 1.96 | -0.16 | 0.02 | -0.48 | -0.60 | -0.33 | -1.10 | -0.64 | -0.25 |
| Kcnh1 | 1.81 | 1.95 | -1.21 | -0.98 | -0.35 | -0.86 | 0.10 | 0.34 | 0.00 | -0.71 | 0.01 | -0.11 |
| Kcnj12 | 1.92 | 1.74 | -0.31 | -0.62 | -0.93 | -0.87 | -0.53 | -0.82 | 0.16 | -0.73 | 0.19 | 0.80 |
| Klk6 | -0.82 | -0.78 | -1.01 | -0.82 | -0.43 | 0.03 | 0.89 | 0.54 | 1.97 | 1.48 | -0.78 | -0.28 |
| Lama3 | -0.45 | -1.07 | -0.63 | 0.03 | 1.66 | 1.70 | 0.59 | 0.26 | -1.27 | -0.90 | -0.56 | 0.65 |
| Lfng | -1.07 | -1.54 | -0.92 | 0.19 | 0.02 | 0.24 | 1.59 | 1.51 | 0.53 | -0.03 | 0.55 | -1.08 |
| Lgi4 | -0.05 | -0.09 | -1.43 | -1.54 | -0.18 | -0.09 | 1.69 | 1.72 | 0.47 | 0.30 | -0.18 | -0.62 |
| Lims2 | -0.87 | -0.70 | -1.05 | -0.68 | -0.52 | -0.76 | 0.55 | 1.08 | -0.16 | -0.28 | 1.76 | 1.64 |
| Lypd6 | -0.69 | -0.62 | -0.88 | -0.47 | 1.60 | 1.87 | 0.12 | 0.01 | -0.57 | -0.87 | -0.70 | 1.23 |
| Mag | -0.54 | -0.62 | -1.36 | -1.41 | -0.58 | -0.42 | 0.47 | 0.39 | 1.82 | 1.37 | 0.47 | 0.42 |
| Mal | -0.85 | -0.82 | -1.22 | -1.38 | 0.14 | -0.16 | 0.46 | 0.10 | 1.75 | 1.63 | 0.44 | -0.09 |
| March11 | -0.67 | -0.37 | -0.04 | 0.31 | 1.74 | 1.44 | -0.16 | 0.04 | -1.28 | -1.79 | 0.34 | 0.45 |
| Mobp | -1.01 | -0.93 | -1.41 | -1.05 | -0.39 | -0.11 | 0.73 | 0.18 | 1.72 | 1.39 | 0.41 | 0.48 |
| Mog | -1.14 | -0.58 | -0.84 | -0.88 | -0.41 | -0.53 | 0.47 | 0.03 | 2.05 | 1.69 | 0.34 | -0.19 |
| Msx2 | -0.79 | -1.14 | -0.58 | -0.32 | 0.29 | -0.05 | 2.02 | 1.95 | -0.13 | -0.32 | -0.22 | -0.70 |
| Mt2A | -0.54 | -0.43 | -0.64 | -0.54 | 0.49 | -0.07 | 1.92 | 2.14 | -0.64 | -0.54 | -0.43 | -0.64 |
| Nkain4 | -1.00 | -1.11 | -1.34 | -0.87 | 0.17 | 0.42 | 1.61 | 1.79 | 0.32 | -0.09 | -0.19 | 0.28 |
| Opalin | -1.14 | -0.31 | -1.20 | -1.14 | -0.35 | -0.39 | 0.31 | 0.18 | 1.91 | 1.59 | 0.04 | 0.50 |
| Pdgfra | -0.69 | -0.90 | -0.97 | -0.79 | -0.27 | -0.14 | 0.62 | 0.88 | -0.38 | -0.82 | 1.67 | 1.81 |
| Plch1 | -0.89 | -1.11 | -0.73 | -0.60 | 1.56 | 1.73 | 0.64 | 0.38 | -0.37 | -0.74 | -0.78 | 0.92 |
| Plk2 | -1.00 | -0.99 | -1.54 | -1.00 | 1.35 | 1.04 | 0.83 | 0.90 | -0.13 | -0.51 | 0.07 | 0.97 |
| Plxdc1 | -0.67 | -0.80 | 1.95 | 2.09 | -0.56 | -0.11 | 0.24 | -0.03 | -0.12 | -0.67 | -0.57 | -0.75 |
| Pmel | -0.02 | -0.91 | -1.24 | -0.84 | -0.58 | -0.65 | 0.68 | 0.88 | 0.00 | -0.65 | 1.64 | 1.68 |
| Pou3f2 | -0.64 | -0.03 | -1.06 | -1.00 | 0.18 | -0.70 | 1.78 | 1.95 | -0.50 | -0.64 | 0.09 | 0.58 |
| Ppfibp1 | -0.85 | -0.85 | -1.27 | -1.16 | -0.36 | -0.24 | 0.60 | 0.64 | 0.27 | -0.12 | 1.58 | 1.75 |
| Ppp1r17 | 0.12 | 0.43 | 1.74 | 1.95 | -0.71 | -1.03 | -1.06 | -0.29 | 0.16 | -0.36 | 0.08 | -1.03 |
| Prr5l | -0.51 | -0.51 | -1.10 | -1.09 | -0.62 | -0.66 | 0.73 | 0.34 | 1.86 | 1.65 | 0.43 | -0.52 |
| Prrt2 | 1.55 | 1.95 | -1.55 | -0.56 | -0.08 | -0.22 | 0.12 | 0.29 | -0.80 | -0.99 | 0.51 | -0.22 |
| Qdpr | -1.30 | -0.43 | -0.92 | -0.39 | -0.19 | -0.55 | 0.00 | 0.20 | 2.16 | 1.73 | -0.02 | -0.29 |
| Rasgrp3 | -0.75 | -0.45 | -1.01 | -1.15 | -0.19 | -0.36 | 0.89 | 0.56 | 1.83 | 1.64 | -0.29 | -0.71 |
| Rbfox3 | 1.96 | 1.72 | -1.66 | -0.65 | -0.52 | -0.46 | 0.06 | -0.31 | -0.27 | -0.35 | 0.48 | 0.00 |
| RGD1561557 | -0.47 | -0.76 | 1.91 | 2.27 | -0.04 | -0.39 | -0.11 | -0.40 | -0.39 | -0.47 | -0.76 | -0.39 |
| RGD1561849 | -0.70 | -0.69 | -1.27 | -0.84 | -0.29 | -0.20 | 0.83 | 0.84 | -0.53 | -0.51 | 1.68 | 1.68 |
| Rlbp1 | -0.62 | -0.21 | -0.88 | -1.03 | -0.51 | -0.69 | 0.65 | 0.76 | -0.69 | -0.37 | 1.75 | 1.83 |
| Ryr1 | -0.43 | -0.67 | 1.91 | 2.27 | -0.36 | -0.37 | -0.21 | -0.34 | -0.49 | -0.72 | 0.02 | -0.62 |
| S1pr1 | -0.81 | -0.62 | -1.13 | -1.07 | 0.51 | 0.47 | 1.55 | 1.71 | 0.59 | 0.16 | -1.14 | -0.21 |
| Scara3 | 1.82 | 1.65 | -1.80 | -0.67 | -0.43 | -0.50 | 0.18 | -0.41 | 0.42 | -0.53 | -0.14 | 0.41 |
| Selplg | -0.79 | -0.52 | -0.85 | 0.30 | 0.21 | 0.09 | -0.43 | -0.52 | 2.35 | 1.52 | -0.52 | -0.85 |
| Serpine2 | -0.97 | -1.08 | -1.01 | -1.13 | -0.48 | -0.16 | 0.94 | 0.66 | 0.06 | 0.02 | 1.35 | 1.79 |
| Slc1a6 | -0.46 | -0.39 | 2.17 | 2.03 | -0.27 | -0.56 | -0.63 | -0.44 | -0.30 | -0.84 | -0.24 | -0.06 |
| Slc25a18 | -0.50 | -0.72 | -1.95 | -0.13 | 0.01 | -0.19 | 1.81 | 1.74 | -0.07 | 0.07 | -0.22 | 0.14 |
| Slc5a11 | -1.08 | -1.53 | -0.27 | 0.02 | -0.76 | -0.51 | 0.71 | -0.03 | 1.84 | 1.53 | -0.37 | 0.45 |
| Slc7a10 | -0.42 | 0.34 | -0.98 | -1.19 | -0.11 | -0.34 | 1.77 | 2.08 | -0.05 | -0.28 | -0.01 | -0.81 |
| Slc9a3 | -0.23 | -0.71 | 1.92 | 2.04 | -1.09 | -0.92 | -0.13 | -0.26 | 0.33 | -0.04 | -0.42 | -0.48 |
| Snx22 | -1.27 | -0.59 | -1.14 | -1.27 | -0.07 | 0.35 | 0.64 | 0.62 | -0.28 | -0.17 | 1.57 | 1.61 |
| Sorcs3 | -0.73 | -0.64 | -0.91 | -1.11 | 1.42 | 1.41 | 0.17 | 0.43 | -0.79 | -1.14 | 0.76 | 1.13 |
| Sv2b | 1.71 | 1.84 | -1.13 | -0.94 | -0.10 | -0.40 | 0.49 | 0.02 | 0.46 | -0.37 | -0.28 | -1.30 |
| Tesc | 1.60 | 1.90 | -1.21 | -1.41 | -0.06 | 0.06 | -0.33 | -0.01 | 0.01 | -1.06 | 0.14 | 0.37 |
| Tmem255b | -1.24 | -0.09 | -0.67 | -0.12 | -0.51 | -0.49 | 0.55 | 0.93 | -0.76 | -0.09 | 1.86 | 1.53 |
| Tmem63a | -0.79 | -0.81 | -1.29 | -0.88 | -0.26 | -0.60 | 0.77 | 0.48 | 1.71 | 1.74 | 0.17 | -0.24 |
| Tmem88b | -0.31 | -0.75 | -1.30 | -1.23 | -0.75 | -0.37 | 0.64 | 0.35 | 1.85 | 1.48 | -0.13 | 0.53 |
| Tnc | -1.21 | -1.14 | -0.49 | -1.39 | 0.00 | 0.34 | 1.89 | 1.34 | 0.27 | -0.32 | 0.10 | 0.61 |
| Zfp385c | -0.51 | -0.91 | 1.62 | 2.03 | 0.54 | 0.37 | 0.09 | -0.16 | -1.12 | -0.96 | -0.50 | -0.50 |

A general enrichment was observed in Table 18 for known markers for each cell type and a depletion for markers for all other cell types. Nuclear expression of Fat2 and Rbfox3 was observed to be significantly enriched in granule cells. Nuclear expression of Car8 and Calb1 was observed to be specific to purkinje cells. Nuclear expression of Aldh1L1 and Slc1a3 was observed to be specific to bergmann glia. Nuclear expression of Colgalt2 was observed to be specific to corticopontine pyramidal cells. Nuclear expression of Hs3st4 was observed to be specific to corticothalamic pyramidal cells, while Pde1a and Csmd1 were observed to be expressed in both cortical pyramidal cell types. In addition to the 120 genes in Table 18, the data also identified 700 to 1,600 expressed genes that are significantly enriched in each of the rat cell types.

Genes were also identified that are most specific for each cell type by implementing an updated version of the specificity index (SI) algorithm (Dougherty, et al. (2010) Nucleic Acids Res 38, 4218-4230, which is hereby incorporated by reference herein in its entirety). An advantage of the SI is that it can identify specifically expressed genes even in cell types that are very abundant in the region of interest (e.g. cerebellar granule cells).

To validate both the cell-type specific rat data and the updated SI algorithm, the expression of genes identified as being specific to each cell type were confirmed using the Allen Mouse Brain Atlas in situ hybridization database. For the top 20 most specific genes calculated by the SI algorithm in Example 1 for all cell types, labeling was observed specifically in the defined cell type on average 93% of the time. Percentages of top 20 SI genes with Allen Mouse Brain Atlas images that showed expected distribution for each cell type were: granule 93%, Purkinje 100%, basket 85%, astrocyte 93%, oligodendrocyte 100%, and OPC 80%. Distribution of the astrocyte-specific gene Itih3 was also observed to be characteristic of both Bergmann glia, a type of astrocyte, and non-Bergmann glia astrocytes of the cerebellum. The following genes were chosen as additional markers for the nuclei of the 6 cell types: Tescalcin (Tesc) for granule cell nuclei, Carbonic Anhydrase 8 (Car8) for Purkinje cell nuclei, March11 for basket cell nuclei, Inter-Alpha-Trypsin Inhibitor Heavy Chain 3 (Itih3) for astrocyte nuclei, Mog for oligodendrocyte nuclei, and Platelet Derived Growth Factor Receptor Alpha (Pdgfra) for oligodendrocyte progenitor nuclei.

These results demonstrate that the cellular profiling technique described herein is a generalizable method that can easily be adapted for use in any species.

Example 9

Identifying and Comparing the Most Specific Genes in Each Species

To gain insight into cell-type specific functions that have changed across species, the specificity index for all genes in each species was calculated. The 100 most specific genes for each species is shown for each cell type in Tables 19-24. A lower SI value indiciates a gene expressed more specifically in one species over another.

Table 19 provides the 100 most specific genes measured by the specificity index (SI) as described in Example 1 for granule cells in human, rat, and mouse samples.

TABLE 19

| | 100 most specific genes measured by SI for each species in granule cells | | | | | |
|---|---|---|---|---|---|---|
| Rank | Human | SI | Rat | SI | Mouse | SI |
| 1 | Cadps2 | 64.6 | Tesc | 27.0 | Gabra6 | 16.0 |
| 2 | Reln | 112.8 | Itga7 | 36.6 | Grin2c | 17.3 |
| 3 | Synpr | 113.6 | Rbfox3 | 39.2 | Fat2 | 25.2 |
| 4 | Galnt5 | 114.2 | AABR07013140.1 | 43.4 | Cadps2 | 31.0 |
| 5 | Ccm21 | 163.1 | Calb2 | 53.8 | Ptpn22 | 35.2 |
| 6 | Srrm4 | 176.1 | Kcnh1 | 55.8 | Chn2 | 52.6 |
| 7 | Tmem266 | 178.5 | Cdh15 | 60.5 | Neurod1 | 58.7 |
| 8 | Cckbr | 209.9 | AABR07030880.1 | 77.6 | Calb2 | 63.1 |
| 9 | Cerk1 | 213.3 | Prrt2 | 91.0 | Trhde | 64.3 |
| 10 | Chn2 | 241.0 | Gabrd | 99.8 | Il16 | 70.6 |
| 11 | Grik2 | 243.5 | Il16 | 104.7 | Ppfia4 | 71.8 |
| 12 | Mal2 | 244.1 | Scara3 | 119.2 | Cbln1 | 78.2 |
| 13 | Fat2 | 248.1 | Cbln1 | 120.8 | Sidt1 | 82.2 |
| 14 | Adamts16 | 264.1 | AABR07026032.2 | 128.9 | Tmem266 | 86.6 |
| 15 | Lcn8 | 265.2 | Cadps2 | 131.5 | Gabrd | 88.3 |
| 16 | Fstl5 | 272.9 | Sv2b | 133.5 | Reln | 89.2 |
| 17 | Tll1 | 274.1 | Fat2 | 138.6 | Kcnj12 | 95.9 |
| 18 | Vsnl1 | 276.9 | Gabra6 | 146.0 | Gprc5c | 98.8 |
| 19 | Rit2 | 284.7 | Car4 | 155.4 | Rims3 | 103.9 |
| 20 | Slc8a2 | 299.5 | Kcnj12 | 172.1 | Tll1 | 105.4 |
| 21 | Slc17a7 | 307.5 | Nrep | 175.8 | Cbln3 | 105.8 |
| 22 | Zp2 | 331.6 | AABR07043098.3 | 182.4 | Olfm3 | 113.7 |
| 23 | Tspan18 | 334.6 | Rtn4r | 187.8 | Slc17a7 | 115.8 |
| 24 | Fgf5 | 351.5 | Shisa8 | 188.7 | Chgb | 120.7 |
| 25 | Prag1 | 356.2 | Sel1l3 | 189.4 | Kcnh1 | 122.2 |
| 26 | Slc6a7 | 371.1 | Grb7 | 196.2 | Cdh15 | 124.2 |
| 27 | Rims1 | 375.5 | Rgl3 | 200.3 | Barhl2 | 124.5 |
| 28 | Cdh7 | 378.6 | Dusp5 | 207.6 | Dusp5 | 124.7 |
| 29 | L1cam | 379.3 | Chn2 | 218.3 | Kcnc1 | 130.3 |
| 30 | Mical2 | 388.1 | Lamp5 | 221.3 | Camk4 | 132.3 |
| 31 | Ptk2b | 390.3 | Pagr1 | 221.3 | Des | 138.2 |
| 32 | Kcnh1 | 402.0 | Cemip | 223.2 | Cerkl | 140.2 |
| 33 | Arhgap29 | 404.9 | Gprc5c | 225.6 | Svep1 | 142.8 |
| 34 | Cdk15 | 410.7 | Shf | 233.9 | Uncx | 143.7 |
| 35 | Pde3b | 414.1 | Wdr66 | 234.9 | Slc8a2 | 151.4 |
| 36 | Itga4 | 416.5 | Tmem44 | 240.1 | Cacna2d1 | 152.0 |
| 37 | Etv1 | 425.6 | Reln | 245.4 | Pxylp1 | 155.9 |
| 38 | Tmem178 | 426.5 | Tll1 | 258.2 | Ptchd1 | 163.2 |
| 39 | Chgb | 429.8 | Slc17a7 | 258.2 | Sel1l3 | 167.7 |
| 40 | Col13a1 | 431.0 | Pax6 | 258.7 | Rtn4r | 183.3 |
| 41 | Rnf152 | 444.4 | Capn1 | 259.9 | Cacna1e | 185.3 |
| 42 | Kcnk1 | 449.5 | Calhm3 | 263.7 | Patj | 187.1 |
| 43 | Il16 | 450.0 | AABR07043098.1 | 270.3 | Atp2b3 | 188.1 |
| 44 | Sstr2 | 463.9 | Camk4 | 283.7 | Marveld2 | 191.7 |
| 45 | Als2 | 464.2 | Selm | 284.5 | Kcnk10 | 195.2 |
| 46 | Barhl1 | 464.5 | Sema3g | 285.7 | Rab15 | 195.9 |
| 47 | Scn2a | 466.8 | LOC100360491 | 287.3 | Rapgef4 | 198.4 |
| 48 | Cbln1 | 471.6 | Diras2 | 292.9 | Rims1 | 208.6 |
| 49 | Dusp5 | 471.7 | Agbl2 | 303.2 | Tmem178 | 216.5 |
| 50 | Ndst3 | 477.7 | Mctp1 | 310.5 | Ak4 | 219.6 |
| 51 | Lurap1l | 481.0 | Mvp | 312.7 | Lin7a | 220.8 |

TABLE 19-continued

| | 100 most specific genes measured by SI for each species in granule cells | | | | | |
|---|---|---|---|---|---|---|
| Rank | Human | SI | Rat | SI | Mouse | SI |
| 52 | Kcnj12 | 491.9 | Tmem51 | 312.9 | Igfbp5 | 229.0 |
| 53 | Snai2 | 501.7 | Vsnl1 | 322.6 | Tesc | 233.4 |
| 54 | Ifnlr1 | 503.3 | Plk5 | 328.1 | Neurl1a | 234.0 |
| 55 | Neurod1 | 514.3 | Mrgprf | 329.2 | Vat1l | 236.3 |
| 56 | Cdyl2 | 521.2 | LOC100910401 | 337.4 | Msra | 236.4 |
| 57 | Ppp1r1c | 524.2 | Ak4 | 342.1 | Vsnl1 | 237.2 |
| 58 | Jkamp | 526.0 | Wscd2 | 350.2 | Rps6ka1 | 238.8 |
| 59 | Neurl1a | 529.6 | Grin2a | 360.2 | Lhfp | 239.9 |
| 60 | Trhde | 539.3 | Cfap74 | 363.1 | Kcnk3 | 241.1 |
| 61 | Mfsd9 | 543.0 | Rnf39 | 376.2 | Ryr2 | 243.4 |
| 62 | Xkr7 | 550.6 | Cbln3 | 385.9 | Exph5 | 248.3 |
| 63 | Barhl2 | 564.0 | Fzd7 | 387.2 | Kif26b | 249.8 |
| 64 | Cbln3 | 572.1 | Golga7b | 389.4 | Adamts18 | 261.7 |
| 65 | Uncx | 577.0 | AABR07033679.1 | 392.9 | Cntnap4 | 263.7 |
| 66 | Ptchd1 | 584.0 | Ptpn22 | 394.9 | Tspan18 | 276.0 |
| 67 | Cblb | 596.7 | Grin2c | 394.9 | Mmp24 | 278.7 |
| 68 | Runx1t1 | 599.3 | Ablim1 | 400.9 | Cdh8 | 280.9 |
| 69 | Sphkap | 603.8 | Kcnkl | 401.5 | Ablim3 | 282.7 |
| 70 | Gabra6 | 603.9 | Arpp21 | 408.5 | Cadm3 | 290.3 |
| 71 | Coro2a | 611.9 | C1rl | 413.8 | Ntf3 | 301.2 |
| 72 | Bmper | 618.4 | Zscan30 | 418.0 | Pld5 | 305.0 |
| 73 | Dkk4 | 618.7 | Maf | 431.7 | Syndig1l | 307.7 |
| 74 | Camk4 | 620.4 | Rtn4rl1 | 433.7 | Galnt15 | 308.4 |
| 75 | Unc13c | 620.8 | Barhl2 | 437.6 | Etv1 | 310.1 |
| 76 | Trp53i11 | 624.3 | Kcnk12 | 441.8 | Sh2d1a | 311.9 |
| 77 | Ephb1 | 625.0 | Actl6b | 441.8 | Scn2a | 314.5 |
| 78 | Glb1l3 | 626.9 | AABR07053850.1 | 448.3 | Panx2 | 325.0 |
| 79 | Mdga1 | 627.5 | Sdc1 | 462.0 | Speg | 329.4 |
| 80 | Kcnc1 | 633.0 | Camkk2 | 470.8 | Bsn | 335.6 |
| 81 | Tmem252 | 639.3 | Nudcd3 | 477.6 | Rnfl12 | 335.9 |
| 82 | Mpp7 | 642.2 | Ccdc155 | 490.3 | Il20rb | 343.3 |
| 83 | Hipk4 | 644.6 | Cbfa2t3 | 490.3 | Slc16a10 | 345.5 |
| 84 | Tmem51 | 651.0 | AABR07037151.1 | 494.1 | Ntn4 | 349.9 |
| 85 | Cacnb3 | 665.3 | Etv1 | 499.3 | Adcy1 | 354.5 |
| 86 | Cyb5a | 674.5 | Jph3 | 502.6 | Mapk12 | 357.3 |
| 87 | Tmem2 | 676.2 | Itga11 | 511.4 | Boc | 357.5 |
| 88 | 6430573F11Rik | 677.3 | Rnfl82 | 520.8 | Syt12 | 358.6 |
| 89 | Rasgrp1 | 680.8 | RGD1560784 | 521.9 | Fstl5 | 359.7 |
| 90 | Rab37 | 685.8 | Plcxd3 | 529.7 | Tead4 | 360.2 |
| 91 | Adarb1 | 686.4 | Ablim3 | 543.8 | Clcn1 | 366.2 |
| 92 | Svop | 690.5 | Rims1 | 548.4 | Pde3b | 366.2 |
| 93 | Pgm5 | 694.1 | Nyx | 550.9 | Pgm2l1 | 367.9 |
| 94 | Mthfd1l | 694.4 | Uncx | 551.3 | Tmtc4 | 368.9 |
| 95 | Cdh15 | 695.6 | AABR07034445.1 | 553.6 | Abcc8 | 370.2 |
| 96 | Vwc2 | 696.0 | AABR07025051.3 | 556.7 | Olfm1 | 372.1 |
| 97 | Disp2 | 701.0 | Kcnk10 | 557.2 | Nedd41 | 372.6 |
| 98 | Tspan15 | 713.3 | Kcnk3 | 560.6 | Lurap1 | 379.7 |
| 99 | Slc26a5 | 716.3 | Nol3 | 562.3 | Krt24 | 384.2 |
| 100 | Lhfp | 723.0 | Als2 | 563.2 | Als2 | 385.7 |

Table 20 provides the 100 most specific genes measured by the specificity index (SI) for purkinje cells in human, rat, and mouse samples.

TABLE 20

| | 100 most specific genes measured by SI for each species in purkinje cells | | | |
|---|---|---|---|---|
| Rank | Rat | SI | Mouse | SI |
| 1 | Arhgef33 | 6.0 | Car8 | 5.4 |
| 2 | Car8 | 9.0 | Calb1 | 9.8 |
| 3 | Slc1a6 | 13.0 | Arhgef33 | 10.2 |
| 4 | Calb1 | 25.8 | Atp2a3 | 11.2 |
| 5 | Ppp1r17 | 26.5 | Itpr1 | 16.4 |
| 6 | Itpr1 | 27.2 | Ppp1r17 | 20.6 |
| 7 | Zfp385c | 28.0 | Slc1a6 | 21.1 |
| 8 | Ryr1 | 28.6 | Slc9a3 | 25.4 |
| 9 | AABR07030473.1 | 35.6 | Trpc3 | 30.4 |
| 10 | Slc9a3 | 40.4 | Casq2 | 37.4 |
| 11 | AABR07006713.1 | 45.6 | Clic6 | 40.2 |
| 12 | AABR07006713.2 | 49.2 | plekhd1 | 41.6 |

TABLE 20-continued

| | 100 most specific genes measured by SI for each species in purkinje cells | | | |
|---|---|---|---|---|
| Rank | Rat | SI | Mouse | SI |
| 13 | RGD1561557 | 63.9 | Ryr1 | 44.4 |
| 14 | Gpr63 | 64.5 | Cacna1g | 48.0 |
| 15 | AABR07049491.1 | 70.2 | Pcap2 | 50.5 |
| 16 | AABR07006727.1 | 71.4 | Sycp1 | 51.8 |
| 17 | Plxdc1 | 71.8 | Pde5a | 51.8 |
| 18 | Cep76 | 72.5 | Tspan11 | 52.7 |
| 19 | Fam107b | 77.0 | Gpr63 | 53.5 |
| 20 | B3gnt5 | 81.8 | Nell1 | 58.2 |
| 21 | Far2 | 82.4 | Cep76 | 60.4 |
| 22 | AC108261.1 | 85.2 | Bcl11a | 61.2 |
| 23 | Grid2ip | 85.9 | Grid2ip | 63.8 |
| 24 | AABR07072628.1 | 90.2 | Htr1b | 66.6 |
| 25 | Kcnip1 | 95.9 | Pet100 | 68.6 |
| 26 | AABR07006724.1 | 96.2 | Strip2 | 73.4 |
| 27 | Trpc3 | 96.8 | Plxdc1 | 76.2 |
| 28 | Phka2 | 100.3 | Skor2 | 77.0 |

TABLE 20-continued 100 most specific genes measured by
SI for each species in purkinje cells

| Rank | Rat | SI | Mouse | SI |
|---|---|---|---|---|
| 29 | Car7 | 100.7 | Dagla | 78.0 |
| 30 | Fam117a | 103.0 | Garnl3 | 82.2 |
| 31 | Hes3 | 106.8 | Itpka | 83.1 |
| 32 | Casq2 | 107.0 | Myo10 | 83.6 |
| 33 | Dgkh | 109.5 | Gng13 | 84.6 |
| 34 | Arhgap26 | 112.8 | Kcnip1 | 85.0 |
| 35 | Trabd2b | 114.4 | Trabd2b | 87.5 |
| 36 | Nell1 | 115.7 | Rnf207 | 106.0 |
| 37 | Bcl11a | 116.3 | Scn4b | 108.8 |
| 38 | Col18a1 | 125.9 | Arhgap20 | 113.4 |
| 39 | LOC100125362 | 126.5 | Grip1 | 118.4 |
| 40 | Ptchd4 | 129.8 | Pde9a | 118.5 |
| 41 | Camk2a | 132.5 | Ppp4r4 | 119.9 |
| 42 | Dyrk4 | 132.5 | Cck | 120.0 |
| 43 | Kitlg | 132.6 | Ebf1 | 121.2 |
| 44 | Kcnab1 | 135.5 | Bean1 | 124.5 |
| 45 | Nxnl2 | 135.7 | Tuba8 | 124.5 |
| 46 | Ltk | 137.8 | Smpx | 126.1 |
| 47 | LOC689927 | 138.2 | Ebf2 | 126.2 |
| 48 | AABR07056156.1 | 141.0 | Slc19a1 | 126.5 |
| 49 | Cpne8 | 142.1 | Ccdc85a | 128.4 |
| 50 | Htr1b | 144.4 | Flt3 | 129.9 |
| 51 | AABR07033570.1 | 145.8 | Camk2a | 133.9 |
| 52 | Icmt | 147.6 | Sh2d4b | 142.2 |
| 53 | AABR07047598.1 | 150.8 | Homer3 | 144.5 |
| 54 | Cstf2t | 156.3 | Stk17b | 151.6 |
| 55 | Grik1 | 157.6 | Clec2l | 158.1 |
| 56 | Itpka | 159.9 | Hrh2 | 160.7 |
| 57 | LOC100910996 | 163.9 | Ksr2 | 161.6 |
| 58 | Hpcal1 | 165.7 | Chtf18 | 161.6 |
| 59 | Efna5 | 176.1 | Vax2 | 162.5 |
| 60 | Myo10 | 177.8 | Foxp4 | 162.9 |
| 61 | Rgs8 | 180.8 | Ankrd33b | 166.6 |
| 62 | Skor2 | 182.8 | Cpne9 | 179.2 |
| 63 | Il22 | 183.8 | Corin | 179.6 |
| 64 | Slc12a3 | 186.2 | Il22 | 179.8 |
| 65 | Cpne9 | 188.8 | Prkag3 | 180.8 |
| 66 | AABR07007980.2 | 197.7 | Cep126 | 180.9 |

TABLE 20-continued 100 most specific genes measured by
SI for each species in purkinje cells

| Rank | Rat | SI | Mouse | SI |
|---|---|---|---|---|
| 67 | Cacna1g | 198.1 | Slc20a1 | 182.2 |
| 68 | Doc2b | 198.6 | Akain1 | 185.2 |
| 69 | Sptbn2 | 199.3 | Nrk | 190.6 |
| 70 | LOC108351705 | 207.0 | Pih1h3b | 194.0 |
| 71 | AABR07035926.1 | 209.4 | Inpp5a | 195.2 |
| 72 | AABR07037943.1 | 209.5 | Lhx1 | 196.1 |
| 73 | Pcp2 | 209.5 | Sptbn2 | 196.3 |
| 74 | AABR07061860.1 | 214.6 | Paxbp1 | 203.4 |
| 75 | AABR07024820.1 | 214.9 | Dner | 206.2 |
| 76 | Impg1 | 215.2 | Doc2b | 210.0 |
| 77 | Nkiras2 | 216.4 | Tspoap1 | 210.7 |
| 78 | Krtap12-2 | 217.7 | Gfra2 | 212.9 |
| 79 | Tmem123 | 218.4 | Fhl5 | 214.7 |
| 80 | AABR07044009.1 | 219.9 | Dmd | 215.1 |
| 81 | Ptprr | 221.2 | Kcnab2 | 220.3 |
| 82 | Homer3 | 221.3 | Serinc2 | 220.4 |
| 83 | Garnl3 | 226.4 | Car7 | 230.8 |
| 84 | Sos1 | 228.3 | Dnah6 | 232.8 |
| 85 | Kcnab1 | 230.1 | Prmt8 | 240.0 |
| 86 | Cntn3 | 231.2 | Prkcg | 241.0 |
| 87 | LOC304725 | 236.5 | Mdfi | 243.4 |
| 88 | Stk17b | 236.6 | Dgkh | 244.9 |
| 89 | AABR07047604.1 | 239.1 | Fam117a | 252.5 |
| 90 | Zdhhc23 | 241.9 | Nek2 | 254.9 |
| 91 | Scn4b | 242.1 | Fmnl1 | 259.3 |
| 92 | AC126640.1 | 246.4 | Atl2 | 263.6 |
| 93 | Pde9a | 247.2 | Cfap161 | 263.8 |
| 94 | Ptprb | 251.5 | Lin28b | 267.2 |
| 95 | Prkcg | 257.7 | Cacna2d2 | 267.6 |
| 96 | Pcp4 | 258.1 | Ptchd4 | 269.5 |
| 97 | AABR07056374.1 | 259.1 | Pkp3 | 272.9 |
| 98 | Fstl4 | 262.8 | Shank1 | 278.3 |
| 99 | Ppp4r4 | 262.9 | Grid2 | 278.3 |
| 100 | Nup93 | 264.5 | Nefh | 284.1 |

Table 21 provides the 100 most specific genes measured by the specificity index (SI) for basket cells in human, rat, and mouse samples.

TABLE 21

100 most specific genes measured by SI for each species in basket cells

| Rank | Human | SI | Rat | SI | Mouse | SI |
|---|---|---|---|---|---|---|
| 1 | Bhlhe22 | 44.1 | Plch1 | 74.3 | Adamts15 | 16.6 |
| 2 | March11 | 45.9 | AABR07001734.1 | 145.0 | March11 | 22.6 |
| 3 | Kit | 66.8 | Lypd6 | 176.5 | Tfap2b | 29.8 |
| 4 | Tfap2b | 67.1 | Lama3 | 186.5 | Socs2 | 32.1 |
| 5 | Clmp | 72.3 | March11 | 193.2 | Penk | 33.4 |
| 6 | Lbx1 | 78.4 | Gldc | 194.7 | Bhlhe22 | 56.7 |
| 7 | Slc38a5 | 81.8 | Grm8 | 252.4 | Plch1 | 57.5 |
| 8 | Frmd3 | 92.1 | AABR07047823.1 | 267.2 | Adamts16 | 71.3 |
| 9 | Btbd11 | 103.9 | AABR07001623.1 | 286.7 | Adrb2 | 75.4 |
| 10 | Lipg | 119.4 | Gjd2 | 302.4 | Frmd3 | 77.6 |
| 11 | Rab3b | 154.7 | Arl4a | 334.9 | Clmp | 79.4 |
| 12 | Lrrc38 | 175.1 | AABR07070578.1 | 358.6 | Cacna2d3 | 83.7 |
| 13 | Galnt14 | 186.6 | Hpcal4 | 379.1 | Trpc7 | 84.8 |
| 14 | Cnr1 | 188.6 | AABR07061428.1 | 382.7 | Galnt18 | 99.9 |
| 15 | Tcerg1l | 190.6 | Col12a1 | 384.5 | Tbc1d4 | 104.5 |
| 16 | Cbln2 | 202.0 | Enpp1 | 384.9 | Asgr1 | 106.4 |
| 17 | Siah3 | 208.1 | Sorcs3 | 402.3 | Kit | 106.8 |
| 18 | Stac2 | 220.0 | Clmp | 458.9 | Tfap2a | 123.2 |
| 19 | Scgn | 230.8 | Plk2 | 462.7 | Fam84a | 123.8 |
| 20 | Rspo1 | 233.5 | Arhgef26 | 464.3 | Gjd2 | 124.1 |
| 21 | Lmcd1 | 247.4 | RGD1561667 | 465.7 | Grik3 | 126.0 |
| 22 | Lpl | 248.4 | Asic2 | 518.6 | Lrrc38 | 132.2 |
| 23 | Adra1b | 255.4 | AABR07026472.1 | 520.8 | Chst9 | 137.5 |
| 24 | Gad2 | 256.6 | AC124896.1 | 525.2 | Flrt2 | 138.0 |
| 25 | Chrna3 | 258.7 | Trpc5 | 560.0 | Chac1 | 138.1 |
| 26 | Socs2 | 270.2 | AABR07052084.1 | 577.8 | Grm8 | 140.0 |
| 27 | Trpc6 | 278.1 | AABR07059478.1 | 580.5 | Esrrg | 143.4 |
| 28 | Kcna3 | 294.7 | Kit | 589.1 | Slc6a7 | 147.4 |

TABLE 21-continued

| | | | | | | |
|---|---|---|---|---|---|---|
| | 100 most specific genes measured by SI for each species in basket cells | | | | | |
| Rank | Human | SI | Rat | SI | Mouse | SI |
| 29 | Syn3 | 302.1 | Nt5dc2 | 596.7 | Pla2g4e | 149.4 |
| 30 | Eml5 | 344.4 | AABR07041885.1 | 610.5 | Stac2 | 149.7 |
| 31 | Nefl | 346.5 | Hcn1 | 624.7 | Cabp1 | 151.1 |
| 32 | Fam84a | 353.0 | Skor1 | 630.9 | Phf24 | 155.2 |
| 33 | Trpc5 | 363.0 | Prdm8 | 701.1 | Camk1g | 161.8 |
| 34 | KIAA1644 | 373.4 | Phf24 | 702.1 | Btbd11 | 161.8 |
| 35 | Hrh3 | 376.1 | Esrrg | 704.7 | Stc2 | 172.0 |
| 36 | Disp3 | 378.7 | Grik3 | 706.3 | Sorcs3 | 172.5 |
| 37 | Tfap2a | 433.3 | Bhlhe22 | 720.2 | Lamb1 | 175.7 |
| 38 | Gjd2 | 436.7 | Mir346 | 736.2 | Trpc5 | 201.1 |
| 39 | Adamts2 | 437.1 | Tmem200a | 742.7 | Coro6 | 209.7 |
| 40 | Sorcs3 | 446.6 | AABR07003600.7 | 753.8 | Slc32a1 | 217.8 |
| 41 | Ptprk | 454.0 | Scn9a | 755.6 | Kirrel | 227.8 |
| 42 | Timp3 | 464.6 | Inpp4b | 764.8 | Cdkl1 | 231.3 |
| 43 | Gjb4 | 481.4 | Ace | 773.3 | Chst1 | 231.7 |
| 44 | Ehd3 | 481.7 | Kcna2 | 776.0 | Asns | 236.3 |
| 45 | Cxcl12 | 496.9 | Adra1d | 792.2 | Sp5 | 240.7 |
| 46 | Actc1 | 510.1 | Slc32a1 | 799.8 | Cryba2 | 241.2 |
| 47 | Pnma2 | 511.8 | Cntnap4 | 820.3 | Aldh1l2 | 241.4 |
| 48 | Fam43a | 512.8 | Grid1 | 851.2 | Kcnab3 | 245.8 |
| 49 | Adam11 | 516.7 | Trpc7 | 853.3 | Tg | 253.4 |
| 50 | Dact2 | 522.4 | Begain | 864.8 | Plxna4 | 253.9 |
| 51 | Rgs16 | 524.5 | AABR07049535.3 | 921.5 | Prkcd | 260.1 |
| 52 | Slc5a8 | 527.5 | Frmpd4 | 925.2 | Cgn | 260.1 |
| 53 | Exph5 | 532.6 | Tfap2b | 925.4 | Tcte1 | 262.3 |
| 54 | Cfap221 | 540.5 | Cnr1 | 931.9 | Trim67 | 264.0 |
| 55 | Myo16 | 553.4 | AABR07054088.3 | 988.5 | Osbpl10 | 267.4 |
| 56 | Megf10 | 555.8 | Zcchc16 | 990.2 | Serpini1 | 286.7 |
| 57 | Cacna1d | 557.6 | Trpv6 | 1002.2 | Slc7a1 | 286.8 |
| 58 | Pax2 | 566.6 | Grb10 | 1006.5 | Gpr22 | 293.5 |
| 59 | Efna5 | 575.9 | Pax2 | 1040.2 | Cntn4 | 294.7 |
| 60 | Plch1 | 576.2 | Nrxn3 | 1055.5 | Skor1 | 298.0 |
| 61 | Gabrg2 | 580.3 | Tyms | 1062.3 | Slc7a3 | 300.2 |
| 62 | Prrt4 | 591.2 | Grid1 | 1083.5 | Atp1b1 | 309.4 |
| 63 | Itga5 | 591.5 | Myt1l | 1088.5 | Kcna2 | 318.7 |
| 64 | Sp5 | 593.2 | Disp3 | 1090.4 | Cebpb | 331.8 |
| 65 | Nefm | 599.4 | AABR07063359.1 | 1093.8 | Parm1 | 340.9 |
| 66 | Grik3 | 601.6 | Btn1a1 | 1105.1 | Dock7 | 342.3 |
| 67 | Cx3cl1 | 607.8 | Rn60_10_0565.6 | 1119.6 | Eml5 | 343.5 |
| 68 | Fbxo24 | 613.6 | AABR07041972.1 | 1141.2 | Cnih3 | 355.4 |
| 69 | Lect2 | 615.7 | Osbpl10 | 1155.3 | Asic2 | 358.1 |
| 70 | Nefh | 617.0 | Six4 | 1156.4 | Hpcal4 | 361.8 |
| 71 | Efnb3 | 621.8 | Mir384 | 1164.1 | Adamts2 | 363.9 |
| 72 | Grk3 | 631.3 | Tbc1d4 | 1170.8 | Masp1 | 364.0 |
| 73 | Mpz | 646.3 | Cabp1 | 1177.4 | Plxnc1 | 368.6 |
| 74 | Syt2 | 648.4 | AABR07003600.2 | 1178.2 | Gabrg2 | 368.7 |
| 75 | Scrt1 | 666.5 | AABR07057590.1 | 1204.1 | Mtfp1 | 370.8 |
| 76 | Cdc42ep3 | 670.5 | Adrb2 | 1204.5 | Ntn1 | 373.5 |
| 77 | Trim67 | 670.8 | Cacna1d | 1205.2 | Ret | 377.7 |
| 78 | Grin2b | 683.8 | Plxnc1 | 1213.6 | Zfp423 | 378.3 |
| 79 | Rab3c | 684.3 | Dusp22 | 1214.0 | Nln | 386.1 |
| 80 | Plxna4 | 691.0 | Hecw1 | 1217.7 | Man2a1 | 386.3 |
| 81 | Fzd8 | 708.3 | Gdpd4 | 1224.6 | Neurod6 | 392.1 |
| 82 | Elmod1 | 719.1 | rno-mir-344a-1 | 1234.3 | Grin2d | 396.4 |
| 83 | Smim17 | 728.0 | Lgi2 | 1236.7 | Angptl3 | 404.5 |
| 84 | Slc8a3 | 730.9 | AABR07060291.2 | 1242.9 | Cnr1 | 405.7 |
| 85 | Nrip3 | 745.4 | Adarb2 | 1277.7 | Tmem132e | 405.9 |
| 86 | Plckhg5 | 755.1 | Angpt1 | 1293.6 | Apcdd1 | 428.5 |
| 87 | Arl4a | 762.5 | Rspo4 | 1309.9 | Rasgrf1 | 445.7 |
| 88 | Grm8 | 775.9 | Rn50_7_1158.3 | 1318.3 | Hcn1 | 453.2 |
| 89 | Cntnap5a | 784.2 | Dcx | 1338.4 | Scnn1g | 459.4 |
| 90 | Maats1 | 803.4 | AABR07065531.31 | 1338.5 | Ly6e | 462.4 |
| 91 | Loxl2 | 805.6 | Onecut1 | 1338.7 | Pax2 | 462.6 |
| 92 | Arap3 | 810.3 | Mkx | 1367.1 | Rab3c | 469.8 |
| 93 | Dex | 825.0 | Rgs4 | 1374.8 | Rph3a | 473.7 |
| 94 | Nyap2 | 837.7 | Kcnc2 | 1403.0 | Rai2 | 475.5 |
| 95 | Skor1 | 844.3 | Hgf | 1404.5 | Gad2 | 475.7 |
| 96 | Pvalb | 846.0 | Fgf13 | 1408.7 | Mpp7 | 477.2 |
| 97 | Ppm1j | 848.4 | Itga8 | 1410.0 | Arl4a | 483.3 |
| 98 | Slc5a4a | 851.9 | AABR07070578.2 | 1421.3 | Igsf3 | 486.3 |
| 99 | Tmem132e | 852.0 | Apcdd1 | 1434.5 | Tmem179 | 502.4 |
| 100 | Cygb | 874.9 | Trim15 | 1449.8 | Sorbs2 | 506.1 |

Table 22 provides the 100 most specific genes measured by the specificity index (SI) for astrocytes in human, rat, and mouse samples.

TABLE 22

100 most specific genes measured by
SI for each species in astrocytes

| Rank | Human | SI | Rat | SI | Mouse | SI |
|---|---|---|---|---|---|---|
| 1 | S1pr1 | 57.5 | AABR07070161.1 | 23.8 | Gdf10 | 9.0 |
| 2 | Gja1 | 127.7 | Itih3 | 25.4 | Slc1a3 | 14.8 |
| 3 | Lgi4 | 141.6 | Gdf10 | 37.4 | Fxyd1 | 18.8 |
| 4 | Efemp1 | 142.2 | Gli1 | 50.6 | Dao | 19.2 |
| 5 | Etnppl | 163.0 | Slc25a18 | 75.8 | A2m | 21.8 |
| 6 | Aqp4 | 170.3 | Nkain4 | 96.0 | Lfng | 23.3 |
| 7 | Rgma | 170.3 | Tnc | 105.4 | Lgi4 | 23.6 |
| 8 | Lgr6 | 176.2 | Msx2 | 108.8 | Mybpc1 | 27.6 |
| 9 | Lcat | 179.9 | S1pr1 | 117.4 | Cdc42ep4 | 29.0 |
| 10 | Tril | 181.4 | Slc7a10 | 120.6 | Slco4a1 | 29.8 |
| 11 | Serpini2 | 181.6 | Aqp9 | 127.8 | Fam20a | 33.0 |
| 12 | Pgghg | 192.3 | Mt2A | 139.2 | Lcat | 33.4 |
| 13 | Slc1a3 | 198.8 | Lgi4 | 140.0 | Acot11 | 33.8 |
| 14 | Gfap | 208.4 | Pou3f2 | 142.7 | Vim | 36.2 |
| 15 | Aldh1a1 | 219.0 | Id4 | 143.4 | Nwd1 | 36.2 |
| 16 | Pla2g5 | 222.3 | Cacng5 | 145.2 | S1pr1 | 38.8 |
| 17 | Fxyd1 | 228.9 | Cyp2d5 | 146.4 | Tnc | 42.4 |
| 18 | Wdr49 | 244.4 | AABR07058658.1 | 147.0 | Rbm24 | 43.3 |
| 19 | Gli1 | 248.8 | AABR07070161.6 | 148.4 | Acsbg1 | 43.6 |
| 20 | Nfatc4 | 249.7 | Lfng | 158.0 | Ntsr2 | 45.0 |
| 21 | Scara3 | 251.9 | AABR07070161.3 | 165.5 | Prex2 | 47.2 |
| 22 | Slc4a4 | 255.7 | Fam107a | 169.5 | Cables1 | 47.4 |
| 23 | Lama2 | 255.8 | Nat8f3 | 171.2 | Gli1 | 55.2 |
| 24 | Cdc42ep4 | 260.4 | Ctxn3 | 173.3 | Etnppl | 56.8 |
| 25 | Gabrg3 | 263.9 | Aldh1l1 | 184.8 | Pla2g7 | 63.6 |
| 26 | P2ry1 | 273.0 | Entpd2 | 188.5 | Phkg1 | 64.0 |
| 27 | Gabra2 | 274.6 | Rbm24 | 218.2 | Nhsl1 | 69.9 |
| 28 | Colec12 | 276.1 | Slc1a3 | 221.2 | Slc14a1 | 74.5 |
| 29 | Mlc1 | 280.6 | Mlc1 | 223.3 | Plekho2 | 75.4 |
| 30 | Slc7a11 | 285.4 | Cxcl14 | 224.2 | Gjb6 | 76.2 |
| 31 | Aldh1l1 | 312.5 | Hif3a | 232.5 | Plce1 | 76.4 |
| 32 | Sox9 | 314.6 | Fxyd1 | 235.7 | Itih3 | 79.2 |
| 33 | Lgals3 | 323.2 | Acsbg1 | 242.4 | Sdc4 | 83.0 |
| 34 | Mgst1 | 323.4 | AABR07070161.7 | 254.2 | Mertk | 83.0 |
| 35 | Gatsl3 | 339.8 | Notch3 | 267.2 | Prr5 | 101.7 |
| 36 | Ahnak | 341.2 | Il33 | 271.9 | Sparcl1 | 102.9 |
| 37 | Pipox | 364.0 | Nwd1 | 273.5 | Id4 | 103.3 |
| 38 | Rhoj | 376.4 | Cdc42ep4 | 295.1 | Mlc1 | 105.8 |
| 39 | Arhgef26 | 393.6 | Samd9l | 296.6 | Pax3 | 106.2 |
| 40 | Arhgef28 | 397.4 | Gabrb1 | 300.9 | Gpr153 | 106.8 |
| 41 | Srpx | 400.0 | Plpp3 | 305.7 | Abi3bp | 111.5 |
| 42 | Mt3 | 404.0 | Cxcr4 | 308.9 | Pltp | 115.9 |
| 43 | Atp1a2 | 414.4 | Rgma | 309.7 | Fxyd7 | 119.1 |
| 44 | Fxyd7 | 415.7 | Itm2a | 311.7 | Rpusd3 | 120.4 |
| 45 | Lfng | 416.9 | Ednrb | 311.8 | Aqp4 | 121.0 |
| 46 | Lamb2 | 422.3 | Pdlim4 | 325.1 | Igdcc3 | 122.6 |
| 47 | Gdf10 | 426.5 | Sgca | 327.4 | Fgfr3 | 122.6 |
| 48 | F3 | 439.4 | Sncaip | 333.7 | Mt3 | 123.0 |
| 49 | Sdc4 | 441.6 | Prodh1 | 336.7 | Atp1a2 | 128.8 |
| 50 | Hspb1 | 449.9 | Agt | 348.6 | Gabrb1 | 129.0 |

TABLE 22-continued 100 most specific genes measured by
SI for each species in astrocytes

| Rank | Human | SI | Rat | SI | Mouse | SI |
|---|---|---|---|---|---|---|
| 51 | Hes1 | 451.9 | Slc14a1 | 350.2 | Ndrg2 | 129.9 |
| 52 | Slc12a4 | 453.2 | AABR07032343.1 | 351.5 | Ucp2 | 130.9 |
| 53 | Mertk | 457.0 | AABR07035782.1 | 356.5 | Plpp3 | 131.9 |
| 54 | C3 | 477.4 | Marc1 | 360.7 | Frem1 | 134.2 |
| 55 | AI464131 | 480.5 | Fgfr3 | 360.7 | Elovl2 | 141.3 |
| 56 | Id4 | 481.7 | AABR07070161.5 | 368.5 | Gli2 | 143.6 |
| 57 | Vit | 483.1 | AC109886.1 | 368.8 | Efhd2 | 144.8 |
| 58 | Fjx1 | 483.1 | Prr5 | 371.1 | Zic4 | 147.8 |
| 59 | Ccdc80 | 495.9 | Aqp4 | 383.9 | Oplah | 149.6 |
| 60 | Adora2b | 498.3 | Plekho2 | 388.7 | Cxcl14 | 150.0 |
| 61 | Ryr3 | 503.0 | AABR07035780.2 | 393.0 | Mfge8 | 154.3 |
| 62 | Mfge8 | 506.7 | Sh3b2 | 393.0 | Sox9 | 154.8 |
| 63 | Plekho2 | 510.4 | F3 | 415.7 | Atp13a4 | 155.0 |
| 64 | Elovl2 | 510.7 | Sparcl1 | 423.3 | AI464131 | 156.0 |
| 65 | Fam179a | 514.1 | Eva1a | 425.7 | Pdlim4 | 157.0 |
| 66 | Cebpb | 514.9 | Pltp | 425.8 | Rfx4 | 167.4 |
| 67 | Acss1 | 520.1 | Gfap | 427.0 | Traf1 | 168.9 |
| 68 | Slc13a5 | 530.2 | Cyp2d4 | 428.3 | Dmp1 | 171.7 |
| 69 | Ednrb | 533.0 | Crlf1 | 458.7 | Gabra4 | 172.8 |
| 70 | Pltp | 536.7 | Sdc4 | 477.1 | Gja1 | 173.3 |
| 71 | Il33 | 541.5 | Sod3 | 480.6 | Etv4 | 175.3 |
| 72 | Tlr4 | 561.8 | Dao | 482.7 | Map2k6 | 176.4 |
| 73 | Fam198b | 568.0 | Chst1 | 492.9 | Wwc1 | 177.2 |
| 74 | Isyna1 | 570.9 | AABR07001555.1 | 504.1 | Syt10 | 177.4 |
| 75 | Glis3 | 575.8 | AABR07063346.1 | 504.2 | Sparc | 177.6 |
| 76 | Dao | 577.5 | Mpp6 | 507.6 | Tril | 178.1 |
| 77 | Fgfr3 | 577.9 | Ptch2 | 509.2 | Slc25a18 | 184.1 |
| 78 | Ncan | 579.8 | AABR07031767.1 | 522.7 | Aldh1l1 | 185.4 |
| 79 | Msx2 | 580.5 | AC105604.1 | 537.0 | Eva1a | 186.6 |
| 80 | Spatc1 | 582.3 | Grin2b | 537.6 | Mxra8 | 187.1 |
| 81 | Pdgfrb | 585.9 | Pygm | 547.1 | Lgr6 | 190.6 |
| 82 | Tubb2b | 587.6 | Etnppl | 558.8 | Rgma | 191.5 |
| 83 | Fat3 | 592.8 | Slc15a2 | 586.7 | Egfr | 197.6 |
| 84 | Fam167a | 593.1 | Casp4 | 588.1 | Slc39a12 | 198.8 |
| 85 | Col22a1 | 605.2 | Gria1 | 589.6 | Slc8b1 | 200.0 |
| 86 | Tcf7l1 | 611.9 | Slc4a4 | 598.0 | Glipr2 | 200.6 |
| 87 | Ndrg2 | 614.1 | Camk2g | 599.5 | Axl | 201.7 |
| 88 | Nhsl1 | 617.4 | Cbs | 603.8 | Aass | 202.3 |
| 89 | Ddit41 | 622.4 | AABR07035175.1 | 612.4 | Hk2 | 205.0 |
| 90 | Pbxip1 | 627.8 | Ntsr2 | 630.0 | Itpkb | 217.6 |
| 91 | Rasl12 | 633.6 | Gja1 | 649.2 | Ramp2 | 226.7 |
| 92 | Sh3bp2 | 641.8 | Aspg | 650.3 | Pyroxd2 | 227.8 |
| 93 | Aplnr | 646.7 | Sfxn5 | 664.4 | Gabra2 | 230.8 |
| 94 | Robo3 | 655.7 | Ccbe1 | 665.0 | Tcf7l1 | 232.2 |
| 95 | Rubcnl | 660.6 | Ahnak | 675.9 | Garem2 | 232.4 |
| 96 | Rab34 | 663.3 | Gramd3 | 677.4 | Wnt6 | 232.6 |
| 97 | Gtf2a1l | 665.6 | Ndrg2 | 682.1 | Dfna5 | 234.6 |
| 98 | Fgfr2 | 669.5 | Mt3 | 695.1 | Fam92b | 236.3 |
| 99 | Kank2 | 673.4 | Shroom3 | 708.7 | Plxnb1 | 238.0 |
| 100 | Rfx4 | 680.3 | Myh11 | 709.7 | Vamp1 | 239.3 |

Table 23 provides the 100 most specific genes measured by the specificity index (SI) for oligodendrocytes in human, rat, and mouse samples.

TABLE 23

100 most specific genes measured by SI for each species in oligodendrocytes

| Rank | Human | SI | Rat | SI | Mouse | SI |
|---|---|---|---|---|---|---|
| 1 | Klk6 | 46.1 | Mog | 51.6 | Gpr37 | 26.2 |
| 2 | Mog | 46.9 | Opalin | 60.4 | Pex5l | 28.8 |
| 3 | Gldn | 53.3 | Mobp | 62.8 | Hapln2 | 38.6 |
| 4 | Cndp1 | 61.5 | Tmem63a | 65.0 | Apod | 42.8 |
| 5 | Gm20425 | 64.6 | AABR07006310.1 | 76.5 | Ermn | 45.6 |
| 6 | Tmem98 | 73.2 | Hapln2 | 93.3 | Prr5l | 49.8 |
| 7 | Slc5a11 | 80.3 | Klk6 | 101.0 | Aspa | 57.4 |
| 8 | Mag | 80.5 | Qdpr | 101.5 | Efnb3 | 57.4 |
| 9 | Carns1 | 87.2 | Selplg | 110.6 | Anln | 59.2 |
| 10 | Gpr37 | 91.8 | Cldn11 | 111.9 | Mog | 63.0 |
| 11 | Cdk18 | 98.2 | Mal | 112.9 | Plp1 | 63.2 |
| 12 | Hhatl | 101.9 | Ermn | 113.1 | Plekhh1 | 67.7 |

TABLE 23-continued 100 most specific genes measured by SI for each species in oligodendrocytes

| Rank | Human | SI | Rat | SI | Mouse | SI |
|---|---|---|---|---|---|---|
| 13 | Anln | 107.8 | AABR07046961.1 | 113.4 | Tmem63a | 72.8 |
| 14 | Enpp2 | 114.4 | Abi3 | 122.8 | Il33 | 77.7 |
| 15 | Folh1 | 134.1 | Gpr37 | 126.0 | D7Ertd443e | 79.4 |
| 16 | Sec14l5 | 135.6 | Tmem88b | 133.2 | Sec14l5 | 81.8 |
| 17 | Myrf | 138.4 | Rasgrp3 | 137.6 | Carns1 | 92.8 |
| 18 | Plp1 | 160.3 | Prr5l | 138.4 | Tnfaip6 | 101.2 |
| 19 | Mal | 176.8 | Slc5a11 | 141.9 | Galnt6 | 101.4 |
| 20 | Gjb1 | 186.0 | Mag | 146.4 | Galnt5 | 102.6 |
| 21 | Itga2 | 189.8 | LOC100362909 | 150.9 | Ndrg1 | 103.5 |
| 22 | Cpm | 192.6 | Tmem176b | 157.1 | Cldn11 | 104.5 |
| 23 | Plpp2 | 212.3 | LOC100302465 | 157.2 | Gjc2 | 106.0 |
| 24 | Cntn2 | 214.9 | Cx3cr1 | 157.3 | Pla2g16 | 107.2 |
| 25 | Ermn | 215.9 | Ctss | 160.2 | Fth1 | 115.0 |
| 26 | Opalin | 227.7 | Carns1 | 172.2 | Opalin | 117.4 |
| 27 | Abca8b | 247.1 | Tmem125 | 174.1 | Car2 | 120.0 |
| 28 | Lpar1 | 256.3 | Tmem176a | 175.1 | Dock5 | 122.0 |
| 29 | Pld1 | 256.8 | Sec14l5 | 180.4 | Gm20425 | 122.1 |
| 30 | Sall1 | 274.5 | Tf | 183.4 | Sall1 | 122.2 |
| 31 | Cercam | 278.1 | C1qb | 188.6 | Pkd2l1 | 125.4 |
| 32 | Dock5 | 286.4 | Apod | 194.8 | Kcnk13 | 126.3 |
| 33 | Pi16 | 288.8 | S1pr5 | 195.5 | Ppp1r14a | 127.8 |
| 34 | Man2a1 | 296.5 | Rn60_5_1374.5 | 198.4 | Gatm | 128.6 |
| 35 | Pex5l | 298.2 | Plp1 | 211.2 | Serpinb1a | 138.0 |
| 36 | Tmem63a | 321.4 | Insc | 215.2 | Pde8a | 144.8 |
| 37 | Tmem125 | 321.7 | Mbp | 217.2 | Tnni1 | 145.2 |
| 38 | Gipr | 321.7 | Pls1 | 224.1 | Glul | 147.3 |
| 39 | Sh3tc2 | 331.4 | Tmem98 | 232.3 | Tmprss5 | 150.4 |
| 40 | D7Ertd443e | 364.8 | Anln | 234.5 | Nipal4 | 151.2 |
| 41 | Kel | 365.2 | Ndrg1 | 240.0 | Trim59 | 151.2 |
| 42 | Ldb3 | 371.4 | Pafah1B1 | 248.8 | Mal | 151.3 |
| 43 | Cede152 | 377.2 | Pex5l | 249.9 | Slc12a2 | 151.3 |
| 44 | Cldn11 | 383.2 | LOC361016 | 250.0 | Qdpr | 156.9 |
| 45 | Synj2 | 385.8 | Galnt6 | 253.9 | Litaf | 160.3 |
| 46 | Lrp2 | 401.5 | Trim36 | 258.7 | Gjb1 | 160.3 |
| 47 | Ninj2 | 405.0 | AABR07017693.1 | 262.2 | Edil3 | 162.6 |
| 48 | Psrc1 | 406.3 | Gpatch4 | 271.2 | Pls1 | 166.8 |
| 49 | Ndrg1 | 406.3 | Plekhg3 | 274.9 | Mboat1 | 167.0 |
| 50 | Actn2 | 409.5 | Hamp | 281.3 | St6galnac3 | 168.0 |
| 51 | Sgk2 | 412.8 | Csf1r | 293.7 | Gng11 | 173.1 |
| 52 | Trim59 | 423.5 | Gjc2 | 295.1 | Enpp2 | 178.6 |
| 53 | Plekhg3 | 432.5 | Car14 | 295.7 | Cpm | 180.2 |
| 54 | Larp6 | 434.5 | Trim59 | 297.5 | Pstpip2 | 181.9 |
| 55 | Slc45a3 | 438.4 | AABR07053870.1 | 299.1 | Trim36 | 186.4 |
| 56 | Cnp | 444.0 | Gpr84 | 300.0 | Klk6 | 188.7 |
| 57 | Col4a5 | 446.8 | Plekhh1 | 302.4 | Myo1d | 189.6 |
| 58 | Pde8a | 449.1 | Ghr | 310.7 | Tmem98 | 192.2 |
| 59 | Rhobtb1 | 464.7 | Kndc1 | 311.3 | Synj2 | 197.4 |
| 60 | D16Ertd472e | 479.6 | Slco2b1 | 316.5 | 4933413G19Rik | 197.8 |
| 61 | Qdpr | 482.2 | Cd74 | 323.5 | Mag | 200.1 |
| 62 | Enpp6 | 483.0 | Aspa | 323.5 | Insc | 200.3 |
| 63 | Rhou | 484.6 | Trpv3 | 327.0 | Pigh | 201.6 |
| 64 | Sema3c | 487.5 | AABR07008030.1 | 335.2 | Pik3c2b | 204.7 |
| 65 | Gsn | 489.1 | Aplp1 | 336.1 | Ninj2 | 206.0 |
| 66 | Cyr61 | 491.6 | Tgfbr2 | 345.9 | Trpv3 | 209.8 |
| 67 | Capn3 | 501.9 | Gjb1 | 346.6 | Car14 | 213.4 |
| 68 | Hoxd1 | 504.8 | Ptp4a3 | 347.0 | Tmem125 | 220.7 |
| 69 | Frmd4b | 507.5 | Prima1 | 347.3 | Map7 | 220.8 |
| 70 | Tmem144 | 509.9 | Pik3c2b | 347.6 | Cdk18 | 221.6 |
| 71 | Galnt6 | 510.0 | AABR07036035.1 | 359.6 | Depdc7 | 223.7 |
| 72 | Pkmyt1 | 515.5 | Sall1 | 371.4 | Aatk | 227.7 |
| 73 | Fbxo32 | 527.0 | Plpp2 | 373.1 | Myrf | 227.8 |
| 74 | Pla2g16 | 531.3 | Pld4 | 375.5 | Cnp | 232.2 |
| 75 | Dpyd | 534.7 | Fam102b | 380.4 | Stmn4 | 232.6 |
| 76 | Sh3gl3 | 540.0 | Cd33 | 381.2 | Chdh | 237.7 |
| 77 | Prima1 | 544.8 | Cdkn1a | 383.3 | Nek4 | 244.3 |
| 78 | Rasal1 | 545.0 | Nkd1 | 383.4 | Frmd4b | 250.7 |
| 79 | Fa2h | 549.9 | Elovl7 | 384.3 | Ugt8a | 253.3 |
| 80 | Fam124a | 556.2 | Piga | 384.7 | Palm2 | 256.3 |
| 81 | Treh | 562.6 | Inf2 | 385.2 | Arsg | 258.0 |
| 82 | Paqr4 | 568.8 | Blnk | 386.1 | Ccdc152 | 258.1 |
| 83 | Azgp1 | 573.6 | Enpp4 | 387.5 | Efemp1 | 258.4 |
| 84 | Plekhh1 | 586.8 | Il18 | 394.1 | Piga | 261.4 |
| 85 | Dapk2 | 588.8 | Spata13 | 398.7 | Rftn1 | 262.5 |
| 86 | Knop1 | 589.4 | Mettl7a | 401.6 | Itgb4 | 263.0 |
| 87 | Sema3b | 590.9 | Inpp5d | 402.1 | Emilin2 | 263.6 |
| 88 | Elovl1 | 593.8 | Myrf | 402.3 | Enpp4 | 263.7 |

TABLE 23-continued

| Rank | Human | SI | Rat | SI | Mouse | SI |
|---|---|---|---|---|---|---|
| | 100 most specific genes measured by SI for each species in oligodendrocytes | | | | | |
| 89 | Shroom4 | 611.7 | Gjc3 | 404.5 | Nkain2 | 265.5 |
| 90 | Car2 | 615.4 | Trim2 | 419.0 | Adamtsl4 | 268.0 |
| 91 | Necab1 | 616.2 | AABR07012039.1 | 431.2 | Hcn2 | 272.8 |
| 92 | Aspa | 620.2 | AABR07033887.1 | 431.8 | Plxnb3 | 273.8 |
| 93 | Gab1 | 623.3 | Enpp2 | 432.4 | Dpy19l1 | 274.9 |
| 94 | Kif6 | 637.3 | Pacs2 | 432.4 | Arhgap23 | 276.5 |
| 95 | Hhip | 644.8 | C1qa | 435.7 | Prima1 | 280.8 |
| 96 | Ugt8a | 648.8 | Trem2 | 441.0 | Gipr | 281.5 |
| 97 | Iqgap1 | 653.5 | Slc45a3 | 441.1 | Sh3tc2 | 284.0 |
| 98 | Map6d1 | 656.7 | Hhip | 447.3 | Tubb4a | 285.4 |
| 99 | Eln | 658.9 | Anxa3 | 450.9 | Map6d1 | 285.8 |
| 100 | Pllp | 662.4 | AABR07022098.1 | 451.6 | Kctd13 | 286.9 |

Table 24 provides the 100 most specific genes measured by the specificity index (SI) for OPCs in human, rat, and mouse samples.

TABLE 24

| Rank | Human | SI | Rat | SI | Mouse | SI |
|---|---|---|---|---|---|---|
| | 100 most specific genes measured by SI for each species in OPCs | | | | | |
| 1 | Fermt1 | 102.7 | Fam89a | 22.2 | Neu4 | 5.4 |
| 2 | Lims2 | 151.6 | Pdgfra | 57.3 | C1ql1 | 16.4 |
| 3 | C1ql1 | 191.5 | RGD1561849 | 78.4 | Ppfibp1 | 25.6 |
| 4 | Sstr1 | 232.5 | Rlbp1 | 80.4 | 3110035E14Rik | 28.2 |
| 5 | Olig1 | 233.0 | Ccnd1 | 81.8 | Pdgfra | 29.0 |
| 6 | Bambi | 238.9 | Tmem255b | 94.6 | Rgcc | 35.4 |
| 7 | Usp43 | 254.1 | C1ql1 | 102.0 | Susd5 | 37.2 |
| 8 | B3gnt7 | 258.0 | Bgn | 110.2 | Itga9 | 50.2 |
| 9 | Pdgfra | 305.9 | Itga9 | 114.3 | Tes | 52.6 |
| 10 | C1ql2 | 311.3 | Ppfibp1 | 119.3 | Rprm | 55.6 |
| 11 | Olig2 | 311.7 | Snx22 | 123.4 | Rep15 | 59.5 |
| 12 | Fmo3 | 316.6 | Col5a3 | 127.1 | Cspg4 | 82.7 |
| 13 | Cspg5 | 351.8 | Pmel | 137.6 | Matn4 | 84.2 |
| 14 | Galr1 | 353.8 | Cav1 | 146.7 | Amz1 | 94.8 |
| 15 | Gpc2 | 374.2 | Serpine2 | 153.4 | 1810041L15Rik | 103.0 |
| 16 | Fibin | 400.1 | Cspg4 | 155.4 | Pxdc1 | 106.0 |
| 17 | Cspg4 | 407.8 | Lims2 | 168.2 | Tox3 | 109.6 |
| 18 | Col11a1 | 428.5 | AABR07052897.1 | 177.0 | Sh3bp4 | 115.3 |
| 19 | Bche | 434.9 | C1ql2 | 189.5 | Elfn1 | 117.8 |
| 20 | Col9a1 | 451.3 | Cdk2 | 193.4 | Galnt3 | 121.9 |
| 21 | Afap1l2 | 475.4 | AABR07010022.1 | 195.6 | Lmcd1 | 123.8 |
| 22 | Cldn1 | 475.7 | Cacng4 | 197.2 | Serpine2 | 124.4 |
| 23 | Plpp4 | 476.0 | Matn4 | 202.8 | C1ql2 | 131.0 |
| 24 | Sox13 | 484.6 | AABR07049948.1 | 203.2 | Neto1 | 140.6 |
| 25 | Plat | 492.1 | Susd5 | 214.6 | Grm5 | 141.2 |
| 26 | Neu4 | 517.4 | Prkg2 | 215.3 | Mmp2 | 145.0 |
| 27 | D630023F18Rik | 517.4 | Pxdc1 | 219.9 | Col11a2 | 155.3 |
| 28 | Col20a1 | 545.7 | RGD1566029 | 225.7 | Sema3d | 157.6 |
| 29 | Pxylp1 | 555.5 | AABR07003304.1 | 248.3 | Lims2 | 160.3 |
| 30 | Asic4 | 559.7 | Sapcd2 | 262.0 | Cav1 | 186.5 |
| 31 | Spsb4 | 562.5 | Cspg5 | 263.0 | Sapcd2 | 187.0 |
| 32 | Prelp | 584.2 | Mmp15 | 267.8 | Rcn1 | 191.6 |
| 33 | Gpr34 | 596.3 | Rgcc | 295.4 | Ptpro | 201.9 |
| 34 | Best3 | 598.0 | Slc22a6 | 298.1 | Ccnd1 | 205.9 |
| 35 | Stk32b | 600.2 | Sema5b | 306.6 | Ptgfrn | 207.0 |
| 36 | Akr1c14 | 600.2 | Qprt | 307.6 | Ncan | 210.5 |
| 37 | Susd5 | 604.3 | Pnlip | 309.2 | 5730559C18Rik | 210.6 |
| 38 | Ophn1 | 607.5 | Slc6a12 | 312.6 | Lpcat2 | 239.8 |
| 39 | Mmp16 | 613.8 | RGD1311892 | 315.7 | Olig2 | 247.2 |
| 40 | Sulf2 | 629.8 | AABR07003306.1 | 316.5 | Fhl3 | 248.8 |
| 41 | Prkg2 | 630.9 | AABR07044671.1 | 319.5 | Tspan6 | 260.3 |
| 42 | Tns3 | 635.8 | Rbpjl | 324.7 | Rin2 | 265.0 |
| 43 | B3galt4 | 640.7 | Chst5 | 348.3 | Ascl1 | 267.2 |
| 44 | Fgfbp3 | 643.2 | Traf4 | 352.3 | Basp1 | 273.1 |
| 45 | Nkain3 | 648.2 | Sox6 | 359.3 | Pmepa1 | 279.3 |
| 46 | Ntn1 | 663.5 | Cox6b2 | 360.5 | Fzd9 | 280.1 |
| 47 | Ascl1 | 677.9 | Pcdh15 | 362.2 | Fam114a1 | 281.9 |
| 48 | Sema5a | 689.3 | Cd101 | 371.9 | Abhd2 | 285.7 |
| 49 | Hrasls | 692.5 | Xylt1 | 372.0 | Ctxn1 | 294.4 |
| 50 | Gal3st4 | 710.2 | AABR07003304.2 | 374.2 | Cspg5 | 295.7 |

TABLE 24-continued

| Rank | Human | SI | Rat | SI | Mouse | SI |
|------|-------|-----|-----|-----|-------|-----|
| 51 | Ebf4 | 717.7 | Calcrl | 379.6 | Cfap20 | 296.7 |
| 52 | Tmem132d | 723.2 | Col1a1 | 387.2 | Vwc2 | 311.3 |
| 53 | Nt5e | 729.2 | Lama4 | 388.6 | Cdo1 | 318.0 |
| 54 | Jag1 | 739.1 | Elfn1 | 388.8 | Cdh13 | 325.1 |
| 55 | Megf11 | 744.4 | Ampd3 | 391.3 | Marcks | 338.1 |
| 56 | Ildr2 | 749.1 | Fam212b | 422.4 | Gsx1 | 342.0 |
| 57 | Plppr1 | 754.8 | Slc6a13 | 428.6 | Sertm1 | 342.1 |
| 58 | Dec | 768.5 | Sstr1 | 438.3 | Slc1a1 | 345.6 |
| 59 | Ntn4 | 768.7 | Sema3d | 442.1 | Matn1 | 349.0 |
| 60 | Sox6 | 769.4 | AC141997.1 | 449.4 | Has2 | 351.8 |
| 61 | Cacng4 | 775.0 | Cpne7 | 463.5 | Lama4 | 353.2 |
| 62 | Pxdn | 776.4 | Ptgfrn | 474.4 | Mycl | 358.0 |
| 63 | Sapcd2 | 777.9 | Wbscr28 | 489.9 | Klhl5 | 358.7 |
| 64 | Tnk2 | 798.9 | Ryr3 | 500.5 | Kcnh5 | 372.5 |
| 65 | Slc43a3 | 803.9 | Gpsm2 | 503.1 | Kcnh8 | 382.4 |
| 66 | Adamts6 | 807.1 | Neto1 | 507.6 | Sema5a | 385.3 |
| 67 | Vsig8 | 813.6 | Chst11 | 510.1 | Enpp6 | 386.3 |
| 68 | Itm2a | 816.8 | Slc22a8 | 512.0 | Slc5a7 | 392.1 |
| 69 | Marcksl1 | 816.9 | Pstpip2 | 520.2 | Cav2 | 396.0 |
| 70 | Alk | 835.0 | AABR07044668.1 | 524.1 | Lbh | 404.3 |
| 71 | Smoc1 | 835.8 | Bcas1 | 525.4 | Adm | 413.2 |
| 72 | Cacna2d3 | 848.6 | Igf2 | 527.8 | Adam12 | 414.2 |
| 73 | Tm4sf1 | 853.5 | Lbh | 528.3 | S100a4 | 416.2 |
| 74 | Bgn | 863.3 | Olfm2 | 531.1 | Mfsd2a | 425.5 |
| 75 | Pdgfc | 870.5 | Ndnf | 534.1 | Igfbp3 | 431.9 |
| 76 | Atp2c2 | 871.7 | Vstm2b | 537.2 | Midn | 433.5 |
| 77 | Aldh1a3 | 871.8 | AABR07058656.1 | 548.8 | Asap3 | 436.2 |
| 78 | Prrx1 | 881.5 | Rep15 | 549.5 | Prkg2 | 437.4 |
| 79 | Meis3 | 887.1 | Vtn | 555.5 | Rlbp1 | 445.0 |
| 80 | Cxxc4 | 891.0 | Eln | 565.4 | Abcg2 | 445.1 |
| 81 | Cd27 | 905.0 | Ramp1 | 566.8 | Vstm2b | 448.6 |
| 82 | Sema3e | 908.3 | Pmepa1 | 568.8 | Dock6 | 469.2 |
| 83 | Adamts17 | 908.4 | Gpnmb | 571.7 | Fbn1 | 471.8 |
| 84 | Akr1c20 | 916.6 | Ptpro | 572.9 | Frrs1 | 472.3 |
| 85 | Arhgap10 | 925.8 | Limd1 | 590.0 | Khdrbs3 | 483.8 |
| 86 | Crispld2 | 926.6 | Cdh13 | 590.2 | Slitrk6 | 490.0 |
| 87 | Sipa1l2 | 941.5 | Nrxn2 | 590.7 | Chst11 | 496.4 |
| 88 | Ppp1r36 | 946.5 | Mgp | 597.2 | Ptpn14 | 498.3 |
| 89 | Gng12 | 947.1 | Myt1 | 597.4 | Dpysl3 | 500.6 |
| 90 | Syt17 | 955.8 | Marcks | 600.0 | Slc44a5 | 501.3 |
| 91 | Midn | 964.5 | LOC100362216 | 600.7 | Eya1 | 501.7 |
| 92 | Gadd45a | 965.6 | AABR07043601.4 | 601.9 | Sox6 | 503.8 |
| 93 | Khdrbs3 | 969.5 | LOC102553018 | 609.8 | Phox2a | 504.8 |
| 94 | Thbs4 | 971.6 | Masp1 | 623.4 | Col11a1 | 506.2 |
| 95 | Vipr2 | 971.8 | Sulf2 | 627.7 | Swap70 | 510.3 |
| 96 | Ccnd1 | 978.9 | Tle6 | 628.9 | Fam89a | 514.6 |
| 97 | Iffo1 | 981.5 | Fam114a1 | 629.9 | Mrm2 | 515.3 |
| 98 | Atoh8 | 988.8 | Tmem100 | 633.1 | Lypd1 | 517.5 |
| 99 | Exosc4 | 989.8 | Ccnd2 | 635.5 | Shisa7 | 519.5 |
| 100 | Pde7b | 992.5 | Rasgef1b | 640.5 | Pcdh17 | 519.7 |

The rank of the 100 most specific genes was compared for each cell type in mouse with their ranks in rat or human as shown in Table 25.

TABLE 25

Comparision of the ranking of the top 100 most specific genes in mice

| mouse | Astrocytes | | Basket | | Granule | | Oligodendrocytes | | OPC | | Purkinje |
|-------|-----|-------|-----|-------|-----|-------|-----|-------|-----|-------|-----|
| | rat | human | rat | human | rat | human | rat | human | rat | human | rat |
| 1 | 1 | 47 | 264 | 4357 | 15 | 70 | 45 | 10 | 600 | 27 | 1 |
| 2 | 12 | 13 | 2 | 2 | 37 | 265 | 26 | 35 | 1 | 3 | 6 |
| 3 | 20 | 17 | 126 | 4 | 7 | 13 | 29 | 104 | 13 | 227 | 2 |
| 4 | 28 | 76 | 23 | 26 | 6 | 1 | 20 | 142 | 6 | 852 | 5 |
| 5 | 1722 | 1090 | 204 | 8824 | 64 | 2253 | 8 | 25 | 7 | 9 | 11 |
| 6 | 23 | 45 | 15 | 1 | 34 | 10 | 5 | 143 | 50 | 990 | 16 |
| 7 | 3 | 3 | 1 | 60 | 35 | 55 | 105 | 92 | 18 | 37 | 4 |
| 8 | 1308 | 3783 | 293 | 4383 | 3 | 379 | 8863 | 7340 | 5 | 206 | 9 |
| 9 | 21 | 24 | 328 | 972 | 111 | 60 | 37 | 13 | 4703 | 2538 | 29 |
| 10 | 522 | 6650 | 372 | 8 | 11 | 43 | 3 | 2 | 7430 | 510 | 22 |

TABLE 25-continued

Comparision of the ranking of the top 100 most specific genes in mice

| mouse | Astrocytes rat | Astrocytes human | Basket rat | Basket human | Granule rat | Granule human | Oligodendrocytes rat | Oligodendrocytes human | OPC rat | OPC human | Purkinje rat |
|---|---|---|---|---|---|---|---|---|---|---|---|
| 11 | 133 | 4139 | 100 | 5 | 46 | 102 | 42 | 18 | 34 | 404 | 8235 |
| 12 | 673 | 9 | 389 | 5538 | 24 | 48 | 38 | 84 | 11 | 17 | 103 |
| 13 | 106 | 111 | 114 | 3927 | 134 | 108 | 6 | 36 | 37 | 2309 | 3 |
| 14 | 40 | 5048 | 167 | 124 | 20 | 7 | 6435 | 8267 | 28 | 393 | 39 |
| 15 | 1460 | 740 | 175 | 110 | 9 | 256 | 10 | 40 | 32 | 8158 | 13 |
| 16 | 6 | 1 | 78 | 862 | 27 | 2 | 49 | 16 | 31 | 394 | 104 |
| 17 | 11 | 792 | 30 | 3 | 19 | 52 | 12 | 9 | 205 | 215 | 3873 |
| 18 | 13 | 4842 | 77 | 37 | 31 | 198 | 581 | 6889 | 167 | 176 | 299 |
| 19 | 15 | 163 | 295 | 32 | 354 | 290 | 51 | 71 | 56 | 842 | 23 |
| 20 | 72 | 1332 | 5 | 38 | 51 | 17 | 297 | 8969 | 988 | 376 | 21 |
| 21 | 206 | 212 | 7 | 66 | 21 | 64 | 28 | 48 | 1363 | 5522 | 27 |
| 22 | 78 | 130 | 38 | 12 | 309 | 118 | 25 | 44 | 10 | 942 | 10 |
| 23 | 10 | 19 | 3822 | 8712 | 30 | 21 | 50 | 282 | 36 | 10 | 17 |
| 24 | 43 | 5 | 251 | 243 | 114 | 39 | 121 | 74 | 46 | 556 | 35 |
| 25 | 116 | 9402 | 5703 | 261 | 2 | 32 | 140 | 504 | 135 | 532 | 41 |
| 26 | 49 | 567 | 3 | 88 | 4 | 95 | 1 | 26 | 343 | 406 | 115 |
| 27 | 409 | 88 | 142 | 210 | 28 | 63 | 71 | 90 | 677 | 1507 | 8 |
| 28 | 19 | 1960 | 2328 | 10814 | 17 | 49 | 44 | 32 | 30 | 170 | 32 |
| 29 | 48 | 63 | 376 | 8814 | 530 | 80 | 9 | 5 | 8 | 2 | 84 |
| 30 | 80 | 277 | 265 | 18 | 63 | 74 | 21 | 30 | 24 | 3271 | 70 |
| 31 | 1427 | 3174 | 24 | 105 | 1754 | 6156 | 3939 | 3733 | 17 | 63 | 30 |
| 32 | 2 | 1242 | 25 | 940 | 173 | 9 | 216 | 5681 | 168 | 178 | 18 |
| 33 | 135 | 53 | 73 | 9 | 83 | 112 | 143 | 103 | 25 | 218 | 28 |
| 34 | 34 | 49 | 440 | 546 | 23 | 65 | 147 | 728 | 4 | 96 | 12 |
| 35 | 36 | 334 | 5797 | 7520 | 116 | 20 | 5801 | 1381 | 40 | 245 | 7 |
| 36 | 42 | 119 | 8 | 40 | 88 | 625 | 127 | 58 | 67 | 2759 | 259 |
| 37 | 7 | 56 | 107 | 1145 | 163 | 9842 | 5690 | 3895 | 19 | 732 | 85 |
| 38 | 8 | 29 | 36 | 33 | 112 | 66 | 426 | 532 | 1642 | 7662 | 265 |
| 39 | 154 | 229 | 64 | 1009 | 14 | 220 | 122 | 5578 | 179 | 11 | 194 |
| 40 | 6269 | 8709 | 37 | 170 | 40 | 215 | 43 | 484 | 4013 | 1426 | 90 |
| 41 | 91 | 857 | 247 | 195 | 181 | 1702 | 39 | 52 | 367 | 1584 | 87 |
| 42 | 39 | 70 | 61 | 10523 | 361 | 179 | 18 | 19 | 284 | 102 | 4308 |
| 43 | 71 | 44 | 1388 | 7060 | 195 | 585 | 189 | 578 | 868 | 47 | 142 |
| 44 | 5262 | 6687 | 4638 | 1390 | 796 | 7672 | 7 | 61 | 649 | 5147 | 1343 |
| 45 | 27 | 6 | 291 | 64 | 25 | 160 | 65 | 20 | 110 | 7420 | 187 |
| 46 | 46 | 77 | 3908 | 7424 | 438 | 570 | 135 | 129 | 4851 | 776 | 111 |
| 47 | 844 | 4527 | 9153 | 1207 | 106 | 610 | 480 | 216 | 92 | 1597 | 57 |
| 48 | 121 | 42 | 163 | 258 | 120 | 27 | 16 | 8691 | 342 | 283 | 2074 |
| 49 | 107 | 43 | 42 | 4247 | 227 | 38 | 9461 | 275 | 403 | 1115 | 160 |
| 50 | 35 | 117 | 86 | 80 | 33 | 202 | 88 | 422 | 52 | 13 | 290 |
| 51 | 111 | 87 | 322 | 1772 | 283 | 139 | 3729 | 5037 | 80 | 1307 | 26 |
| 52 | 2510 | 866 | 315 | 111 | 194 | 152 | 117 | 14 | 160 | 561 | 176 |
| 53 | 14 | 510 | 686 | 361 | 5 | 6832 | 184 | 22 | 2295 | 1371 | 135 |
| 54 | 7903 | 961 | 147 | 77 | 142 | 59 | 1791 | 7297 | 98 | 571 | 76 |
| 55 | 245 | 64 | 20 | 7121 | 424 | 4012 | 35 | 1865 | 114 | 531 | 2751 |
| 56 | 119 | 129 | 1007 | 10147 | 539 | 174 | 2 | 1 | 3540 | 649 | 583 |
| 57 | 142 | 669 | 1368 | 1201 | 97 | 18 | 304 | 121 | 4627 | 3243 | 72 |
| 58 | 902 | 552 | 46 | 208 | 92 | 1645 | 46 | 6 | 416 | 1204 | 175 |
| 59 | 609 | 529 | 719 | 684 | 655 | 100 | 229 | 45 | 379 | 1053 | 358 |
| 60 | 16 | 619 | 10 | 95 | 44 | 187 | 19 | 386 | 253 | 211 | 54 |
| 61 | 463 | 62 | 2364 | 7818 | 2380 | 239 | 11 | 7 | 39 | 610 | 380 |
| 62 | 262 | 32 | 194 | 159 | 191 | 687 | 31 | 3559 | 93 | 7046 | 64 |
| 63 | 3965 | 276 | 99 | 277 | 6504 | 756 | 136 | 228 | 262 | 1118 | 108 |
| 64 | 38 | 55 | 7929 | 3329 | 857 | 126 | 79 | 400 | 1654 | 380 | 51 |
| 65 | 29 | 152 | 128 | 4321 | 2183 | 3867 | 94 | 47 | 753 | 311 | 9464 |
| 66 | 139 | 100 | 1010 | 448 | 900 | 23 | 48 | 248 | 145 | 48 | 92 |
| 67 | #### | 6607 | 486 | 30 | 128 | 199 | 22 | 259 | 556 | 5275 | 192 |
| 68 | 3210 | 2430 | 187 | 851 | 362 | 10149 | 17 | 38 | 6616 | 2501 | 388 |
| 69 | 415 | 101 | 16 | 144 | 75 | 148 | 134 | 246 | 61 | 3906 | 37 |
| 70 | 32 | 2 | 12 | 113 | 818 | 426 | 264 | 11 | 154 | 207 | 4697 |
| 71 | 335 | 3239 | 113 | 39 | 1712 | 234 | 34 | 1146 | 378 | 3535 | 74 |
| 72 | 74 | 200 | 8240 | 1044 | 1593 | 325 | 854 | 141 | 3172 | 601 | 166 |
| 73 | 221 | 127 | 143 | 1623 | 5608 | 8368 | 83 | 17 | 5945 | 3157 | 59 |
| 74 | 8281 | 3977 | 97 | 61 | 4575 | 2835 | 72 | 56 | 3107 | 3621 | 236 |
| 75 | 164 | 249 | 633 | 9775 | 93 | 37 | 418 | 1483 | 9799 | 6801 | 102 |
| 76 | 144 | 10 | 402 | 2003 | 2534 | 2970 | 9635 | 6045 | 289 | 91 | 44 |
| 77 | 4 | 643 | 281 | 330 | 119 | 47 | 8154 | 7468 | 300 | 355 | 1030 |
| 78 | 22 | 31 | 355 | 279 | 3891 | 2291 | 318 | 69 | 15 | 41 | 1554 |
| 79 | 31 | 5791 | 2634 | 502 | 174 | 3874 | 123 | 96 | 3 | 4330 | 140 |
| 80 | 1740 | 691 | 69 | 4200 | 108 | 792 | 392 | 295 | 7959 | 208 | 153 |
| 81 | 143 | 8 | 162 | 8045 | 160 | 435 | 5860 | 11188 | 100 | 287 | 323 |
| 82 | 59 | 7 | 193 | 849 | 1940 | 933 | 155 | 43 | 113 | 3334 | 158 |
| 83 | 4611 | 727 | 208 | 3878 | 1184 | 135 | 2751 | 6855 | 2299 | 1195 | 42 |
| 84 | 1295 | 1264 | 72 | 14 | 7925 | 9944 | 27 | 2119 | 2774 | 3890 | 4391 |

TABLE 25-continued

| | Comparision of the ranking of the top 100 most specific genes in mice | | | | | | | | | | |
| | Astrocytes | | Basket | | Granule | | Oligodendrocytes | | OPC | | Purkinje |
| mouse | rat | human | rat | human | rat | human | rat | human | rat | human | rat |
|---|---|---|---|---|---|---|---|---|---|---|---|
| 85 | 311 | 1401 | 151 | 99 | 228 | 1966 | 709 | 9289 | 1524 | 93 | 56 |
| 86 | 3028 | 597 | 119 | 11044 | 50 | 5724 | 7658 | 7379 | 1734 | 681 | 101 |
| 87 | 62 | 250 | 245 | 3903 | 1118 | 1458 | 197 | 4043 | 59 | 135 | 9072 |
| 88 | 277 | 439 | 82 | 191 | 336 | 1032 | 24 | 288 | 147 | 169 | 33 |
| 89 | 1222 | 558 | 3237 | 9174 | 100 | 16 | 226 | 1471 | 538 | 318 | 31 |
| 90 | 607 | 151 | 2576 | 346 | 1207 | 5396 | 6314 | 10145 | 254 | 145 | 136 |
| 91 | 1329 | 796 | 31 | 58 | 1556 | 2075 | 493 | 303 | 701 | 3045 | 489 |
| 92 | 180 | 762 | 170 | 79 | 6095 | 35 | 668 | 170 | 26 | 60 | 69 |
| 93 | 89 | 27 | 285 | 272 | 1122 | 1884 | 58 | 1538 | 7641 | 4408 | 2335 |
| 94 | 88 | 86 | 311 | 1523 | 677 | 8020 | 169 | 226 | 720 | 18 | 201 |
| 95 | 96 | 115 | 127 | 24 | 311 | 143 | 81 | 77 | 387 | 3902 | 95 |
| 96 | 962 | 4060 | 172 | 10414 | 379 | 3235 | 154 | 37 | 2 | 374 | 19 |
| 97 | 426 | 166 | 11 | 87 | 71 | 842 | 432 | 39 | 1932 | 5835 | 120 |
| 98 | 155 | 3563 | 2531 | 157 | 290 | 4104 | 201 | 761 | 209 | 348 | 156 |
| 99 | 340 | 288 | 299 | 1962 | 5142 | 8316 | 182 | 98 | 75 | 122 | 82 |
| 100 | 5745 | 1281 | 1498 | 1174 | 109 | 45 | 4319 | 6562 | 699 | 411 | 122 |

The specificity rank was observed to be more conserved between mouse and rat than mouse and human.

Example 10

Determining the Extent That Cell-Type Specific Genes Vary Across Species

To explore further the extent to which cell-type specific genes change across species, the comparative analysis was focused on the data from mouse and human nuclei samples because the annotation of the rat genome is less complete. By excluding rat genes, the number of high confidence orthologs that could be used for comparison increased from 11,443 to 14,273 by filtering the ENSEMBL orthologs.

Furthermore, to focus on differentially expressed genes that are most likely to impact cellular function, genes were selected that passed a stringent adjusted p-value cutoff of <0.01, that changed by at least 4-fold between species, and that are expressed at significant levels in each cell type (average number of counts>400 and fpkm>0). The number that were left after filtering for expression levels (base-Mean>50, log 10(fpkm)>0), and the number that were left after filtering for genes that are differentially expressed across all cell types between mouse and human were broken down into human and mouse enriched genes as shown in Table 26.

were observed to be differentially expressed in all cell types analyzed (adjusted p<0.01, fold change>2) were removed from the analysis. Filtering in this way yielded between 133 and 293 cell-type and species specific differentially expressed genes that were approximately equally distributed between those enriched in mouse and those enriched in human.

To confirm these data, the abundance of granule cell neurons relative to all other cell types in the cerebellum allowed two types of validation that could not be obtained for less abundant cell types: first, in addition to assaying the expression of nascent nuclear RNAs, the expression of mature cytoplasmic RNAs was examined; second, given the high fraction of granule cell genomes present in cerebellar nuclear preparations, chromatin accessibility was assessed using unsorted cerebellar nuclei. Since previous studies have demonstrated that ATACseq peaks are typically found in the promoters and gene bodies of expressed genes and severely reduced or absent from genes that are not expressed (Buenrostro, et al. (2013) Nat Methods 10, 1213-1218; Mo, et al. (2015) Neuron 86, 1369-1384; Su, et al. (2017) Nat. Neurosci. 20, 476-483, each of which is hereby incorporated by reference herein in its entirety), ATACseq data from mouse, rat and human cerebellar nuclei was used to confirm the expression data.

As expected, protein coding genes that were identified as expressed in the data from the cellular profiling technique

TABLE 26

| | Enriched genes | | | | |
| Cell Type | p < 0.01 fc > 4 | baseMean > 50 log$_{10}$(rpkm) > 0 | Exclude general species genes | Human enriched | Mouse enriched |
|---|---|---|---|---|---|
| Granule | 1776 | 710 | 202 | 74 | 128 |
| Basket | 2372 | 823 | 236 | 103 | 133 |
| Astrocyte | 1570 | 778 | 293 | 117 | 176 |
| Oligo | 1326 | 667 | 182 | 104 | 78 |
| OPC | 1013 | 490 | 133 | 73 | 60 |

According to Table 26, between 490 and 823 genes were identified that are mouse- or human-enriched in these cell types.

To identify cell-type and species differences rather than general differences between mouse and human, genes that described herein from all three species were accompanied by the presence of spliced cytoplasmic mRNAs, and ATACseq peaks were evident in their promoters and gene bodies. For example, the housekeeping gene Gapdh and the granule-specific gene Etv1 are strongly expressed in granule cells of mouse, rat, and human. As expected, the presence of nuclear RNA, cytoplasmic RNA, and ATACseq peaks over these genes were observed. But for the human-enriched genes Clvs2 and Vwc2, while these three independent measures of active expression were present in the human data, no expression or chromatin accessibility was evident in the mouse data. Conversely, for the mouse-enriched genes Cnksr3 and Ecel, nuclear and cytoplasmic RNA expression and ATACseq peaks were observed in the mouse data, but not the human data. As expected, expression of these genes in rat was similar to a mouse, although low levels of the human-enriched genes Clvs2 and Vwc2 were observed to be present in rats.

Figure 4:
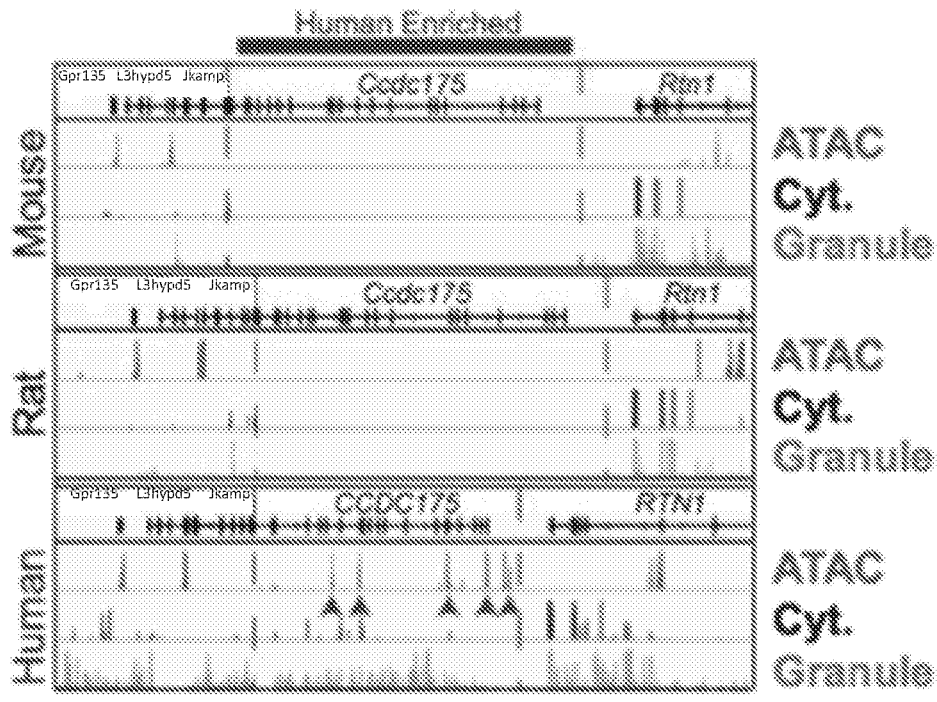
FIG. 4 provides a genome browser view showing three tracks—nuclear RNA levels from granule cells, cytoplasmic RNA levels from total cerebellum, and ATACseq DNA accessibility from total cerebellum—for mouse, rat, and human to reveal species specific and cell-type specific differences.

Two additional features of expression between mouse and human were identified. Changes in expression may involve more than one gene at a given genomic interval. For example, in the locus containing G Protein-Coupled Receptor 135 (Gpr135), Trans-L-3-Hydroxyproline Dehydratase (L3hypdh), JNK1/MAPK8-Associated Membrane Protein (Jkamp), Ccdc175, and Reticulon 1 (Rtnl), all five genes were expressed in human granule cells as revealed by nuclear and cytoplasmic gene expression and the presence of ATACseq peaks in FIG. 4. Jkamp, L3hypdh, and Gpr135 were also observed to be expressed in mouse and rat, as supported by the presence of promoter DNA accessibility sites shown by the ATACseq peaks, but were expressed at much lower levels relative to their human orthologs. Rtnl was observed to be expressed at a lower level in mice than in rats and humans, although different patterns of ATACseq peaks were observed for each sample. In mouse and rat, Ccdc175 was not observed to be expressed and no ATACseq peaks were observed. This indicates that the genes in this region form two distinct domains—one containing Rtnl and the other containing Gpr135, L3hypdh, Jkamp, and Ccdc175. Gpr135, L3hypdh, and Jkamp are equally accessible to ATACseq in the rodent data. Therefore, the reduced nuclear and cytoplasmic RNA levels of these genes was likely due to changes in chromatin structure of the neighboring and non-expressed gene, Ccdc175.

A second feature of the expression between mouse and human data showed that changes sometimes involve expression of alternative family members in a given cell type. For instance, the Pde1 gene family contains the three calcium and calmodulin-dependent phosphodiesterase Pde1a, Pde1b, and Pde1c. These enzymes catalyze the hydrolysis of cAMP or cGMP, and play important roles in modulation of neuronal activity. ATACseq was used to confirm that mouse granule cells mouse express only Pde1c, whereas granule cells from human express high levels of Pde1a and low levels of Pde1c. These results matched previous findings that Pde1a is expressed in the human but not mouse cerebellum in Loughney, K., & Ferguson, K. (1996) Phosphodiesterase inhibitors (pp. 1-19); Loughney, et al. (1996) J Biol Chem 271, 796-806; and Sonnenburg, et al. (1993) J Biol Chem 268, 645-652; each of which is herby incorporated by reference herein in its entirety. Since Pde1a preferentially hydrolyzes cGMP while Pde1c hydrolyzes both cAMP and cGMP with equal efficiencies (Takimoto, E. (2009) Circ. Res. 105, 931-933, which is hereby incorporated by reference herein in its entirety), these differences may result in slightly different biochemical consequences in mouse and human cerebellum.

To confirm the presence or absence of these mRNAs in the mouse brain, publicly available gene expression data from the Allen Mouse Brain Atlas and GENSAT Project (Gong, et al. (2003) Nature 425, 917-925; Lein, et al. (2007) Nature 445, 168-176, each of which is herby incorporated by reference herein in its entirety) was analyzed. These data confirmed expression in the granule layer of the cerebellum for granule-specific marker Etvl and the mouse-enriched genes Cnksr3, Ecel, and Pde1c, and the absence of expression of the human-enriched genes Ccdc175, Clvs2, Vwc2, and Pde1a. Interestingly, while Clvs2 and Pde1a are absent from the cerebellum, they are expressed in other regions in the mouse brain, suggesting that alterations in cell specific regulatory sequences might underlie these species differences (Carroll, S. B. (2005) PLoS Biol 3, e245; Carroll, S. B. (2008) Cell 134(11), 25-36; each of which is hereby incorporated by reference herein in its entirety). Ecel expression is also observed in the Purkinje layer of the cerebellum. Expression of the human enriched genes Ccdc175, Clvs2, Vwc2, and Pde1a was observed in the mouse brain. No staining was detected in any region for Ccdc175 and Vwc2. Strong staining of Clvs2 was observed in the dentate gyms and of Pde1a in layers 5 and 6 of the cortex and CA1-3 of the hippocampus.

To further validate the data, qPCR was used to determine the relative expression of mouse- and human-enriched genes. qPCR analysis of gene expression was performed for housekeeping, human enriched, and mouse enriched genes using human and mouse cerebellar cytoplasmic cDNA. Two biological replicates, each with three technical replicates were used for each species. Expression was normalized to the arithmetic mean of expression from the three housekeeping genes. Fold change was calculated relative to expression in the human XK sample. p-values were calculated using two-tailed students t-test assuming unequal variance with the mean normalized values for the biological replicates (technical replicates averaged), and are as follows: 1) housekeeping genes—$Actb=0.334$, $Gapdh=0.141$, and $Polr2a=0.109$; 2) human-enriched genes—$Clvs2=0.0195$, $Vwc2=0.0161$, and $Pde1a=0.00086$; and mouse-enriched gene—$Pde1c=0.0696$. p-values could not be calculated for Ccdc175, Cnksr3, and Ecel because all technical replicates of at least one biological replicate failed to amplify.

In all but one case, the qPCR results confirmed the RNAseq and ATACseq data. In the outlier case, Pde1c showed no significant changes in expression between mouse and human. To understand this discrepancy, expression of Pde1a and Pde1c was assayed in mouse and human cerebellar sections by immunofluorescence. Staining was performed at least two times each using sections from two separate mice and two human donors. NeuN was the marker for granule cells. Consistent with the RNAseq and ATACseq data, both Pde1c and Pde1a members were observed to be primarily localized in the granule layer, with Pde1c expression predominant in mouse and Pde1a expression predominant in human cerebellum. Mouse cerebellum showed Pde1c specifically in granule cells and background labeling for Pde1a, while human cerebellum showed Pde1a specifically in granule cells and background labeling for Pde1c.

To understand whether these genes might reflect changes in expression that occur independently, or transcriptional programs that are altered between species, Gene Ontology (GO) analysis was performed for the ten categories of species-specific genes. Four groups of genes resulted in significant GO groups: human-enriched astrocyte, human-enriched oligodendrocyte, human-enriched OPC, and mouse-enriched granule genes. The remaining 6 gene sets were not observed to have any significantly associated GO categories suggesting that species differences in these cell types contribute to a wide range of pathways and functions. GO analysis of human-enriched genes from astrocytes, oligodendrocytes, or OPCs revealed that these genes are involved in cellular structure, size regulation, and nervous system function, potentially reflecting known differences in morphology between mouse and human glial cells. Granule cell mouse-enriched genes are involved in nervous system function and the metabolism of polysaccharides that may play a role in cell-cell interactions.

Taken together, these data demonstrate that cellular profiling technique described herein can be employed with nuclei to accurately assess cell-type specific gene expression in rodent and human brains, and gene expression in the nervous system. Gene expression in the brain was observed to be highly conserved in specific cell types across species. Accordingly, most abundant and cell specific markers of well-characterized cell types were observed to be shared between the rodent and human brain. Despite this shared identity, there were a significant number of genes in each cell type whose expression was not conserved between species. This group of genes does not generally conform to known GO categories, and in many cases their expression is found in other brain regions. Cell type and species-specific expression can reflect altered regulation of adjacent genes within a locus, or selective expression of functionally related yet distinct members of a given gene family. Although the consequences of these gene expression changes will have to be interrogated in future studies, the data herein demonstrate that functionally important differences in gene expression in specific CNS cell types occur between species and suggest that they may result in important differences in the biochemical functions of rodent and human cell types.

Example 11

Comparing the Nuclear Transcriptome of Mice and Humans

Figure 6:
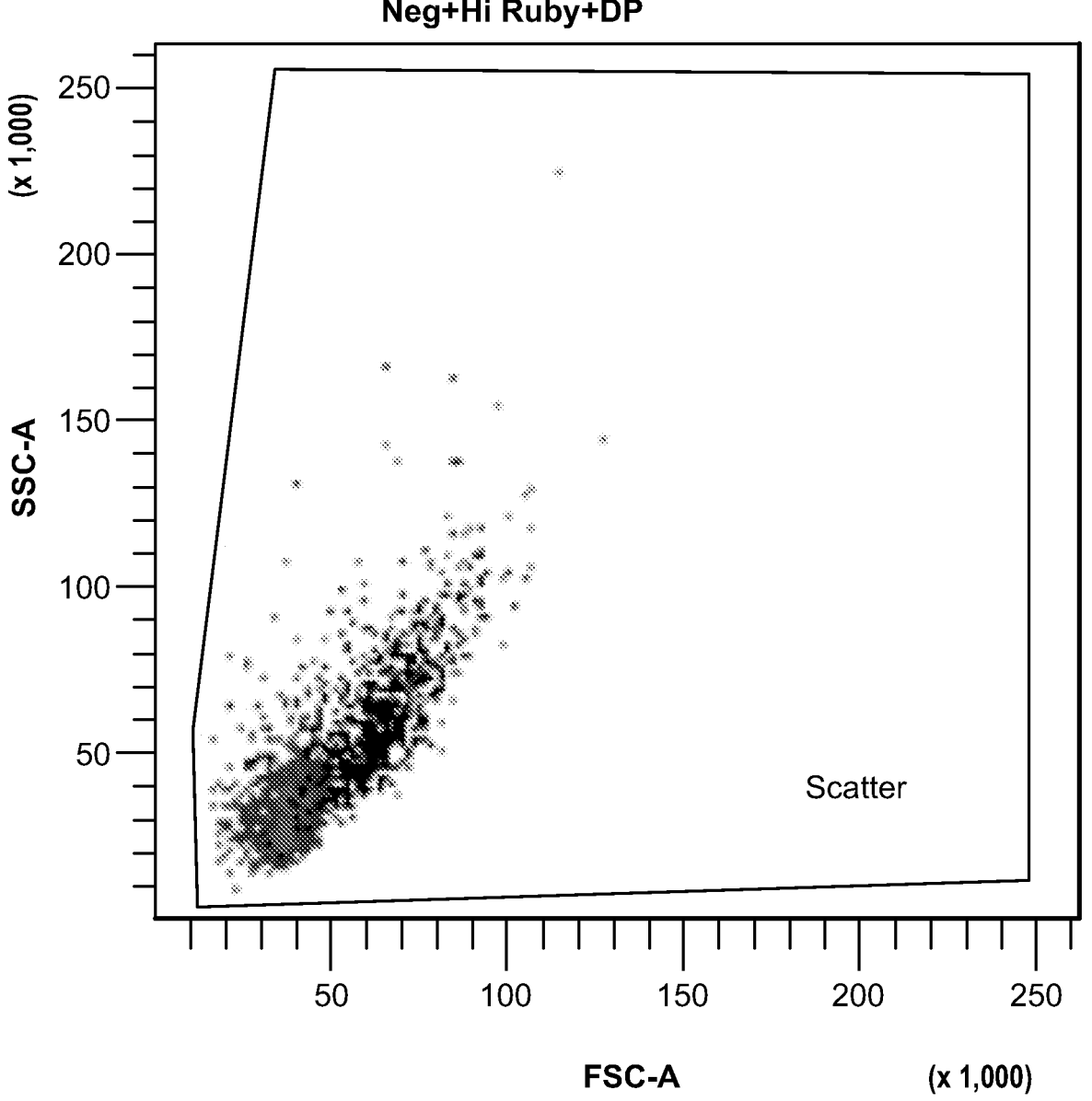
FIG. 6 shows flow cytometry sorting results to approximate the size of the nuclei with the combination of forward-scattered light (FSC) and side-scattered light (SSC).

Immunofluorescence was used to determine whether sorting resulted in pure populations in human samples. The nuclear structure was observed to be quite different between the three populations, and the nuclei in each of the populations was different in size. NEUN+ granule neurons were observed to be small and highly heterochromatic. The size of NEUN− nuclei was observed to be mixed between larger nuclei likely from Bergmann glia and smaller nuclei likely from oligodendrocytes. ITPR1+ nuclei were observed to be bigger and more euchromatic than the nuclei in the other two groups. FIG. 6 shows flow cytometry sorting results to approximate the size of the nuclei with the combination of forward-scattered light (FSC) and side-scattered light (SSC). (DP=double positive). These results show that nuclei from different cell types are distinct in nuclear structure, which may result in differences across each cell type in gene expression regulation or in disease susceptibility.

Figure 5A:
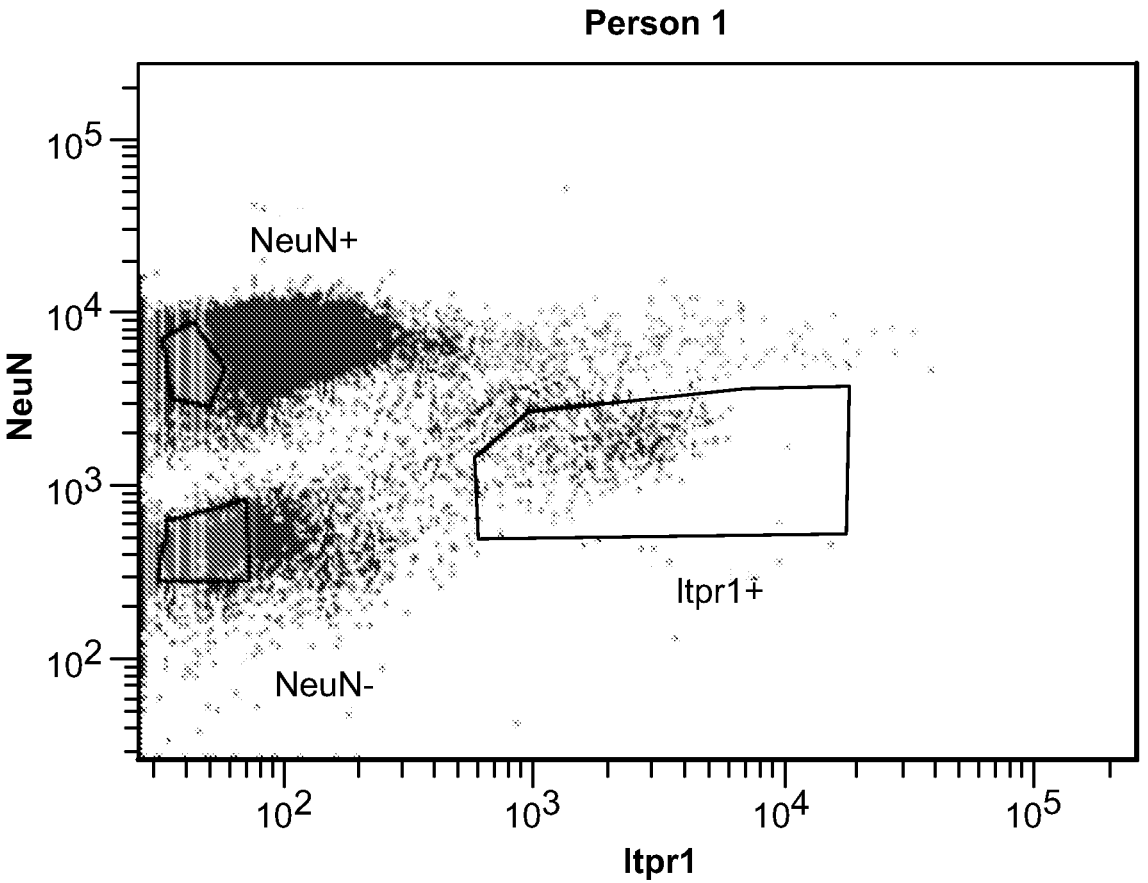
FIG. 5A and FIG. 5B show flow cytometry sorting results for nuclei from two different human subjects.
Figure 5B:
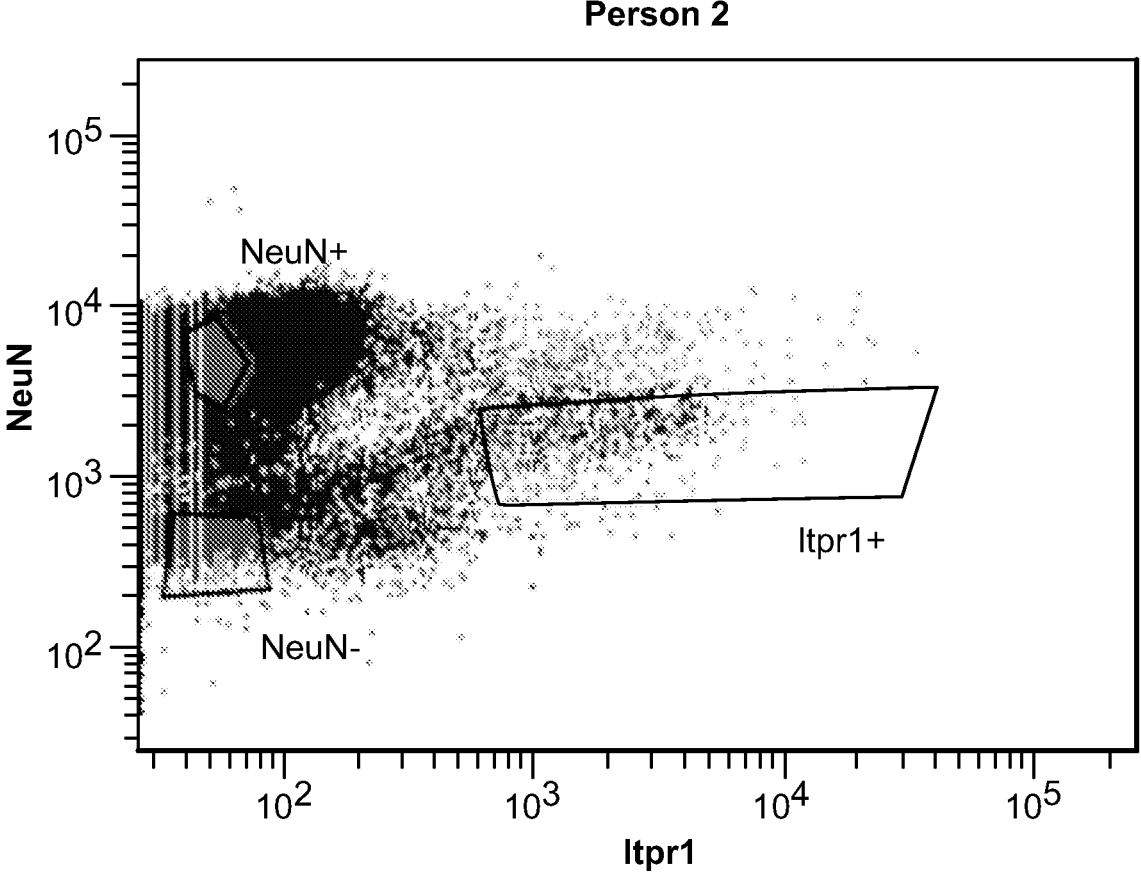

Although, heterogeneity of nuclei sorted from two different human subjects (Person 1 and Person 2) was observed in the flow cytometry results in FIG. 5A and FIG. 5B, respectively. Species specific markers may be identified to differentiate nuclei from different cell types.

Figure 7A:
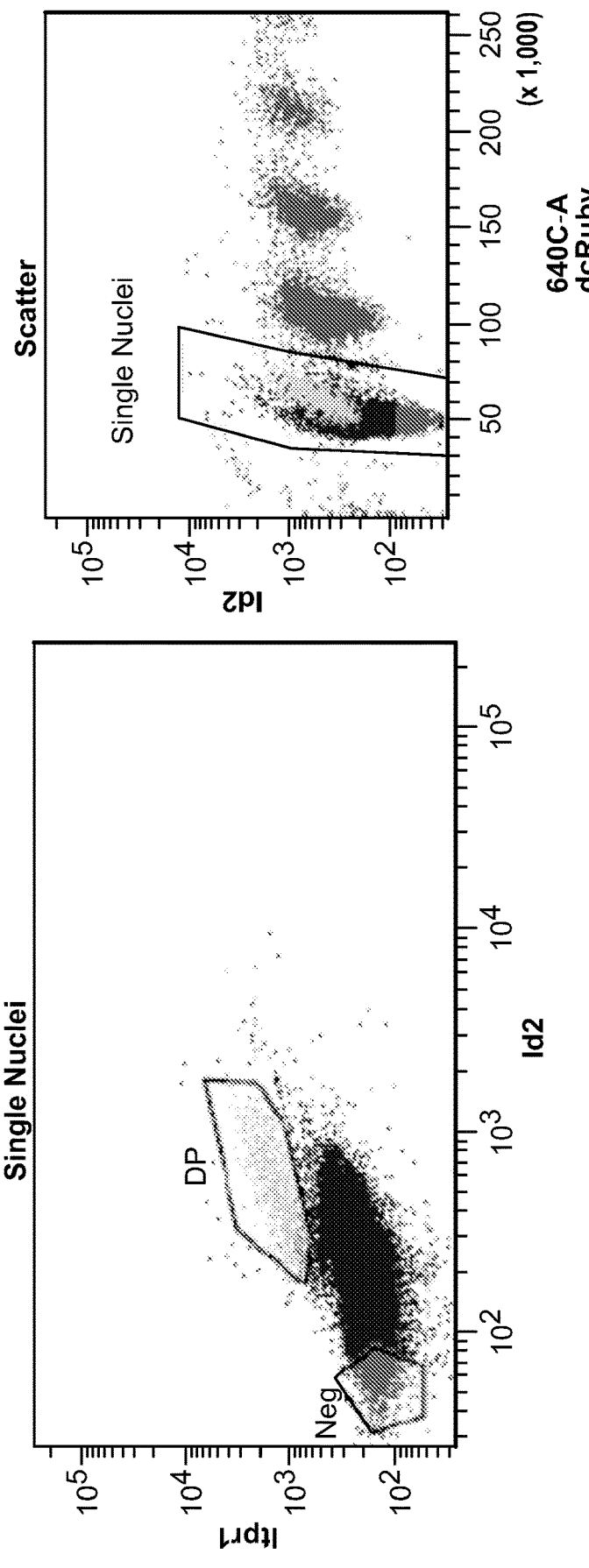
FIG. 7A, FIG. 7B, FIG. 7C, and FIG. 7D show flow cytometry results for 4 different staining strategies for human cerebellar nuclei.
Figure 7B:
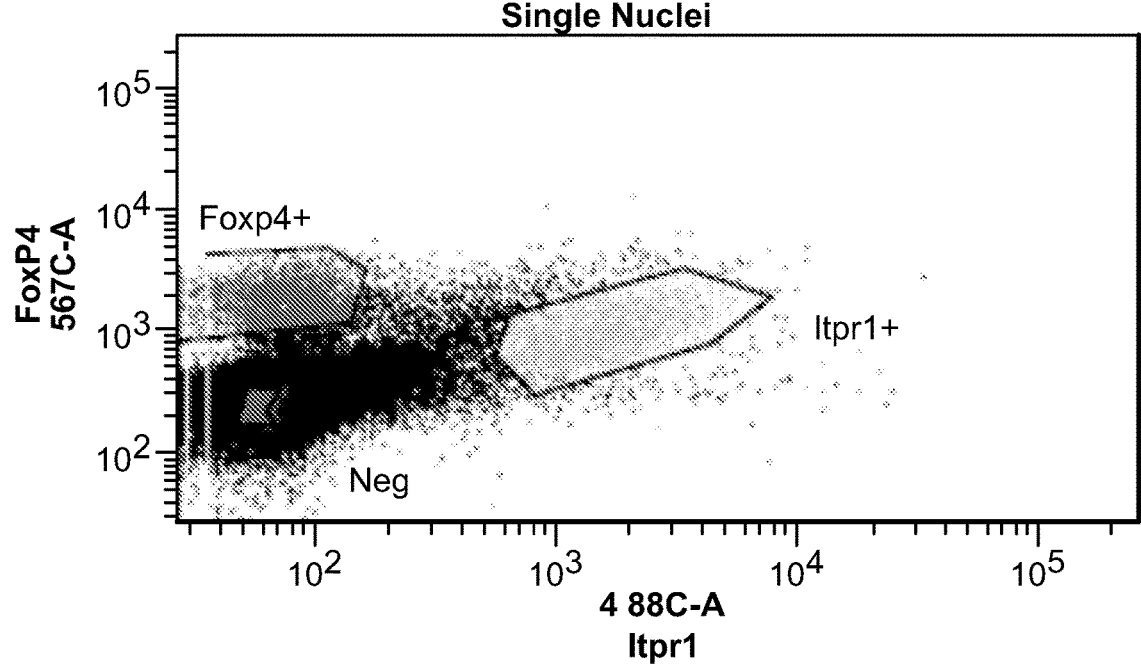
Figure 7B:
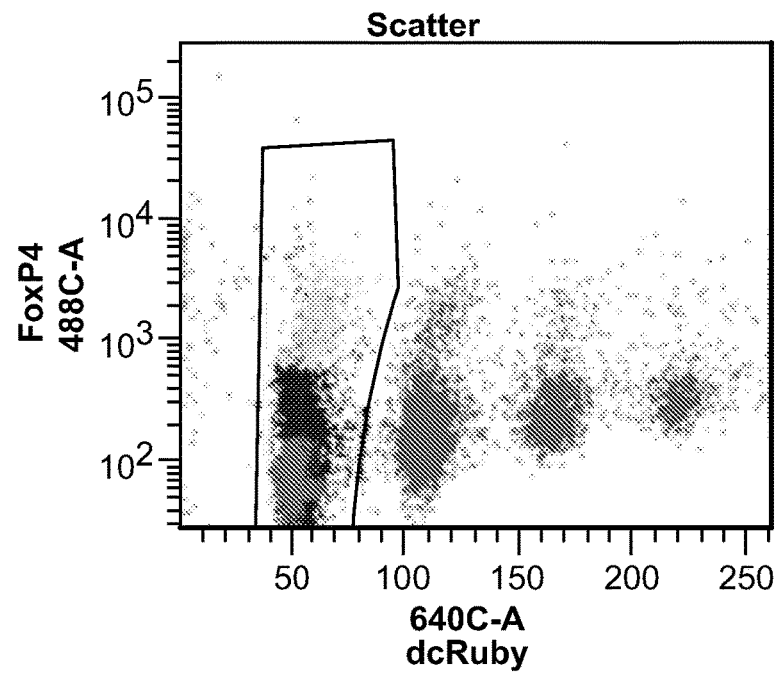
Figure 7C:
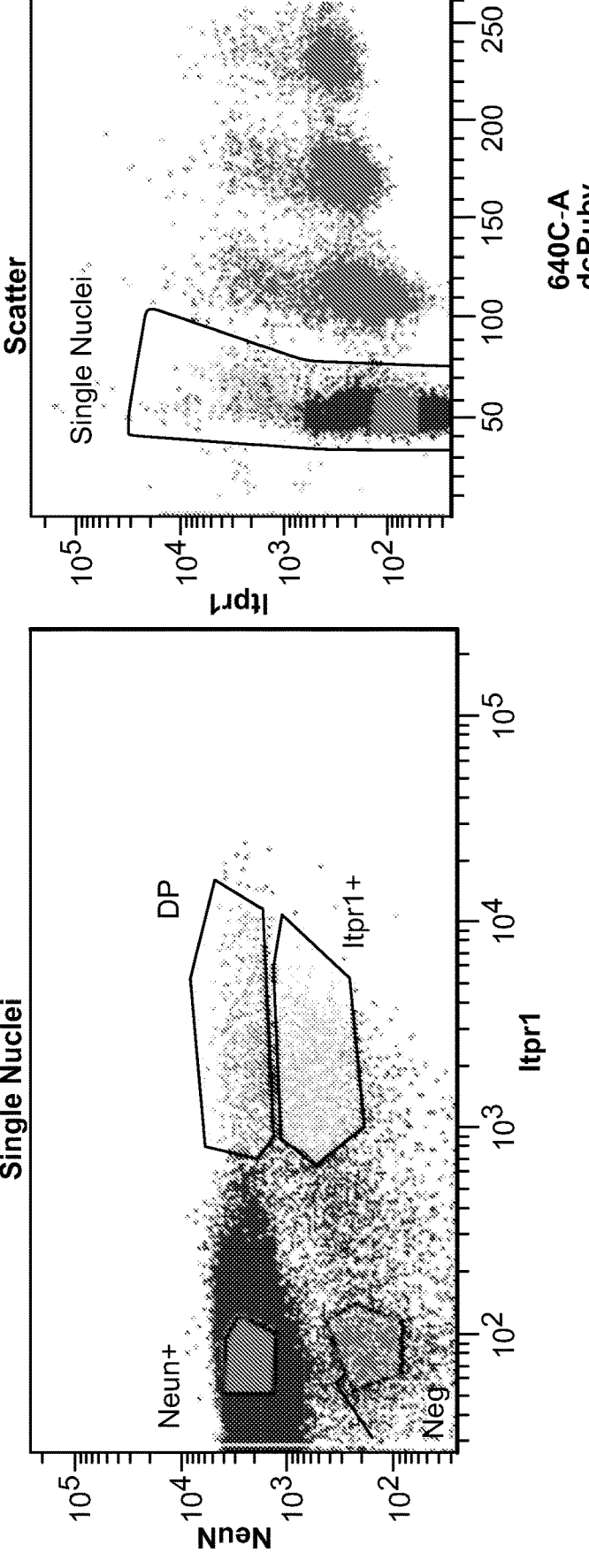
Figure 7D:
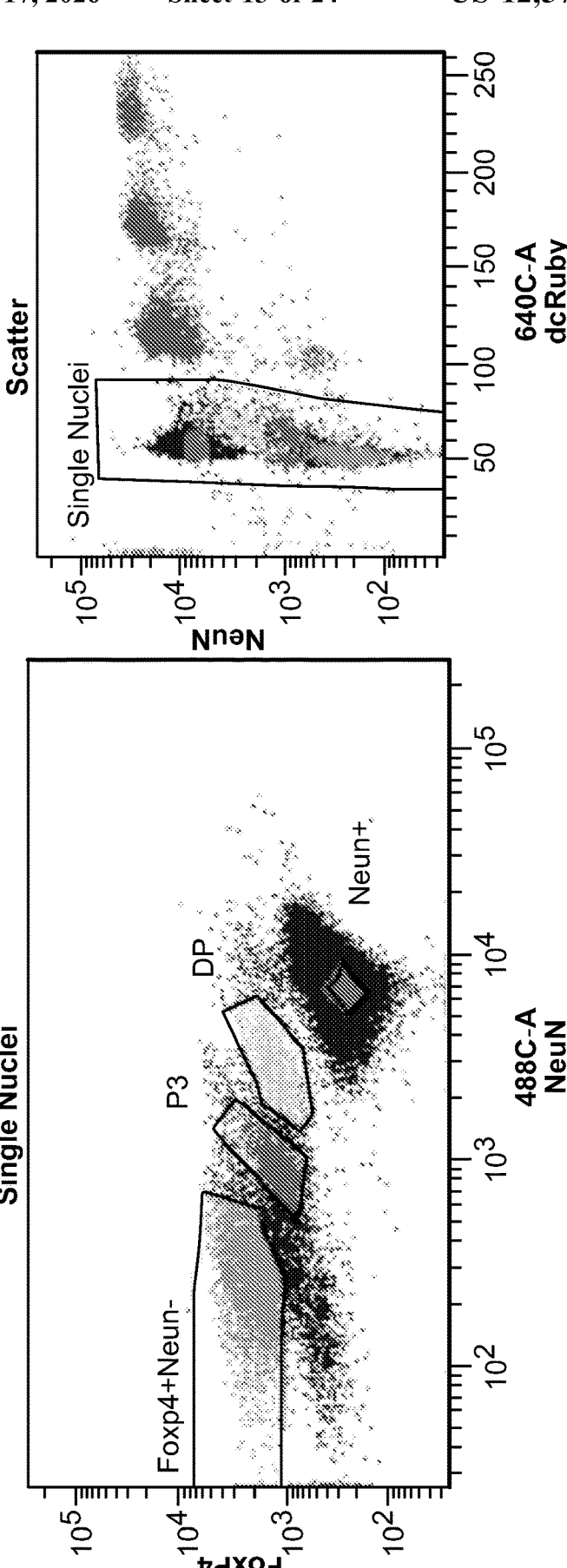

FIG. 7A, FIG. 7B, FIG. 7C, and FIG. 7D provides flow cytometry results for 4 different staining strategies for human cerebellar nuclei developed from strategies used to sort nuclei in mice. FIG. 7A shows flow cytometry results from gating with Itpr1 and Id2 for purkinje cells, i.e., Itpr+ and Id2+. FIG. 7B shows gating with Forkhead Box P4 (FoxP4) and Itpr1 for purkinje cells, i.e., FoxP4+ and Itpr+. FIG. 7C shows gating with NeuN and Itpr1 for granule cells using the same sorting strategy used in mice, i.e. Itpr− and NeuN+. FIG. 7D shows gating with Foxp4 and NeuN. The lightest gray population in all four staining strategies provided the same population of nuclei as shown by gene expression profiling from RNAseq that is shown in Table 37.

Gene expression profiles from RNAseq results from mouse and human sorted nuclei are shown in Examples 15 and 17, respectively. The granule cell nuclei population in Table 37 of Example 17 was observed to have a similar profile to the granule cells from a mouse, as shown in Table 31 of Example 15. The glia nuclei population in Table 37 was observed to have a similar profile to the glia from a mouse (Tables 33 and 34). The basket nuclei population from human samples in Table 37 was observed to have a similar profile to basket/stellate cells from mice in Table 32. These similarities were particularly noticeable in the RNAseq results for Rbfox3 (also known as NeuN), Fat2, Ryanodine Receptor 1 (Ryr1), Pvalb, Glutathione S-Transferase Mu 1 (Gstm1), and Pleiotrophin (Ptn).

In contrast, significant variations were observed between a mouse and a human in the RNAseq data in Tables 31-34 and 37 for Protein Tyrosine Kinase 2 Beta (Ptk2b), Solute Carrier Family 43 Member 2 (S1c43a2), Glutamate Ionotropic Receptor Kainate Type Subunit 3 (Grik3), Itpr1, Protocadherin 9 (Pcdh9), and RAS Guanyl Releasing Protein 1 (Rasgrp1)-positive nuclei from granule, basket/stellate, and glia cells.

Hierarchical clustering (first by species, and then by cell type) of nuclear RNAseq data from the top 500 genes that contribute to the greatest variation between the samples, hence best differentiate one sample from another showed some groups of genes that differentiate between cell types and other groups of genes that differentiate between species. This analysis reveals genes that are conserved and divergent between mice and human.

A principle component analysis of the mouse and human cerebellar samples allows visualization of clustering by cell type and by species. The first principle component (x-axis) represents the largest variation between the samples, and the second principle component represents the second largest source of variation between the samples and how they separate by cell type. The analysis herein showed that cell type contributes to X % of the variance between samples while species contributes to Y % of the variance between samples.

Example 12

Identifying Cell Type and Species-Specific Genes From Cross-Species Comparisons Given the high quality of the cell specific expression profiles described above, the extent of gene expression changes between species in these cerebellar cell types was analyzed. To ensure that the results reflected altered expression rather than differences in annotation between species, the analysis was limited to high confidence 1:1 orthologs between mouse, rat, and human. To define ortholog annotations for mouse, rat, and human genes, ortholog annotation across species were downloaded from ENSEMBL (304,147 transcripts vs. 19,197 genes), and filtered to include only: high confidence pairs (76,172 transcripts vs 14,541 genes) →1:1 orthologs (67,522 transcripts vs.13,242 genes) →genes greater than 1kb in total length and that change by less than 2-fold in length across species (30,497 transcripts vs. 11,443 genes). For each gene, the longest orthologous transcript was used for annotation resulting in 11,443 transcripts and 11,443 genes.

The log 2 fold change in expression for the 250 most variable genes across mouse, rat, and human nuclei between the normalized RNAseq results from the nuclei of the seven cells types compared to the RNAseq results for the sorted nuclei from each individual cell type is shown in Table 27. Negative values indicate reduced expression in the nuclei of the cell type compared to the normalized value across nuclei from all cell types analyzed, and a positive value indicates increased expression compared to the normalized value across nuclei from all cell types analyzed. Two replicate samples of nuclei from each cell type was analyzed.

TABLE 27

| | Log2 fold change of expression for nuclei from rat samples | | | | | | | | | | |
|---|---|---|---|---|---|---|---|---|---|---|---|
| | Cell types | | | | | | | | | | |
| | Granule | | Purkinje | | Basket | | Astrocytes | | Oligodendrocytes | | Oligodendrocytes & OPCs | |
| Gene | Log2 fold change in expression | | | | | | | | | | |
| 1810041L15Rik | 1.19 | 0.19 | −2.21 | −1.89 | 1.56 | 1.79 | 2.87 | 3.64 | 2.42 | 4 | 8.39 | 6 |
| 2810459M11Rik | −1.87 | −2.02 | −2.3 | −2.18 | −1.68 | −1.65 | 0.16 | −0.23 | −1.76 | −2.52 | 1.47 | 1.23 |
| 3110035E14Rik | −2.28 | −2.15 | −3.05 | −2.71 | −1.63 | −0.98 | 0.71 | 0.86 | −2.04 | −1.72 | 4.07 | 4.27 |
| A2m | −2.89 | −2.47 | −1.33 | −1.55 | −2.91 | −2.17 | −0.7 | 0.49 | −2.38 | −2.03 | −2.43 | −2.81 |
| Adamts15 | 0.23 | −1.13 | −1.44 | −1.21 | 3.42 | 3.8 | 2.77 | 2.98 | −0.48 | 0.17 | 1.13 | 2.4 |
| Adra1a | −1.04 | −1.28 | −2.07 | −1.83 | −1.2 | −0.87 | 1.55 | 1.61 | −0.71 | −0.62 | 1.01 | 1.17 |
| AI593442 | −1.5 | −2.54 | 3.52 | 3.57 | −0.43 | −1.32 | 0.27 | −0.85 | −2.36 | −2.38 | −0.52 | −0.77 |
| Aldh1a1 | −2.46 | −1.56 | −2.11 | −1.98 | −2.49 | −1.2 | 0.95 | 0.1 | 0.35 | 0.64 | −1.51 | −2 |
| Anln | 1.19 | 1.14 | −2.07 | −2.13 | −0.76 | −0.79 | 0.82 | −0.1 | 3.91 | 3.88 | 0.28 | −1.69 |
| Apcdd1 | −1.48 | −2.27 | −2.44 | −2.42 | 1.69 | 1.42 | 0.36 | −0.22 | −1.54 | −1.82 | −0.47 | 0.39 |
| Apod | −0.76 | −0.56 | −0.92 | −1.05 | 0.31 | 0.76 | 2.53 | 2.03 | 4.94 | 5.15 | 2.74 | 2 |
| Aqp4 | −1.01 | −1.27 | −1.73 | −1.54 | 1.06 | 1.03 | 4.34 | 3.59 | 1.55 | 2.08 | 1.26 | −0.24 |
| Arhgef33 | −1.65 | −1.97 | 7.41 | 7.38 | −2.03 | −2.29 | −2.43 | −2.2 | −1.67 | −2.04 | −1.3 | −0.78 |
| Ascl1 | −1.85 | −1.35 | −1.96 | −2.09 | −0.81 | −0.22 | −1.32 | 1.34 | −2.16 | −1.75 | 1.51 | −0.46 |
| Asgr1 | −2.55 | −2.24 | −2.24 | −2.38 | 1.46 | 1.14 | 0.35 | 1.83 | −1.33 | −0.74 | −2.62 | 0.28 |
| Aspa | −1.4 | −2.09 | −1.62 | −1.63 | −0.99 | −0.87 | 0.13 | −0.99 | 3.66 | 3.02 | 1.59 | 0.26 |
| Atp1a2 | −2.63 | −2.39 | −2.36 | −2.34 | 0.41 | 0.43 | 3.29 | 3.34 | 0.36 | 0.38 | 2.43 | 2.45 |
| Atp2a3 | −0.3 | −0.36 | 5.82 | 5.86 | −0.73 | −0.79 | −1.15 | −0.17 | 0.68 | 0.28 | −0.1 | −0.55 |
| B3gnt5 | −2.93 | −2.34 | 2.81 | 2.77 | −2.95 | −2.94 | −2.76 | −2.88 | −3.11 | −2.86 | −2.98 | −2.14 |
| B3gnt7 | 1.65 | 1.97 | −1.88 | −1.4 | −0.66 | 0.34 | 1.43 | 1.25 | 0.46 | −0.92 | 3.59 | 3.78 |
| Bcl11a | −0.01 | −0.03 | 6.76 | 6.55 | −1.16 | −1.58 | −1.72 | −0.69 | −0.94 | −0.97 | −0.19 | −0.97 |
| Bhlhe22 | −1.16 | −2.23 | −1.69 | −2.35 | 2.83 | 2.54 | 1.27 | 1.01 | −0.49 | −1.41 | −2.2 | 0.49 |
| C1ql1 | −1.82 | −1.57 | −2.26 | −2.78 | −0.6 | −0.49 | 2.24 | 2.65 | −1.27 | −1.69 | 5.84 | 5.17 |
| C1ql2 | −1.41 | −1.52 | −1.51 | −1.65 | 1.62 | 0.8 | 0.71 | 1.14 | −0.24 | −1.31 | 3.86 | 5.15 |
| Cacna1g | 1.48 | 1.57 | 4.57 | 4.75 | 1.7 | 1.72 | −0.09 | 0 | −1.26 | −1.4 | −0.56 | 0.06 |
| Cacng4 | −2.16 | −2.25 | −2.84 | −2.83 | −1.48 | −1.11 | 1.64 | 1.71 | −0.89 | −1.19 | 3.54 | 3.52 |
| Calb1 | −1.69 | −1.98 | 6.9 | 6.88 | −1.64 | −0.74 | −1.37 | −1.39 | −0.98 | −1.25 | −1.82 | −2.29 |
| Camk1g | −0.11 | 0.82 | −1.54 | −1.44 | 4.12 | 4.13 | 3.71 | 4.04 | 1.26 | 1.32 | 3.78 | 3.72 |
| Car8 | −1.15 | −1.57 | 7.24 | 7.51 | −2.22 | −1.99 | −2.17 | −2.03 | −1.78 | −1.82 | −0.12 | 0.3 |
| Carns1 | −2.58 | −2 | −1.77 | −2.42 | −1.17 | −1.87 | 0.19 | 0.96 | 3.57 | 3.56 | −2.64 | −2.18 |
| Casq2 | 0.81 | 0.5 | 5.41 | 5.45 | −1.44 | −1.32 | −1.27 | −0.32 | −1.25 | −0.8 | 0.17 | −0.97 |
| Cbln2 | −1.07 | −1.18 | −1.18 | −1.3 | −0.13 | 0.48 | −1.42 | −1.36 | −1.37 | −0.98 | −0.2 | 0.06 |
| Ccdc152 | −0.11 | −1.44 | −1.43 | −1.75 | −1.3 | −2.08 | 0.09 | −0.09 | 2.34 | 2.01 | −2.16 | −1.06 |
| Ccdc180 | −0.2 | −0.25 | −0.69 | −0.98 | −0.83 | −1.52 | −1.27 | −0.77 | −1.36 | −0.77 | −0.16 | −1.38 |
| Ccnd2 | −1.11 | −1.18 | −1.02 | −1.36 | −1.32 | −1.41 | −0.59 | −0.31 | −1.07 | −0.07 | 2.05 | 2.15 |
| Cd82 | 1.13 | 0.88 | 0.33 | 0.15 | −0.48 | −0.57 | 1.08 | 1.32 | 3.61 | 3.73 | 1.52 | −0.35 |
| Cd9 | −1.96 | −1.73 | −2.23 | −1.7 | −1.07 | −0.97 | 1.56 | 1.66 | 2.43 | 2.77 | 3.24 | 3.83 |
| Cdh19 | −1.46 | −1.5 | −1.45 | −1.7 | −1.97 | −1.48 | −0.52 | −0.78 | 2.23 | 2.09 | −1.4 | −1.54 |
| Cdhr1 | −0.19 | −2.09 | −0.82 | −1.68 | −2.01 | −0.41 | 0.24 | −0.32 | −1.76 | −0.78 | 3.02 | 3.03 |
| Cldn11 | −1.76 | −2.05 | −1.6 | −2.35 | −0.98 | −0.54 | 1.09 | 0.47 | 5.2 | 5.34 | 2.29 | 1.33 |
| Clec7a | 2.43 | 0.82 | 0.43 | 0.58 | 1.29 | −1.02 | −0.53 | −1.33 | 1.63 | 0.16 | −1.11 | 0.17 |
| Clmn | −2.26 | −2.39 | 2.76 | 2.65 | −1.47 | −1.64 | 0.85 | 0.89 | 2.55 | 2.48 | 0.71 | −0.59 |
| Cmtm5 | −2.78 | −2.07 | −2.83 | −2.89 | −0.11 | 0.35 | 3.59 | 4.14 | 4.36 | 4.51 | 3.44 | 2.62 |
| Cntn3 | −1.77 | −1.79 | 3.87 | 3.83 | −1.85 | −1.55 | −0.17 | −0.69 | −2.16 | −2.45 | −1.07 | −0.8 |
| Cntnap5a | 0.76 | 0.43 | 2.79 | 2.7 | −1.23 | −1.29 | −1.44 | −0.91 | −1 | −0.79 | −0.18 | −0.78 |
| Cobl | −1.52 | −1.82 | −0.99 | −0.93 | −2.02 | −2.09 | −1.32 | −1.27 | 1.99 | 1.59 | 0.9 | 1.1 |
| Col5a3 | −1.13 | −1.13 | −2.29 | −2.52 | −1.14 | −0.73 | 1.25 | 2.22 | −0.44 | −0.88 | 4.74 | 4.54 |
| Col6a1 | −0.41 | −1.72 | 3.91 | −0.81 | −0.47 | −1.01 | −0.69 | 0.87 | −1.24 | −1.73 | 2.16 | 0.49 |
| Cpm | −0.66 | −0.78 | −1.35 | −1.57 | −0.98 | −0.9 | 0.38 | 0.21 | 3.39 | 3.66 | 3.05 | 2.33 |
| Cryab | −2.69 | −2.42 | −2.77 | −2.3 | −1.48 | −2.01 | 0.42 | −0.24 | 2.78 | 2.45 | 1.63 | 1.45 |
| Cspg4 | −2.17 | −2.1 | −2.09 | −2.16 | −0.71 | −0.62 | 1.57 | 2.19 | 1.8 | 1.26 | 4.68 | 4.86 |
| Csrp1 | −1.99 | −1.59 | −2.37 | −2.35 | −0.98 | −0.69 | 2.1 | 2.29 | 3.63 | 3.69 | 1.28 | −0.43 |
| D7Ertd443e | −1.36 | −1.65 | 0.31 | 0.08 | −1.35 | −1.2 | −1.08 | −1.52 | 3.92 | 3.76 | 0.24 | −0.85 |
| Ddx3y | 1.49 | −2.38 | 2.03 | −2.53 | 1.64 | −2.96 | 1.4 | −2.46 | 2.15 | −2.56 | 2.16 | −2.88 |
| Dock5 | −1.2 | −1.34 | −1.92 | −1.31 | −0.99 | −0.82 | 0.91 | 0.2 | 3.71 | 3.64 | 1.89 | −0.52 |
| Dpy19l2 | −1 | −1.28 | −1.23 | −1.53 | −1.84 | −1.42 | −1.65 | −1.31 | −0.84 | −0.65 | −0.66 | −1.68 |
| Ebf2 | 0.49 | 0 | 4.96 | 4.73 | −0.5 | −0.28 | −0.16 | 0.03 | −0.36 | −0.28 | 0.95 | 0.92 |
| Echdc2 | −2.05 | −2.44 | −2.44 | −1.65 | −1.98 | −1.33 | −1.98 | −2.51 | −2.76 | −2.6 | −2.27 | −2.47 |
| Efna5 | −0.72 | −0.48 | 2.57 | 2.59 | −0.71 | −0.88 | −0.8 | −0.81 | −2.29 | −1.55 | −0.98 | −1.54 |
| Enpp2 | −2.15 | −2.12 | −1.57 | −1.12 | −0.36 | −0.07 | 1.33 | 0.94 | 3.9 | 3.99 | 1.3 | 1.39 |
| Erbb3 | −1.1 | −1.58 | −2.59 | −2.33 | −1.51 | −1.23 | −0.31 | 0.55 | 2.92 | 2.65 | 3.12 | 2.67 |
| Ermn | −2.61 | −1.56 | −1.55 | −2.43 | −0.87 | −0.32 | 1.24 | −1.16 | 4.52 | 4.42 | −1.34 | −0.23 |
| Etnppl | −0.93 | 0.43 | −1.47 | −1.66 | −0.01 | −0.68 | 3.06 | 2.73 | 1.11 | 1.34 | 0.09 | −1.68 |

TABLE 27-continued

Log2 fold change of expression for nuclei from rat samples

Cell types

| Gene | Granule | | Purkinje | | Basket | | Astrocytes | | Oligodendrocytes | | Oligodendrocytes & OPCs | |
|------|---------|---|----------|---|--------|---|-----------|---|-----------------|---|-------------------------|---|
| | Log2 fold change in expression | | | | | | | | | | | |
| Fa2h | −1.94 | −2.17 | −2 | −2.28 | −1.22 | −0.94 | 0.67 | −0.02 | 3.65 | 3.62 | 1.81 | 2.38 |
| Fam46a | −1.39 | −1.55 | −2.11 | −2.24 | 0.36 | 0.04 | −1.27 | −2.3 | 1.01 | 1.05 | −1.5 | −0.08 |
| Fgfr2 | −2.49 | −2.54 | −2.18 | −3.01 | 0.38 | 0.32 | 1.92 | 2.05 | 3.52 | 3.5 | 1.18 | 0.76 |
| Flrt2 | −1.36 | −1.25 | −1.31 | −1.5 | 1.93 | 1.87 | −0.14 | 0.06 | −2.38 | −1.74 | 1.23 | 1.67 |
| Fmo3 | −0.52 | −0.5 | −1.01 | −1.23 | −1.54 | −1.51 | −1.06 | −1.19 | −0.96 | −1.73 | −0.54 | −0.76 |
| Folh1 | −1.98 | −1.65 | −0.42 | −0.59 | −0.52 | −0.29 | 2.44 | 2.04 | 2.44 | 2.17 | 0.87 | 1.26 |
| Foxh1 | 2.18 | 2.29 | 3.51 | 3.05 | 2.67 | 2.39 | 2.1 | 2.45 | 0.57 | 0.29 | 1.32 | 1.11 |
| Fsip2 | −0.42 | −0.71 | −1.48 | −1.69 | −1.52 | −1.49 | −1.87 | −1.78 | −1.36 | −0.65 | −0.18 | −0.83 |
| Fxyd1 | 2.44 | 1.78 | −2.6 | −1.44 | 0.62 | 0.83 | 4.27 | 5.25 | 0.58 | 0.86 | 1.8 | 0.25 |
| Fxyd7 | 3.03 | 3.49 | −0.76 | −0.74 | −0.52 | −0.03 | 3.25 | 4.03 | −0.44 | 0.31 | 1.14 | 1.6 |
| Gad2 | −1.77 | −1.95 | 2.11 | 1.85 | 2.84 | 2.8 | 1.71 | 1.51 | −0.77 | −0.93 | 1.59 | 2.36 |
| Gal3st1 | −0.87 | −1.35 | −1.8 | −1.44 | −1.34 | −1.17 | 0.94 | 1.84 | 3.42 | 3.92 | 4.71 | 3.49 |
| Galnt5 | −1.52 | −1.16 | −2.13 | −1.37 | −2.24 | −2.85 | −1.45 | −1.47 | 2.16 | 2.25 | −1.33 | −1.71 |
| Galnt6 | −0.78 | −0.48 | −0.86 | −1.39 | −1.71 | −0.68 | 0.62 | −0.26 | 4.15 | 4.13 | 0.92 | 0.72 |
| Galr1 | −0.5 | −1.12 | −0.88 | −1.58 | −2.22 | −1.23 | −1.13 | −1.41 | −0.53 | 0.25 | −0.64 | −1.61 |
| Gdf10 | −0.65 | −1.82 | −1.07 | −1.76 | 1.37 | 1.91 | 4.69 | 4.91 | 0.64 | 0.47 | −1.33 | −2.28 |
| Gfap | −0.66 | −1.04 | −1.65 | −1.02 | 0.97 | 1.07 | 4.31 | 4.76 | 1.91 | 2.86 | 3.03 | 0.26 |
| Gja1 | −2.41 | −1.54 | −2.28 | −1.84 | 0.38 | 1.13 | 3.61 | 3.7 | 1.49 | 1.93 | 1.63 | 1.5 |
| Gjb1 | −0.95 | −1.14 | −0.73 | −1.59 | −2.2 | 0.35 | 0.83 | −0.37 | 3.97 | 3.8 | 0.05 | 2.09 |
| Gjc2 | 0.35 | −0.11 | −2.31 | −0.2 | −0.17 | 0.83 | 1.36 | 1.42 | 4.07 | 4.66 | 1.47 | 0.68 |
| Gldn | −0.7 | −0.62 | −0.9 | −0.8 | 0.6 | 0.12 | −1.34 | −0.86 | −1.55 | −1.5 | −1.27 | −1.55 |
| Gli1 | −1.52 | −1.43 | −2.48 | −1.86 | 0.67 | 0.87 | 3.84 | 4.12 | −0.02 | −0.69 | −1.38 | −0.34 |
| Glp2r | −1.23 | −1.74 | −1.93 | −2.27 | −1.99 | −2.06 | −1.81 | −1.02 | −2.02 | −2.48 | −1.09 | −0.49 |
| Glul | −1.82 | −2.14 | −1.95 | −2.16 | −0.6 | −0.49 | 2.04 | 2.31 | 3.18 | 3.28 | 1.16 | −0.18 |
| Gm136 | −1.2 | −0.95 | −1.57 | −0.08 | 0.51 | 0.28 | 0.33 | 1.28 | −0.9 | 0.02 | −1.16 | −0.41 |
| Gnb3 | 2.45 | 0.53 | −0.36 | 0.05 | 2.16 | 1.76 | 1.43 | 1.06 | −1.65 | 0.74 | 0.56 | 1.13 |
| Gng11 | −1.12 | −0.35 | −1.22 | −1.35 | −1.14 | −1.13 | −0.7 | −1.41 | −1.41 | −1.02 | −1.19 | −1.36 |
| Gpr37 | −0.75 | −1.26 | −0.37 | −1.48 | −0.47 | −0.15 | 1.49 | 1.51 | 5.01 | 4.93 | 1.03 | 0.2 |
| Gpr37l1 | −2.4 | −2.53 | −2.27 | −2.95 | −0.56 | −0.17 | 3.14 | 3.57 | 0 | 0.02 | 3.64 | 2.54 |
| Gpr63 | −0.91 | −1.26 | 4.72 | 4.71 | −0.1 | 0.42 | −1.15 | −1.14 | 0.44 | 0.21 | −1.37 | −0.78 |
| Gpx2 | 0.63 | 0.63 | −1.22 | −1.01 | −1.8 | −1.78 | −0.69 | 0.26 | −1.5 | −1.66 | −1.18 | 0.62 |
| Gramd3 | −2.44 | −2.82 | −2.7 | −2.89 | −0.28 | −0.17 | 2.42 | 2.39 | 0.91 | 0.94 | 0.83 | 0.42 |
| Grb14 | −0.58 | −0.8 | 2.06 | 1.95 | 1.42 | 1.47 | 0.64 | 0.9 | 2.39 | 2.85 | 2.34 | 2.3 |
| Gria3 | −2.79 | −2.97 | 2.31 | 1.97 | 2.18 | 2.13 | 1.13 | 0.51 | −1.3 | −1.09 | −0.06 | 0.8 |
| Grik3 | −1.75 | −1.94 | −2.31 | −2.34 | 3.39 | 3.41 | 1.97 | 2.17 | −0.63 | −0.23 | 1.43 | 2.09 |
| Grm1 | 0.14 | 0.29 | 2.75 | 2.65 | 1.42 | 1.42 | 0.29 | −0.15 | −1.5 | −1.57 | −1.83 | −0.84 |
| Grm5 | −1.39 | −1.63 | −1.61 | −1.75 | −2.06 | −1.96 | −0.49 | −0.46 | −2.09 | −1.98 | 1.26 | 1.52 |
| Gsn | −1.82 | −1.74 | −1.42 | −1.21 | −1.32 | −1.21 | 0.29 | 0.38 | 2.98 | 3.23 | 2.56 | 1.84 |
| Hapln2 | −2.36 | −1.58 | −2.48 | −2.93 | 0.38 | 0.73 | 1.04 | 0.6 | 4.18 | 4.03 | −0.9 | −1.21 |
| Hepacam | −2.77 | −2.52 | −3.05 | −3.04 | −0.87 | −0.69 | 2.01 | 1.88 | 2.82 | 2.56 | 1.87 | 1.42 |
| Hhatl | −2.58 | −2.99 | 2.42 | 2.43 | −2.61 | −2.92 | −1.52 | −0.27 | 1.48 | 0.8 | −2.07 | −1.58 |
| Hspa1b | −1.47 | −0.8 | −1.59 | −1.73 | −1.51 | −1.49 | −1.86 | −0.61 | −1.8 | −1.37 | −1.56 | −1.75 |
| Htr1b | −0.08 | −1.18 | 4.23 | 5.25 | −1.1 | −0.1 | 2.14 | 1.21 | −0.02 | −0.97 | 0.36 | 0.06 |
| Id4 | −2.25 | −1.51 | 0.03 | 1.48 | 0.02 | −0.25 | 3.58 | 4.42 | −0.6 | −0.31 | −2.33 | −2.03 |
| Igsf11 | −1.58 | −0.84 | −2.78 | −2.73 | −1.06 | −0.49 | 1.95 | 1.8 | 2.78 | 2.86 | 1.04 | 0.91 |
| Il22 | −0.77 | −1.68 | 4.05 | 5.14 | −1.59 | −0.3 | −1.29 | −1.2 | −1.21 | −1.46 | −0.89 | −0.7 |
| Il33 | −0.54 | −0.81 | −1.67 | −1.54 | 0.2 | 0.29 | 3.83 | 3.88 | 0.96 | −0.09 | 0.88 | 1.05 |
| Insc | −0.48 | −0.94 | −1.82 | −1.79 | −0.95 | −1 | 1.22 | 0.09 | 5.42 | 4.97 | 1.19 | 0.71 |
| Itgb8 | −1.56 | −2.55 | −2.62 | −2.28 | −1.41 | −1.01 | 1.25 | 0.6 | 2.17 | 1.83 | 0.98 | 1.88 |
| Itih3 | −1.4 | −1.47 | −2.24 | −2.21 | 1.69 | 1.84 | 6.54 | 5.13 | 0.94 | 1.1 | −0.54 | −0.74 |
| Itpr1 | −0.01 | 0.29 | 6.26 | 6.3 | 0.39 | 0.27 | −0.86 | −1.08 | −1.06 | −1.25 | −0.74 | −0.79 |
| Kcnc2 | −1 | −1.16 | −1.29 | −0.78 | 4.91 | 4.87 | 4.54 | 4.32 | 2.04 | 2.37 | 2.79 | 3.62 |
| Kcnj10 | −1.79 | −2.13 | −2.15 | −2.04 | −1.61 | −1.66 | 1.01 | 1.22 | 1.94 | 2.05 | 1.68 | 1.08 |
| Kif19a | 1.99 | 1.96 | −1.73 | −1.56 | 4.46 | 4.08 | 3.78 | 4.21 | 1.24 | 1.28 | 1.91 | 2.65 |
| Kit | −2.25 | −2.35 | −3.05 | −2.92 | 3.32 | 3.34 | 2.35 | 2.19 | −0.14 | 0.04 | 0.62 | 1.03 |
| Kitl | −1.86 | −2.4 | 4.43 | 4.38 | −1.83 | −2.04 | 0.59 | −0.01 | 1.38 | 0.26 | −1.23 | −1.88 |
| Klk6 | −1.22 | −1.13 | −2.29 | −0.94 | −0.26 | 0.31 | 2.67 | 1.7 | 4.92 | 5.14 | −1.35 | −0.68 |
| Leng9 | −3.11 | −2.96 | −2.08 | −3.3 | −2.97 | −2.84 | −2.71 | −2.86 | −2.52 | −2.17 | −3.35 | −2.54 |
| Lfng | −0.53 | −1.88 | −1.53 | 1.21 | 1.77 | 1.87 | 5.85 | 5.13 | 2.09 | 1.3 | 3.28 | −1.5 |
| Lgi4 | 1.39 | 1.37 | −1.7 | −2.01 | 1.29 | 1.45 | 4.7 | 5.11 | 2.14 | 2.45 | 1.14 | −0.31 |
| Lims2 | −0.59 | −0.85 | −1.53 | −1.57 | −1.14 | −0.83 | 1.81 | 2.61 | 0.17 | 0.48 | 4.75 | 4.69 |
| Mag | −0.16 | −0.77 | −2.36 | −2.4 | −0.55 | −0.24 | 1.57 | 1.32 | 5.86 | 5.98 | 2.06 | 1.33 |
| Mak | −0.79 | −1.04 | −1.8 | −1.45 | −1.89 | −1.81 | −2.21 | −0.88 | −1.56 | −1.21 | 0.07 | −1.47 |
| Mal | −1.88 | −1.62 | −2.33 | −2.89 | −0.06 | −0.15 | −0.09 | −0.56 | 4.13 | 3.91 | 0.72 | −0.35 |
| March11 | −0.99 | −0.72 | 0.38 | 0.2 | 3.41 | 3.46 | −0.85 | −0.41 | −1.94 | −2.35 | 0.55 | 0.97 |
| Marcksl1 | −1.21 | −2.27 | −2.26 | −2.39 | −1.26 | −1.41 | −1.74 | −1.66 | −0.37 | −0.77 | −2.23 | −1.92 |
| Mcam | −2.49 | −2.1 | −3.02 | −2.95 | −1.82 | −1.9 | −1 | −0.27 | 2.63 | 2.94 | 1.2 | 1.11 |
| Mff | −2.83 | −2.4 | −2.99 | −3.14 | −2.86 | −2.65 | −3.05 | −2.68 | −2.88 | −2.25 | −3.34 | −2.93 |
| Mfge8 | −1.34 | −1.25 | −1.75 | −2.07 | −0.81 | −0.77 | 2.24 | 2.62 | 0.59 | 0.6 | 2.95 | 2.84 |
| Mlc1 | −0.81 | −1.45 | −1.63 | −1.12 | 0.68 | 1.02 | 4.24 | 4.36 | 0.84 | 1.38 | 0.12 | −1.05 |
| Mog | −1.17 | −0.58 | −0.83 | −1.31 | −0.18 | −0.01 | 1.09 | 0.11 | 5.52 | 5.43 | 1.22 | 0.23 |

TABLE 27-continued

| | Log2 fold change of expression for nuclei from rat samples | | | | | | | | | | |
| | Cell types | | | | | | | | | | |
| | Granule | | Purkinje | | Basket | | Astrocytes | | Oligodendrocytes | | Oligodendrocytes & OPCs | |
| Gene | Log2 fold change in expression | | | | | | | | | | | |
|---|---|---|---|---|---|---|---|---|---|---|---|---|
| mt-Co1 | -1.48 | -0.89 | -1.53 | -0.89 | -1.19 | -0.92 | -0.81 | -1.42 | 0.89 | 0.89 | -0.57 | -0.87 |
| mt-Nd4 | -2.72 | -2.54 | -2.72 | -2.79 | -2.68 | -2.62 | -2.66 | -2.99 | -1.75 | -1.73 | -2.3 | -2.41 |
| Mybpc1 | -0.36 | -0.78 | 0.96 | 0.03 | -1.33 | -0.9 | 0.72 | 0.95 | -0.21 | -0.03 | 0.61 | -0.72 |
| Myot | -0.7 | -0.47 | -1.55 | -1.72 | -2.05 | -2.03 | -2.37 | -1.8 | -2.32 | -1.91 | -1.12 | -2.27 |
| Myrf | -1.83 | -2.06 | -0.01 | 0.18 | -0.84 | -0.35 | 1 | 0.98 | 4.6 | 4.51 | 3.25 | 2.55 |
| Ndrg1 | -0.92 | -1.79 | -1.71 | -1.5 | -0.83 | -0.6 | 1.23 | 0.88 | 4.09 | 4.36 | 0.42 | 0.81 |
| Nell1 | -0.39 | -0.57 | 4.77 | 4.64 | -1.15 | -1.12 | 0.6 | 0.18 | 0.13 | 0.28 | -0.05 | -0.95 |
| Neto1 | -0.64 | -0.45 | -0.7 | -0.46 | -0.91 | -1.21 | 0.73 | 0.89 | -1.31 | -0.58 | 4.06 | 4.1 |
| Neu4 | -1.77 | -1.89 | -1.89 | -2.02 | -1.81 | -1.1 | -1.59 | -0.25 | -2.09 | -1.67 | 1.94 | 0.51 |
| Ninj2 | -0.69 | -0.68 | -1.91 | -1.4 | -1.49 | -1.11 | 0.14 | 0.07 | 3.91 | 3.87 | 2.6 | 2.42 |
| Nkx2-2 | -2.42 | -2.87 | -2.87 | -2.96 | -2.19 | -1.78 | 1.18 | 1.97 | 1.1 | 1.08 | 0.95 | 1.14 |
| Notch1 | -0.9 | -1.7 | -1.64 | -2.33 | -0.45 | -0.45 | 2.45 | 3.22 | 1.02 | 0.85 | 4.05 | 3.5 |
| Nrk | -1.07 | -1.27 | 6.94 | 6.45 | -2.31 | -2.72 | -1.92 | -2.62 | -2.36 | -1.82 | -0.82 | -1.91 |
| Olig1 | -1.87 | -2.01 | -1.42 | -2.59 | -1.9 | -0.88 | 0.47 | 0.93 | 2.28 | 2.24 | 2.57 | 3.4 |
| Olig2 | -1.49 | -1.23 | -2.18 | -2.15 | -0.91 | -0.54 | 0.83 | 1.2 | 3.18 | 3.23 | 3.43 | 4.06 |
| Opalin | -2.14 | -0.68 | -2.47 | -2.45 | -0.88 | -0.69 | 0.2 | -0.11 | 5.59 | 5.32 | -0.03 | 1.09 |
| Pax3 | -1.45 | -1.75 | -2.64 | -2.42 | -0.56 | -0.35 | 2.3 | 2.24 | -0.92 | -0.24 | 1.44 | 1.38 |
| Pcp2 | -1.72 | -1.14 | 4.57 | 4.71 | -1 | -0.96 | -0.62 | -1.73 | -0.29 | 0.28 | 0.37 | -1.51 |
| Pdc | -0.04 | 0.21 | 2.05 | 1.59 | 0.76 | 0.57 | 0.06 | 0.18 | -0.12 | -0.97 | -0.36 | -0.28 |
| Pdgfra | -1.1 | -1.69 | -2.13 | -1.65 | -0.2 | 0.01 | 1.69 | 2.44 | -1.22 | -1.23 | 6.44 | 6.13 |
| Pdzd3 | 4.91 | 4.97 | 0.85 | 0.46 | 2.29 | 1.45 | 2.89 | 3.99 | 2.26 | 4.11 | 2.79 | 1.46 |
| Penk | 0.67 | 1.36 | -0.57 | -2.04 | 3.69 | 3.35 | 2.94 | 2.86 | 1.15 | 1.08 | -1 | -0.14 |
| Pex5l | -2.01 | -2.16 | -2.63 | -2.82 | 0.5 | 0.29 | 0.92 | 0.37 | 3.92 | 3.71 | 0.42 | -0.43 |
| Pgghg | -1.37 | -1.53 | -1.52 | -0.86 | -0.5 | -0.46 | 2.66 | 3.05 | 2.47 | 1.05 | 3.36 | 1.9 |
| Phyhip | -0.59 | -1.22 | -2.38 | -2.95 | -0.79 | -0.81 | -2.15 | -1.47 | -2.43 | -1.94 | -2.58 | -2.38 |
| Pkp3 | -1.53 | -0.89 | 5.36 | 4.98 | -1.57 | -1.54 | -0.51 | -0.4 | -1.85 | -1.43 | -0.01 | -1.8 |
| Pla2g16 | -1.56 | -2.13 | -2.68 | -2.44 | 0.09 | 0.26 | 1.3 | 1.29 | 2.8 | 3.34 | 1.7 | -0.59 |
| Plch1 | -1.69 | -1.97 | -1.6 | -1.73 | 3.43 | 3.71 | 0.27 | 0.18 | -1.39 | -1.46 | -1.53 | 1.3 |
| Plekhd1 | -1.75 | -2.05 | 3.4 | 3.19 | 1.77 | 1.53 | 1.21 | 0.88 | -0.96 | -0.66 | -2.23 | -1.15 |
| Plekhg3 | -1.08 | -1.69 | -2.42 | -2.39 | -1.7 | -1.47 | 0.18 | -0.06 | 3.51 | 3.52 | 1.23 | 1.43 |
| Pllp | -1.48 | -1.28 | -0.94 | -1.59 | -1.27 | -0.93 | 0.68 | 0.79 | 3.25 | 3.14 | 3.75 | 3.3 |
| Plp1 | -1.76 | -1.53 | -2.27 | -1.65 | -0.92 | -0.66 | 1.05 | 0.33 | 4.27 | 4.26 | 1.37 | 1.18 |
| Plpp3 | -2.77 | -2.31 | -2.19 | -2.17 | -0.13 | 0.17 | 3.13 | 3.05 | 0.56 | 0.68 | 1.34 | 1.13 |
| Plpp4 | 1.23 | 1.26 | -2.03 | -2.3 | -1.14 | -1.41 | 0.01 | -0.19 | -1.96 | -1.77 | 2.12 | 2.74 |
| Plscr1 | -1.78 | -0.8 | -2.4 | -0.13 | -2.33 | -2.31 | -1.51 | -1.26 | -2.16 | -1.65 | -0.37 | -1.18 |
| Plxnb3 | -2.49 | -2.86 | -3 | -2.95 | -1.72 | -0.48 | 1.83 | 2.32 | 2.8 | 2.62 | 3.31 | 2.69 |
| Pmp2 | -1.43 | -1.56 | -1.55 | 0.43 | -1.46 | -1.44 | -1.09 | -1.76 | -0.54 | -1.33 | -0.66 | -0.93 |
| Pmp22 | -2.6 | -2.54 | -2.93 | -2.01 | -1.12 | -1.11 | 1.06 | 0.82 | 2.25 | 2.1 | 1.46 | 1.91 |
| Ppfibp1 | -0.68 | -0.8 | -1.72 | -1.78 | 0.09 | 0.25 | 1.32 | 1.89 | 0.81 | 0.68 | 5.09 | 4.84 |
| Ppp1r14a | -1.05 | -1.41 | 1.49 | 0.53 | 0.01 | -0.67 | 0.84 | 0.97 | 4.59 | 4.73 | 3.24 | 1.07 |
| Ppp1r17 | 1.41 | 1.42 | 5.37 | 5.5 | -1.32 | -1.29 | -2.07 | -0.78 | 0.93 | 0.31 | 0.57 | -1.56 |
| Prex1 | -1.86 | -2.03 | -1.98 | -2.06 | -0.91 | -0.61 | 2.11 | 2.83 | 2.14 | 2.18 | 2.55 | 2.33 |
| Prex2 | -1.79 | -2.05 | -2.63 | -2.6 | 0.59 | 0.66 | 2.88 | 2.9 | 1.85 | 1.8 | 1.62 | 1.08 |
| Prima1 | -1.14 | -1.84 | -2.13 | -2.2 | -1.17 | -1.19 | 1.27 | 0.63 | 3.65 | 3.82 | 1.08 | 0.94 |
| Prkcg | -2.07 | -2.09 | 4.48 | 4.47 | 2.4 | 2.48 | 0.77 | 0.84 | -1.25 | -1.19 | -1.24 | 0.26 |
| Prr5 | -1.02 | -1.28 | -2.45 | -2.15 | 1.08 | 1.36 | 4.22 | 4.78 | 0.44 | 0.17 | 3.06 | 2.2 |
| Prrg3 | -1.59 | -1.92 | -2.68 | -2.76 | -2.63 | -2.27 | -2.58 | -2.54 | -2.54 | -2.15 | -1.88 | -2.5 |
| Prrx1 | -0.93 | -1.1 | -1.35 | -2 | -0.63 | -0.62 | 1.38 | 1.02 | -1.4 | -1.06 | 1.55 | 2.31 |
| Ptchd4 | 0.7 | 0.53 | 4.27 | 4.12 | -0.45 | -0.67 | -0.6 | -1.26 | -1.96 | -2.06 | -1.61 | -1.26 |
| Ptprk | -1.87 | -2.1 | -2.37 | -2.62 | 1.78 | 1.84 | -0.64 | -0.74 | 0.14 | 0.16 | 0.93 | 1.33 |
| Ptprz1 | -2.77 | -2.64 | -1.77 | -2.28 | 0.95 | 1.03 | 1.57 | 1.28 | -1.32 | -1.37 | 2.05 | 2.41 |
| Pttg1 | 0.38 | -2.17 | -1.86 | -2.7 | -2.52 | -2.5 | -2.18 | -1.72 | -1.91 | -2.4 | -1.58 | 0.62 |
| Pvalb | -1.97 | -1.65 | 2.42 | 2.95 | 3.11 | 3.09 | 2.27 | 2.41 | -0.42 | 0.04 | -1.54 | 1.08 |
| Pxdc1 | -1.68 | -1.66 | 0.41 | 1.68 | 0.1 | -0.46 | 1.23 | 1.53 | -0.6 | -0.89 | 4.35 | 4.39 |
| Qk | -3.06 | -2.98 | -3.15 | -3.15 | -2.98 | -2.84 | -1.96 | -1 | -0.8 | -0.42 | -1.41 | -1.73 |
| Rapgef3 | -1.67 | -1.99 | -2.88 | -2.39 | -0.45 | -0.47 | 1.81 | 2.08 | 3.11 | 2.91 | 3.98 | 3.49 |
| Rassf2 | -2.79 | -2.82 | -2.82 | -3.04 | -0.94 | -0.71 | 1.95 | 2.28 | 1.86 | 1.87 | 1.03 | 0.18 |
| Rbp2 | -0.55 | -0.35 | -1.2 | -1.1 | -1.55 | -1.87 | -1.18 | -2.22 | -1.52 | -1.08 | -0.57 | -1.27 |
| Rbpjl | -0.29 | -0.85 | -1.05 | -0.88 | -0.93 | -0.17 | 2.53 | 3.13 | 3.54 | 3.75 | 5.03 | 4.91 |
| Rgcc | -2.1 | -2.5 | -0.38 | -1.75 | -1.16 | -1 | 1.15 | 0.89 | -0.67 | 0.12 | 2.53 | 3.09 |
| Rgma | 0.42 | -0.44 | -2.24 | -2.1 | 0.36 | 0.55 | 3.84 | 3.87 | 1.69 | 1.76 | 1.72 | 1.02 |
| Ryr1 | -0.83 | -1.28 | 4.88 | 6.48 | -1.06 | -0.61 | -1.36 | -1.31 | -1.35 | -1.43 | -0.29 | -1.41 |
| S100b | -1.92 | -1.95 | -2.41 | -1.27 | -1.36 | -0.33 | 2.45 | 2.5 | 2.47 | 2.84 | -1.3 | 0.4 |
| S1pr1 | -1.5 | -1.68 | -2.67 | -2.38 | 1.66 | 1.58 | 5.41 | 5.46 | 1.26 | 1.47 | -2.64 | -0.82 |
| Sall1 | -1.45 | -1.87 | -2.16 | -2.32 | -0.85 | -0.6 | 0.42 | -0.1 | 4.11 | 3.86 | 0.86 | 0.89 |
| Sec14l5 | -1.19 | -1.39 | -1.41 | -1.51 | -1.39 | -1.28 | 0.22 | -0.25 | 3.53 | 3.35 | 0.69 | -1.87 |
| Serpine2 | -2 | -2.03 | -2.41 | -2.57 | -1.01 | -0.92 | 1.35 | 1.3 | -0.85 | -0.09 | 3.79 | 3.81 |
| Shisa6 | -2.56 | -2.75 | 3.71 | 3.72 | 2.31 | 2.34 | 0.98 | 1.36 | -1.38 | -1.14 | 0.96 | 1.03 |
| Skor2 | 0.35 | 0.15 | 7.17 | 6.26 | -1.51 | -1.74 | -1.67 | -0.93 | -1.45 | -2.46 | -1.38 | -1.24 |
| Slc1a3 | -2.31 | -2.8 | -2.96 | -3 | 0.14 | 0.51 | 3.28 | 3.19 | 1.2 | 1.09 | 0.35 | 0.17 |
| Slc1a6 | -2.02 | -2.38 | 4.33 | 4.24 | -1.94 | -2.53 | -2.64 | -2.58 | -2.26 | -2.2 | -1.96 | -1.95 |

TABLE 27-continued

| | Log2 fold change of expression for nuclei from rat samples | | | | | | | | | | |
|---|---|---|---|---|---|---|---|---|---|---|---|
| | Cell types | | | | | | | | | | |
| | Granule | | Purkinje | | Basket | | Astrocytes | | Oligodendrocytes | Oligodendrocytes & OPCs | |
| Gene | Log2 fold change in expression | | | | | | | | | | |
| Slc26a3 | -0.7 | -0.67 | -0.74 | -0.08 | -0.83 | -0.97 | -1.03 | -0.69 | -1.54 | -1.37 | -0.13 | -1.18 |
| Slc32a1 | -1.37 | -1.88 | 1.69 | 2.07 | 3.5 | 3.22 | 2.42 | 1.78 | -0.49 | 0.68 | -2.05 | 0.22 |
| Slc4a4 | 1.7 | 1.95 | -2.56 | -2.39 | -0.06 | 0.1 | 3.03 | 2.85 | 0.14 | 0.29 | -0.33 | -1.75 |
| Slc5a11 | -1.51 | -2.17 | -0.76 | -0.36 | -1.14 | -1.03 | 0.95 | -0.09 | 4.19 | 4.32 | -0.39 | 0.57 |
| Slc9a3 | -1.13 | -1.66 | 6.68 | 6.81 | -2.33 | -2.5 | -1.32 | -0.78 | -0.23 | -0.55 | -0.97 | -2.23 |
| Slitrk6 | -1.62 | -1.73 | -1.73 | -1.86 | -1.65 | -1.63 | 1.32 | -0.35 | 4.02 | 3.92 | 1.54 | 2.06 |
| Socs2 | -2.24 | -2.35 | 0.3 | 0.04 | 3.43 | 3 | 1.79 | 1.3 | 0.61 | 0.18 | -0.38 | 1.22 |
| Sorcs3 | -1.54 | -1.89 | -2.4 | -2.56 | 3.06 | 3.04 | -0.4 | -0.16 | -2.46 | -2.18 | 1.13 | 1.7 |
| Sox10 | -2.29 | -2.29 | -2.79 | -2.32 | -1.36 | -1.62 | 0.57 | 0.82 | 2.6 | 2.72 | 3.21 | 3.03 |
| Sox2 | -2.45 | -2.11 | -2.55 | -2.67 | -1.68 | -1.65 | 1.23 | 0.45 | 2.38 | 2.36 | 0.55 | 0.7 |
| Sox6 | -2.63 | -2.66 | -2.63 | -2.92 | -1.17 | -0.91 | 1.66 | 1.55 | -1.23 | -1.28 | 2.89 | 3.26 |
| Sox8 | -2.26 | -2.76 | -2.38 | -2.28 | -1.31 | -0.86 | 1.03 | 0.94 | 2.81 | 2.8 | 2.57 | 2.43 |
| Stag3 | -2.41 | -2.75 | -2.36 | -2.86 | -2.45 | -2.66 | -2.3 | -2.57 | -1.78 | -2.89 | -3.01 | -2.68 |
| Stk32a | -2.57 | -2.47 | -2.58 | -2.83 | -0.85 | -0.5 | 2.36 | 2.02 | -0.65 | -0.38 | 1.9 | 1.99 |
| Sulf2 | -1.68 | -1.86 | -2.41 | -2.64 | -0.4 | -0.91 | 1.07 | 1.09 | 1.99 | 1.71 | 3.51 | 3.6 |
| Susd5 | -0.99 | -1.02 | -1.65 | -1.55 | -1.32 | -1.67 | 0.55 | 1.15 | -1.52 | -0.81 | 3.65 | 3.85 |
| Tceal7 | -1.46 | -0.36 | -1.57 | -1.01 | -0.22 | -1.47 | -1.17 | -1.76 | -1.77 | -1.36 | -1.54 | -1.72 |
| Tfap2b | -0.01 | -0.31 | -1.49 | -1.7 | 3.88 | 4.08 | 2.84 | 2.81 | 0.11 | 0.68 | -0.5 | 1.62 |
| Thbs2 | -0.08 | -0.15 | -0.7 | -0.94 | -0.48 | -0.52 | -0.53 | 0.7 | -1.22 | 0.63 | 1.5 | 1.59 |
| Tmem125 | -0.83 | -1.74 | -1.73 | -1.87 | -0.88 | -1.63 | 1.19 | -0.53 | 5.17 | 6.33 | -0.95 | 1.41 |
| Tmem132d | -0.47 | -0.67 | 2.04 | 2.07 | -1.42 | -1.4 | 0.02 | 0.36 | -1.45 | -1.2 | 2.96 | 3.08 |
| Tmem63a | -1.3 | -1.61 | -2 | -1.85 | -0.8 | -0.96 | 0.81 | 0.25 | 3.82 | 4.16 | 0.02 | -0.68 |
| Tmem98 | -1.28 | -1.11 | -1.87 | -1.27 | -1.09 | -1.13 | 1.02 | -0.2 | 3.93 | 4.2 | 2.23 | -0.19 |
| Tnc | -1.46 | -1.08 | -0.3 | -2.19 | 1.81 | 1.92 | 4.93 | 4.56 | 1.08 | 0.67 | 1.94 | 2.06 |
| Tnfrsf13c | -1.8 | -1.92 | -1.91 | -2.05 | -1.83 | -1.81 | -2.17 | -2.11 | -0.14 | -0.97 | -1.89 | -2.07 |
| Tns3 | -1.12 | -1.52 | -1.94 | -2.45 | -1.37 | -1.07 | 1.48 | 1.47 | 2.19 | 2.38 | 3.19 | 3.07 |
| Trabd2b | -0.13 | -0.19 | 5.23 | 6.9 | -0.5 | -0.85 | -0.62 | -0.67 | -1.49 | -1.5 | 0.25 | 0.44 |
| Tril | -1.54 | -1.72 | -2.84 | -1.78 | -0.28 | -0.24 | 3.54 | 3.6 | 0.75 | 0.34 | 4.03 | 3.63 |
| Trpc3 | -2.35 | -2.37 | 6.43 | 6.09 | 1.13 | 0.98 | 1.94 | 1.4 | -0.99 | -1.21 | -1.19 | 0.17 |
| Trpc7 | -0.9 | -0.88 | 1.04 | 0.86 | 3.85 | 3.74 | 2.17 | 2.28 | 0.32 | 0.61 | 0.44 | 1.91 |
| Tshb | -1.96 | -2.08 | 0.55 | 0.2 | -1.99 | -0.64 | -0.54 | -1.12 | 2.99 | 2.73 | -2.04 | 1.44 |
| Tspan11 | -0.91 | -0.82 | 2.89 | 2.89 | -1.8 | -2.1 | 0.43 | 0.02 | -1.88 | -2.65 | 2.37 | 2.18 |
| Tspan2 | -1.46 | -1.6 | 2.28 | 2.19 | -0.88 | -0.59 | 0.79 | 0.54 | 4.2 | 4.19 | 2.77 | 3.08 |
| Tuba8 | 0.61 | -0.36 | 4.24 | 4.29 | 2.15 | 1.64 | 1.6 | 2.44 | -0.13 | 0.21 | -0.48 | 0.97 |
| Tubb2b | -2.38 | -2.03 | -2.48 | -2.6 | -0.95 | -1.09 | 1.25 | 1.33 | 1.37 | 2.46 | 2.62 | 2.12 |
| Txnip | -2.28 | -1.48 | -2.4 | -2.85 | 0.17 | -0.41 | 1.18 | 0.92 | 3.71 | 3.72 | 2.75 | 2.05 |
| Ube2b | -2.67 | -2.45 | -2.62 | -2.63 | -2.92 | -3.03 | -2.59 | -3 | | -2.81 | -2.95 | -3.01 |
| Ugt8a | -2.09 | -2.14 | -1.72 | -2.23 | -0.18 | 0.01 | 0.37 | -0.47 | 3.01 | 3.07 | 1.31 | 1.17 |
| Upp1 | -0.63 | -1.51 | -2.09 | -2.22 | -0.98 | -0.65 | 1.65 | 0.49 | -0.92 | -1.21 | -0.33 | -0.49 |
| Vstm2b | -2.23 | -0.18 | -1.26 | -1.24 | 0.33 | -0.04 | -0.12 | 0.19 | -2.58 | -2.1 | 2.44 | 2.15 |
| Wfdc1 | -0.97 | -0.59 | 3.43 | 3.16 | 3.72 | 3.91 | 0.85 | 1.81 | -1.21 | 0.02 | -0.75 | 2.01 |
| Xrra1 | -1.26 | -1.14 | -1.77 | -1.68 | -1.15 | -1.28 | -1.54 | -1.29 | -1.19 | -0.79 | -1.26 | -0.45 |
| Zcchc24 | -1.92 | -2.07 | -2.53 | -2.71 | -0.92 | -0.46 | 2.29 | 2.96 | 2.65 | 2.78 | 4.36 | 3.62 |
| Zeb2 | -3.05 | -2.13 | -2.14 | -1.92 | -1.28 | -1.03 | 1.26 | 1.19 | 3.01 | 3.04 | 1.58 | 1.66 |
| Zfp36l1 | 0.18 | -2.41 | -2.4 | -1.94 | -1.48 | -1.19 | 0.82 | 1.18 | 1.04 | 0.41 | 1.6 | 1.36 |

The log 2 fold change in expression for the 250 most variable genes across mouse, rat, and human nuclei between the normalized RNAseq results from the nuclei of the seven cells types compared to the RNAseq results for the sorted nuclei from each individual cell type is shown in Table 28. Negative values indicate reduced expression in the nuclei of the cell type compared to the normalized value across nuclei from all cell types analyzed, and a positive value indicates increased expression compared to the normalized value across nuclei from all cell types analyzed. Two replicate samples of nuclei from each cell type was analyzed.

TABLE 28

| | Log2 fold change in expression for nuclei from mouse samples | | | | | | | | | | | | | | |
|---|---|---|---|---|---|---|---|---|---|---|---|---|---|---|---|
| | Cell type | | | | | | | | | | | | | | |
| | Granule | | | Purkinje | | | Basket | Astrocytes | | Oligo | | OPCs | | | |
| Replicate | 861 | 862 | 996 | 327 | 329 | 639 | 640 | 859 | 860 | 993 | 994 | 855 | 856 | 857 | 858 |
| 3110035E14Rik | -2.30 | -0.70 | -1.74 | -1.70 | -1.46 | -1.41 | -0.51 | -0.68 | -1.09 | -2.44 | -2.36 | 0.95 | 0.21 | 4.34 | 4.46 |
| 1810041L15Rik | -2.34 | -2.52 | -2.21 | -2.10 | -1.78 | -0.67 | -1.99 | -1.76 | -1.89 | -2.53 | -2.23 | -0.98 | -1.48 | 2.72 | 2.53 |
| 2810459M11Rik | -2.01 | -1.23 | -1.91 | -1.48 | 0.01 | -0.78 | -2.12 | -1.52 | -1.58 | 1.25 | 0.90 | -1.06 | -2.04 | 1.31 | 0.63 |
| A2m | 0.71 | -0.85 | 0.73 | -0.60 | -0.30 | -0.28 | -0.71 | -1.59 | -1.65 | 5.43 | 5.45 | -0.89 | -0.28 | -1.64 | -1.44 |

TABLE 28-continued

Log2 fold change in expression for nuclei from mouse samples

Cell type

| Replicate | Granule | | | Purkinje | | | Basket | | | Astrocytes | | Oligo | | OPCs | |
|---|---|---|---|---|---|---|---|---|---|---|---|---|---|---|---|
| | 861 | 862 | 996 | 327 | 329 | 639 | 640 | 859 | 860 | 993 | 994 | 855 | 856 | 857 | 858 |
| Adamts15 | −1.30 | −1.09 | −1.23 | −0.90 | −1.53 | −0.02 | 4.30 | 4.17 | 4.24 | −0.76 | 0.50 | −1.42 | −1.73 | −0.89 | −1.68 |
| Adra1a | −1.45 | −1.88 | −1.23 | −1.04 | −0.94 | −1.73 | −1.49 | −1.61 | −1.96 | 3.26 | 3.77 | −0.90 | −0.89 | 1.94 | 1.93 |
| AI593442 | −0.21 | −1.44 | −1.50 | 3.52 | 3.41 | 2.83 | 2.43 | 2.43 | 2.72 | −1.53 | −0.83 | −1.68 | −0.59 | 0.62 | 1.10 |
| Aldh1a1 | −0.11 | −2.77 | 0.23 | −1.22 | −0.89 | −0.07 | −0.68 | −0.38 | −2.07 | 4.35 | 4.78 | 1.65 | 1.69 | 1.32 | 2.02 |
| Anln | −0.51 | −0.50 | −0.79 | −0.01 | −0.10 | −1.21 | −1.23 | −1.11 | −1.14 | −1.43 | −1.06 | 3.86 | 4.03 | 0.07 | 0.18 |
| Apcdd1 | −0.61 | −2.01 | −0.49 | −1.58 | −1.85 | −1.18 | 1.99 | 1.87 | 1.79 | 0.07 | −0.37 | −0.99 | −1.77 | 0.02 | −0.61 |
| Apod | −2.02 | −2.36 | −1.40 | −2.36 | −2.57 | −2.25 | −1.94 | −2.44 | −2.02 | −0.73 | −0.49 | 2.81 | 2.93 | −0.55 | −0.61 |
| Aqp4 | −0.18 | −0.84 | −0.39 | −1.56 | −1.33 | 0.15 | −0.60 | −0.88 | −0.56 | 3.93 | 3.85 | 0.47 | 0.60 | −2.11 | −1.21 |
| Arhgef33 | −1.92 | −1.77 | −1.87 | 6.78 | 6.81 | 6.28 | −1.11 | −1.54 | −1.27 | 0.42 | 0.41 | −1.75 | −1.66 | −2.04 | −2.03 |
| Ascl1 | −0.70 | −2.20 | −2.17 | −0.39 | −0.80 | −0.59 | 0.65 | 0.64 | 0.24 | 1.45 | 0.46 | −1.15 | −0.71 | 3.36 | 2.93 |
| Asgr1 | −2.54 | −1.07 | −2.46 | −1.86 | −1.23 | −2.56 | 1.34 | 2.02 | 1.76 | −2.40 | −2.17 | −2.39 | −1.97 | −0.04 | −1.75 |
| Aspa | −2.08 | −2.16 | −1.86 | −1.28 | −1.01 | −1.44 | −2.23 | −1.89 | −2.11 | 0.35 | 0.39 | 4.71 | 4.67 | 2.27 | 2.44 |
| Atp1a2 | −1.21 | −1.25 | −0.92 | −2.55 | −2.65 | −1.09 | −1.39 | −1.77 | −1.76 | 4.43 | 4.42 | 0.12 | 0.07 | 1.83 | 1.66 |
| Atp2a3 | −1.32 | −1.66 | −2.00 | 7.64 | 7.26 | 6.62 | −1.64 | −1.99 | −1.68 | −2.25 | −1.63 | −0.65 | −1.57 | −1.94 | −1.89 |
| B3gnt5 | −1.34 | −1.27 | −2.04 | 2.76 | 3.11 | 2.02 | −0.05 | −0.31 | 0.10 | −1.35 | −1.03 | −0.46 | −0.08 | 1.15 | 0.66 |
| B3gnt7 | −1.23 | −1.55 | −2.09 | −1.99 | −1.10 | −2.19 | −2.24 | −0.79 | −1.07 | −2.03 | −2.06 | −1.01 | −0.78 | −0.25 | 0.17 |
| Bcl11a | −0.56 | −0.87 | −1.49 | 5.76 | 5.60 | 5.16 | −0.60 | −0.01 | −0.31 | −1.90 | −1.37 | −0.61 | −0.31 | −0.71 | −0.92 |
| Bhlhe22 | −1.49 | 1.13 | −0.15 | −0.83 | −0.91 | −0.68 | 2.99 | 3.48 | 3.73 | −1.28 | −2.40 | −1.27 | −1.92 | −0.66 | −0.49 |
| C1ql1 | −1.32 | −1.53 | −2.03 | −1.71 | −0.99 | −1.74 | −1.01 | −1.17 | −1.11 | −0.86 | 0.39 | 0.15 | −0.99 | 4.35 | 4.16 |
| C1ql2 | −1.79 | −1.07 | −1.72 | −0.07 | −0.60 | −1.82 | −1.24 | −1.18 | −0.82 | −1.66 | −1.69 | −0.93 | 0.05 | 3.86 | 3.12 |
| Cacna1g | −0.44 | −0.33 | 0.35 | 3.85 | 3.63 | 3.89 | −0.49 | −0.44 | −0.50 | −1.89 | −1.16 | −1.53 | −2.05 | −1.14 | −0.70 |
| Cacng4 | −1.91 | −2.05 | −1.82 | −1.66 | −1.86 | −1.57 | −0.43 | −0.38 | −0.51 | 2.45 | 2.81 | −0.18 | −0.78 | 3.35 | 3.42 |
| Calb1 | 0.54 | 0.42 | −0.48 | 5.59 | 7.47 | 7.10 | −0.93 | −1.70 | −1.01 | −1.31 | −1.62 | −1.50 | −1.68 | −2.10 | −1.92 |
| Camk1g | −2.25 | −2.20 | −1.50 | −2.15 | −1.51 | 0.34 | 2.86 | 2.80 | 2.69 | −2.35 | −2.77 | −1.45 | −2.39 | −1.24 | 0.59 |
| Car8 | −1.82 | −1.74 | −2.36 | 8.03 | 7.72 | 6.68 | −1.24 | −2.01 | −1.92 | −2.43 | −2.46 | −1.62 | −1.56 | 0.43 | 0.31 |
| Carns1 | −2.15 | −0.65 | −1.16 | −1.60 | −0.92 | −0.69 | −1.42 | −1.59 | −1.05 | −0.62 | −0.73 | 3.38 | 3.78 | 1.10 | 0.06 |
| Casq2 | −1.15 | −1.75 | −2.23 | 6.55 | 5.98 | 6.25 | −1.24 | −1.38 | −1.45 | 0.93 | 0.66 | −0.29 | −0.08 | −1.58 | −0.90 |
| Cbln2 | −1.45 | −0.60 | −1.38 | −1.28 | −1.10 | 0.98 | −1.53 | −0.23 | −1.53 | −1.32 | −1.35 | −0.45 | −1.35 | −0.26 | 0.24 |
| Ccdc152 | −2.20 | −2.97 | −1.66 | −0.60 | −0.84 | −1.28 | −2.44 | −2.76 | −1.06 | 1.83 | 1.92 | 3.74 | 3.87 | −2.21 | −0.48 |
| Ccdc180 | −1.40 | −1.53 | −1.97 | −0.74 | −0.54 | −2.02 | −2.16 | −1.71 | −1.66 | −1.88 | −1.69 | −1.03 | −0.85 | −1.43 | −1.55 |
| Ccnd2 | −1.68 | −1.93 | −2.46 | −0.85 | −0.55 | −1.26 | 0.61 | 1.20 | 0.99 | −2.95 | −2.17 | −1.33 | −1.33 | −0.39 | 0.62 |
| Cd82 | −2.16 | −1.41 | −2.29 | −1.82 | −1.53 | −2.68 | −2.59 | −2.03 | −2.01 | −1.88 | −2.40 | 2.55 | 2.71 | 0.73 | 0.96 |
| Cd9 | −1.85 | −2.21 | −2.06 | −2.25 | −1.89 | −2.64 | −2.30 | −2.35 | −1.94 | 1.54 | 0.94 | 2.16 | 2.45 | 3.02 | 3.07 |
| Cdh19 | −0.84 | −1.44 | −0.71 | −1.19 | −0.94 | −1.39 | −0.29 | −1.34 | −0.89 | 3.36 | 4.10 | 5.06 | 5.79 | 4.54 | 4.07 |
| Cdhr1 | −1.87 | −1.81 | −0.94 | −2.19 | −0.98 | −2.38 | −1.97 | −0.67 | −0.62 | −1.06 | −1.11 | −1.32 | −1.38 | −1.51 | 1.34 |
| Cldn11 | −2.42 | −1.66 | −2.12 | −2.03 | −1.31 | −1.97 | −2.25 | −2.16 | −2.29 | −1.56 | −2.35 | 5.02 | 5.31 | 3.56 | 3.03 |
| Clec7a | −1.42 | −1.37 | −1.34 | −0.31 | −1.04 | −1.44 | −1.50 | −1.45 | −0.69 | −1.28 | 0.12 | −0.36 | −1.31 | −1.15 | −1.39 |
| Clmn | −2.46 | −2.67 | −2.36 | 2.92 | 3.14 | 2.53 | −2.61 | −2.71 | −2.76 | 2.20 | 2.40 | 2.53 | 2.67 | 0.81 | 0.79 |
| Cmtm5 | −1.31 | −1.06 | −1.27 | −1.54 | −1.48 | −2.13 | −2.69 | −2.54 | −2.28 | 3.59 | 3.72 | 2.42 | 2.79 | 1.08 | 1.50 |
| Cntn3 | −2.21 | −1.99 | −1.91 | 4.75 | 4.25 | 3.77 | 2.77 | 2.59 | 2.78 | −2.19 | −1.75 | 1.59 | 1.77 | 1.18 | 1.05 |
| Cntnap5a | −1.54 | −1.64 | −1.82 | 2.79 | 2.49 | 2.42 | −1.71 | −0.92 | −1.42 | −2.15 | −1.56 | −1.46 | −1.32 | −1.65 | −1.61 |
| Cobl | −2.73 | −2.86 | −2.74 | −1.64 | −1.13 | 0.17 | −1.61 | −1.83 | −1.64 | −3.11 | −2.60 | 2.45 | 2.33 | 2.67 | 2.81 |
| Col5a3 | −1.69 | −2.14 | −2.48 | −2.06 | −1.50 | −2.37 | −2.15 | −1.82 | −1.96 | 2.42 | 2.57 | −0.61 | −0.77 | 1.58 | 1.63 |
| Col6a1 | −2.37 | −1.50 | −2.46 | −1.86 | −1.58 | −0.22 | −2.01 | −0.70 | −1.21 | −2.91 | −2.93 | −1.79 | −2.10 | −2.82 | −2.19 |
| Cpm | −1.91 | −1.91 | −1.86 | −1.18 | −0.82 | −1.77 | −1.53 | −1.13 | −1.40 | −2.10 | −2.06 | 3.73 | 3.65 | 2.03 | 1.94 |
| Cryab | −1.46 | −1.83 | −1.49 | −2.52 | −2.32 | −2.99 | −3.02 | −2.34 | −1.90 | −0.21 | 0.18 | 3.00 | 3.07 | 1.61 | 1.46 |
| Cspg4 | −1.64 | −1.89 | −2.11 | −2.29 | −1.99 | −2.34 | −1.02 | −1.36 | −1.33 | −1.76 | −0.87 | 0.35 | 0.38 | 3.61 | 3.62 |
| Csrp1 | −1.79 | −1.84 | −1.79 | −0.94 | −0.78 | −1.52 | −2.12 | −2.14 | −1.77 | 3.33 | 3.44 | 2.98 | 2.97 | 0.73 | 1.25 |
| D7Ertd443e | −2.00 | −1.97 | −2.48 | −1.30 | −1.22 | −0.61 | −2.23 | −1.88 | −1.75 | −1.66 | −0.83 | 4.84 | 4.69 | 2.01 | 2.27 |
| Ddx3y | 1.94 | 2.23 | −2.92 | 2.53 | 0.73 | 2.27 | −2.88 | 2.14 | 2.17 | −2.41 | −2.90 | 2.74 | 2.72 | 2.58 | 2.55 |
| Dock5 | −2.14 | −2.24 | −1.93 | −0.88 | −0.60 | −1.14 | −2.25 | −2.33 | −1.97 | −1.07 | −0.50 | 3.37 | 3.43 | 0.20 | 0.04 |
| Dpy19l2 | −1.57 | −1.44 | −2.00 | −0.25 | −0.04 | −1.67 | −1.82 | −1.33 | −1.49 | −1.72 | −1.15 | −0.32 | −0.20 | −0.83 | −0.84 |
| Ebf2 | −1.08 | −1.53 | −2.18 | 5.10 | 4.81 | 4.58 | −1.38 | −0.95 | −0.83 | −0.49 | 0.05 | −0.22 | −0.01 | −0.68 | −0.92 |
| Echdc2 | 0.86 | 1.15 | 0.28 | −0.41 | −0.17 | −1.56 | 0.30 | 0.64 | 0.52 | −0.93 | 0.36 | −0.95 | −1.46 | −1.35 | −1.28 |
| Efna5 | −1.34 | −1.36 | −1.41 | 2.65 | 2.47 | 2.57 | 3.31 | 2.98 | 3.11 | −2.19 | −1.18 | −1.13 | −1.18 | −1.59 | −1.46 |
| Enpp2 | −1.93 | −1.81 | −1.59 | −0.69 | −0.58 | −0.41 | −1.11 | −1.54 | −1.13 | −1.92 | −1.44 | 4.97 | 4.93 | 3.37 | 3.36 |
| Erbb3 | −1.94 | −1.40 | −1.42 | −1.21 | −0.96 | −2.15 | −2.42 | −1.89 | −2.05 | −2.72 | −2.20 | 3.17 | 3.49 | 2.48 | 3.00 |
| Ermn | −0.02 | −1.09 | −1.47 | −0.58 | −0.34 | −2.01 | −1.62 | −1.03 | −1.61 | −2.45 | −2.22 | 5.69 | 5.67 | 2.63 | 2.25 |
| Etnppl | −1.33 | −0.62 | 0.32 | −1.50 | −1.89 | −0.27 | −0.51 | −1.20 | −1.85 | 4.88 | 4.77 | 1.39 | 1.04 | −0.19 | −0.73 |
| Fa2h | 0.62 | 0.10 | 0.27 | −1.59 | −1.50 | −1.40 | −2.05 | −1.87 | −1.94 | −1.97 | −2.13 | 3.79 | 3.68 | 2.50 | 2.29 |
| Fam46a | −2.38 | −1.51 | −1.81 | −2.22 | −1.42 | −1.15 | −2.00 | −1.62 | −0.92 | −2.25 | −0.47 | 3.58 | 3.33 | 2.47 | 2.11 |
| Fgfr2 | −1.29 | −1.18 | −1.83 | −1.94 | −1.09 | −1.77 | −2.43 | −1.55 | −1.44 | 2.95 | 2.51 | 2.88 | 2.95 | 0.92 | 0.88 |
| Flrt2 | −2.33 | −2.70 | −2.58 | −0.14 | −0.08 | 0.32 | 3.47 | 3.09 | 3.29 | −2.18 | −1.40 | −0.54 | −0.24 | 0.64 | 0.83 |
| Fmo3 | 0.22 | −1.14 | −1.72 | 0.48 | 0.11 | −1.86 | −2.44 | −0.75 | −0.97 | −0.49 | −0.22 | 0.72 | 0.21 | −0.32 | −0.02 |
| Folh1 | −0.81 | −1.86 | −0.99 | −1.24 | −0.99 | −1.38 | −1.92 | −2.37 | −2.57 | 3.04 | 3.76 | 4.35 | 4.54 | 0.68 | 0.91 |
| Foxh1 | −2.61 | −2.57 | −2.86 | −2.78 | −2.63 | −2.41 | −2.68 | −2.64 | −2.14 | −2.81 | −2.84 | −2.01 | −1.33 | −2.71 | −2.00 |
| Fsip2 | −1.26 | −1.51 | −2.88 | −1.40 | −1.35 | −1.46 | −2.84 | −1.24 | −1.17 | −2.84 | −1.24 | −1.17 | −1.76 | −1.66 | −0.96 |
| Fxyd1 | −1.67 | −0.83 | −0.64 | −1.74 | −2.04 | −1.71 | −2.10 | −2.25 | −2.30 | 5.16 | 5.67 | −1.45 | 0.33 | −2.16 | −1.78 |
| Fxyd7 | −2.20 | −1.62 | −1.12 | −1.04 | 0.06 | −0.98 | −1.80 | −2.05 | −1.67 | 3.96 | 3.16 | −2.31 | −1.86 | −0.88 | −0.32 |
| Gad2 | −2.05 | −2.08 | −2.22 | 2.04 | 1.74 | 1.78 | 2.50 | 2.47 | 2.52 | −2.09 | −2.37 | −1.62 | −1.72 | −1.81 | −0.78 |
| Gal3st1 | −1.68 | −1.91 | −2.29 | −0.67 | −0.77 | 0.08 | −1.44 | −1.33 | −1.30 | −1.52 | −1.46 | 3.72 | 3.74 | 3.67 | 3.23 |
| Galnt5 | −1.68 | −1.37 | −1.56 | −0.22 | −0.09 | −1.33 | −1.47 | −1.50 | −1.14 | −1.62 | −1.45 | 5.74 | 5.65 | 2.87 | 2.74 |

TABLE 28-continued

Log2 fold change in expression for nuclei from mouse samples

| | | Granule | | | Purkinje | | | Basket | | | Astrocytes | | Oligo | | OPCs | |
|---|---|---|---|---|---|---|---|---|---|---|---|---|---|---|---|---|
| Replicate | 861 | 862 | 996 | 327 | 329 | 639 | 640 | 859 | 860 | 993 | 994 | 855 | 856 | 857 | 858 |
| Galnt6 | −0.54 | −0.56 | −2.00 | −0.86 | −0.76 | −1.55 | −1.69 | −0.39 | −0.56 | −2.03 | −1.04 | 4.60 | 4.68 | 2.53 | 2.26 |
| Galr1 | 0.54 | 0.76 | 0.29 | −0.08 | 0.46 | −1.39 | −0.57 | −1.61 | −0.82 | −1.60 | 0.06 | 1.51 | 1.93 | 0.79 | 0.14 |
| Gdf10 | 1.03 | 0.71 | 0.85 | −1.54 | −0.80 | −1.35 | −0.55 | −0.60 | −1.64 | 5.78 | 5.79 | −0.73 | −0.67 | −0.86 | −1.61 |
| Gfap | −1.80 | −1.53 | −2.11 | −0.46 | −0.99 | −1.54 | −2.03 | −1.75 | −1.47 | 1.91 | 1.61 | −1.27 | −1.18 | −0.96 | −1.64 |
| Gja1 | −1.29 | −1.32 | −0.65 | −0.84 | −0.88 | −0.26 | −1.63 | −1.02 | −1.33 | 3.93 | 3.83 | 0.54 | 0.25 | −0.66 | −0.51 |
| Gjb1 | −1.20 | −1.13 | −1.69 | −1.29 | −0.42 | −1.60 | −2.20 | −1.85 | −0.95 | −1.94 | −1.66 | 3.26 | 3.84 | 1.50 | 1.05 |
| Gjc2 | −1.66 | −2.32 | −1.92 | −1.78 | −1.91 | −1.80 | −0.99 | −1.45 | −0.45 | −1.16 | −2.05 | 3.48 | 3.83 | 2.00 | 1.90 |
| Gldn | −0.82 | −0.40 | −0.58 | 0.61 | 0.25 | −0.67 | −0.93 | −0.29 | −0.46 | −1.16 | −0.52 | −0.03 | −1.22 | −0.58 | −0.66 |
| Gli1 | −1.14 | −0.72 | 0.09 | −0.95 | −0.61 | −2.37 | −1.95 | −0.79 | −1.23 | 4.92 | 5.16 | −0.79 | −0.12 | −0.92 | −0.74 |
| Glp2r | 3.65 | 3.73 | 3.82 | 4.68 | 4.90 | 3.13 | −0.06 | −0.58 | −0.85 | 3.03 | 3.34 | 2.74 | 3.33 | 2.76 | 2.49 |
| Glul | −0.99 | −1.15 | −1.83 | −2.38 | −2.37 | −1.80 | −2.41 | −2.33 | −2.46 | 1.38 | 1.70 | 3.31 | 3.53 | 0.42 | 0.27 |
| Gm136 | −1.52 | −1.46 | −2.36 | −1.38 | −0.92 | −2.82 | −2.28 | −2.03 | −2.08 | −2.69 | −1.36 | −1.78 | −2.72 | −1.83 | −1.94 |
| Gnb3 | −1.99 | −1.52 | −2.18 | −2.06 | −1.48 | −2.02 | −1.88 | −1.64 | −2.08 | −2.54 | −2.11 | −2.11 | −2.57 | −1.95 | −2.23 |
| Gng11 | 1.46 | −0.20 | −1.42 | −1.32 | −1.14 | −1.52 | −1.57 | −0.33 | −0.39 | 3.61 | 3.19 | 5.37 | 5.74 | 3.01 | 4.52 |
| Gpr37 | −1.98 | −1.37 | −2.32 | −2.19 | −1.81 | −2.02 | −2.35 | −2.10 | −2.51 | −0.14 | 0.43 | 6.04 | 6.36 | 2.59 | 2.85 |
| Gpr37l1 | −1.67 | −1.50 | −2.05 | −0.47 | 0.12 | −0.30 | −2.20 | −2.87 | −2.32 | 3.07 | 2.48 | −1.11 | −1.43 | 1.56 | 1.57 |
| Gpr63 | −0.13 | −0.79 | −0.41 | 4.79 | 4.58 | 4.54 | 0.76 | 0.44 | 0.55 | 0.02 | −0.35 | −0.25 | −0.60 | −0.05 | −0.23 |
| Gpx2 | −2.15 | −1.17 | −1.12 | −1.98 | −1.79 | −2.18 | −2.23 | −0.62 | −2.23 | −2.02 | −2.05 | −1.02 | −1.47 | −1.89 | −1.57 |
| Gramd3 | −1.82 | −2.10 | −1.83 | −1.94 | −1.95 | −1.96 | −2.22 | −2.25 | −2.11 | 2.89 | 2.99 | 1.94 | 1.80 | 1.76 | 1.56 |
| Grb14 | −1.83 | −2.10 | −1.61 | 1.49 | 1.71 | 1.35 | 0.20 | 0.26 | 0.31 | −2.61 | −2.45 | 3.26 | 3.19 | 2.56 | 2.43 |
| Gria3 | −2.85 | −2.94 | −3.11 | 3.02 | 2.61 | 2.27 | 2.70 | 2.53 | 2.62 | −2.75 | −2.97 | −1.81 | −2.22 | 0.68 | 0.60 |
| Grik3 | −2.29 | −2.64 | −2.33 | −2.11 | −2.13 | −0.01 | 2.87 | 2.64 | 2.62 | −2.33 | −2.47 | −1.14 | −1.10 | 0.98 | 0.90 |
| Grm1 | 1.50 | 1.49 | 1.29 | 3.30 | 3.09 | 2.58 | 1.79 | 1.53 | 1.63 | −2.59 | −2.16 | −2.21 | −2.38 | −2.68 | −2.60 |
| Grm5 | −1.30 | −1.34 | −1.52 | −0.90 | −0.43 | 1.84 | −0.64 | −0.28 | −0.35 | −1.50 | −1.48 | 0.25 | −0.14 | 3.84 | 3.94 |
| Gsn | −2.38 | −2.33 | −2.45 | −2.12 | −1.26 | −2.59 | −2.35 | −1.79 | −1.66 | −0.45 | −1.00 | 3.08 | 3.62 | 2.85 | 2.96 |
| Hapln2 | −2.37 | −2.50 | −2.00 | −2.59 | −1.73 | −1.26 | −0.59 | −0.91 | −0.56 | −1.79 | −1.55 | 3.73 | 3.69 | −0.73 | −0.22 |
| Hepacam | −1.75 | −1.64 | −1.46 | −2.68 | −2.62 | −1.84 | −1.94 | −2.53 | −2.58 | 3.68 | 3.73 | 3.12 | 3.15 | 1.40 | 1.64 |
| Hhatl | −1.57 | −2.10 | −1.96 | 1.12 | 1.42 | 0.98 | −2.82 | −2.05 | −2.18 | −0.73 | −0.16 | 1.26 | 1.63 | −0.68 | −0.04 |
| Hspa1b | −1.20 | −1.84 | −1.09 | −1.70 | −1.50 | −1.91 | −0.89 | −1.26 | −0.89 | −1.74 | −1.78 | 0.08 | −1.05 | 0.05 | −1.86 |
| Htr1b | −1.44 | −1.40 | −1.37 | 5.67 | 4.23 | 5.79 | −1.52 | −1.48 | −0.76 | −0.45 | −1.34 | −1.31 | −1.35 | −1.18 | −0.11 |
| Id4 | 1.40 | −0.67 | −1.05 | −0.03 | 0.92 | 0.30 | −1.08 | −1.95 | −0.72 | 4.98 | 4.12 | −0.69 | −0.76 | −1.25 | −2.16 |
| Igsf11 | −1.44 | −2.33 | −1.65 | −2.04 | −2.05 | −1.36 | −2.28 | −2.55 | −2.57 | 2.34 | 2.75 | 3.45 | 3.25 | 1.84 | 1.43 |
| Il22 | −1.96 | −0.85 | −1.22 | 5.89 | 5.31 | 3.94 | 2.12 | 2.73 | 2.34 | −1.82 | −1.86 | −1.82 | −1.19 | −1.68 | −1.29 |
| Il33 | −1.68 | −1.90 | −2.44 | 0.14 | −0.42 | −1.42 | −1.73 | −1.25 | −1.42 | −1.56 | −1.53 | 4.72 | 4.70 | 1.85 | 2.76 |
| Insc | −1.35 | −1.12 | −1.57 | −1.11 | −1.52 | −1.69 | −1.91 | −1.41 | −1.30 | −1.57 | −0.88 | 4.98 | 4.84 | 2.57 | 2.47 |
| Itgb8 | −1.41 | −1.96 | −1.76 | −2.48 | −2.45 | −1.19 | −1.40 | −1.68 | −1.60 | 2.23 | 2.35 | 2.87 | 2.82 | 2.52 | 2.57 |
| Itih3 | −0.76 | 0.38 | −0.09 | −1.87 | −1.44 | −2.28 | −1.40 | −1.50 | −0.97 | 6.46 | 6.34 | 1.54 | 1.58 | 0.26 | 0.89 |
| Itpr1 | −1.40 | −1.45 | −1.11 | 5.48 | 5.02 | 5.10 | 0.12 | −0.19 | −0.15 | −1.06 | −1.07 | −1.00 | −1.31 | −1.18 | −1.00 |
| Kcnc2 | −1.35 | −1.86 | −2.15 | 0.07 | 0.06 | 2.06 | −1.98 | −0.18 | −1.74 | −1.15 | −1.35 | −1.00 | −1.28 | 1.42 | 1.69 |
| Kcnj10 | −1.50 | −1.40 | −1.68 | −2.65 | −2.62 | −2.48 | −2.37 | −2.45 | −2.56 | 3.16 | 3.07 | 2.71 | 2.71 | 1.64 | 1.49 |
| Kif19a | −0.62 | −1.02 | −0.41 | −1.78 | −2.25 | −2.86 | −2.45 | −2.28 | −1.84 | 1.47 | 1.08 | −1.65 | −1.56 | 1.03 | 1.35 |
| Kit | −1.48 | −1.68 | −1.79 | −1.60 | −1.36 | −1.34 | 3.58 | 3.44 | 3.47 | −1.57 | 0.31 | 0.34 | 0.90 | 1.09 |
| Kitl | −1.67 | −1.31 | −1.46 | 5.60 | 5.71 | 4.10 | −1.13 | −1.08 | −1.07 | 3.16 | 3.49 | −1.39 | −1.12 | −1.55 | −1.62 |
| Klk6 | −1.56 | −2.51 | −1.69 | −0.60 | −0.01 | −1.40 | −1.91 | −0.77 | −1.32 | −2.43 | −1.19 | 2.55 | 3.05 | −1.13 | −1.00 |
| Leng9 | 1.57 | 1.44 | 0.05 | 2.70 | 2.84 | 1.33 | 0.67 | 1.40 | 1.37 | 0.85 | 1.47 | 2.10 | 2.19 | 1.47 | 1.61 |
| Lfng | −1.35 | −2.59 | −1.58 | −1.43 | −1.41 | −1.54 | −2.69 | −1.97 | −2.02 | 4.64 | 4.59 | −0.35 | −0.60 | −0.90 | −1.03 |
| Lgi4 | −0.73 | −1.20 | −1.45 | −2.43 | −2.22 | −1.88 | −2.20 | −2.06 | −3.08 | 4.55 | 4.50 | −0.50 | −0.79 | −1.98 | −2.42 |
| Lims2 | −1.66 | −1.56 | −1.72 | −0.79 | −0.59 | −1.58 | −1.03 | −1.38 | −1.24 | −1.26 | −2.01 | 1.95 | 2.17 | 3.71 | 3.55 |
| Mag | −0.60 | −3.06 | −2.49 | −2.37 | −1.90 | −1.99 | −2.36 | −2.84 | −2.50 | −1.50 | −2.57 | 4.87 | 5.13 | 2.78 | 2.76 |
| Mak | −1.30 | −2.28 | −2.06 | −1.45 | −1.07 | −2.13 | −1.33 | −0.81 | −1.31 | 0.06 | 0.56 | −0.86 | −0.63 | −0.49 | −0.74 |
| Mal | −1.41 | −2.34 | −2.30 | −2.74 | −1.52 | −1.41 | −2.14 | −2.43 | −2.33 | −2.42 | −2.53 | 4.25 | 4.31 | 2.53 | 2.81 |
| March11 | −0.38 | −0.93 | −0.66 | 0.85 | 0.86 | 1.40 | 4.33 | 4.00 | 4.21 | −1.98 | −1.84 | −1.33 | −1.61 | −1.02 | −1.77 |
| Marcksl1 | −0.52 | −0.44 | −2.00 | −1.53 | −1.25 | −1.81 | −1.66 | −1.83 | −0.93 | 1.91 | −0.41 | −0.44 | 1.03 | 0.23 | 0.75 |
| Mcam | 0.78 | 0.89 | 0.16 | 0.58 | 1.71 | −0.91 | −2.50 | −2.34 | −2.09 | −2.27 | −2.96 | 3.89 | 4.44 | 3.12 | 3.36 |
| Mff | 1.58 | 1.68 | 1.22 | 1.91 | 1.47 | 1.51 | 1.85 | 1.92 | 2.01 | 0.78 | 0.78 | 2.17 | 2.20 | 1.55 | 1.23 |
| Mfge8 | −1.37 | −1.31 | −1.43 | −1.33 | −1.50 | −1.88 | −2.63 | −2.08 | −2.62 | 3.48 | 3.41 | −0.88 | −0.47 | 0.43 | 0.66 |
| Mlc1 | −0.06 | 0.56 | −0.43 | −1.60 | −1.13 | −1.23 | −1.83 | −1.53 | −1.32 | 5.14 | 4.42 | 0.42 | −0.16 | −2.62 | −1.54 |
| Mog | −2.20 | −1.55 | −1.84 | −2.18 | −0.87 | −1.92 | −1.27 | −1.21 | −1.55 | −2.23 | −2.75 | 5.21 | 5.25 | 3.42 | 2.78 |
| mt-Co1 | −0.81 | −1.91 | −1.66 | −2.41 | −2.45 | −2.37 | −2.59 | −2.02 | −1.76 | −2.54 | −2.26 | −0.79 | −0.92 | −1.48 | −1.28 |
| mt-Nd4 | −0.86 | −1.43 | −1.56 | −1.74 | −1.75 | −2.20 | −2.31 | −1.95 | −1.41 | −2.18 | −1.54 | −0.42 | −0.05 | −0.87 | −0.89 |
| Mybpc1 | 1.07 | −0.34 | 1.30 | −0.41 | −0.11 | −0.74 | −0.39 | −1.08 | −1.25 | 5.64 | 8.71 | 0.30 | 0.21 | 1.28 | 1.65 |
| Myot | −0.80 | −0.88 | −1.82 | 0.33 | 0.26 | −1.16 | −1.45 | −0.62 | −0.69 | −1.11 | −0.77 | −1.11 | −1.17 | −0.67 | −0.61 |
| Myrf | −2.72 | −2.31 | −2.00 | −1.05 | −1.16 | −1.15 | −2.33 | −1.22 | −2.18 | −1.55 | −2.78 | 3.14 | 3.23 | 1.61 | 1.48 |
| Ndrg1 | −1.96 | −2.34 | −1.80 | −1.81 | −2.56 | −2.04 | −2.56 | −1.92 | −1.39 | −2.06 | −2.67 | 3.79 | 3.75 | 1.27 | 1.47 |
| Nell1 | −1.38 | −1.44 | −2.04 | 5.37 | 5.43 | 4.59 | −1.37 | −0.98 | −1.33 | −1.52 | −1.03 | −1.15 | −1.02 | −0.99 | −0.99 |
| Neto1 | −2.23 | −1.55 | −2.32 | −0.77 | −0.72 | 1.69 | −0.09 | −0.39 | −0.02 | −0.12 | −1.66 | 0.79 | 0.25 | 4.78 | 4.81 |
| Neu4 | −0.98 | −0.91 | −2.10 | −0.99 | −1.80 | −2.20 | 1.83 | 1.12 | 0.67 | −1.44 | −1.49 | 3.23 | 3.66 | 6.68 | 7.15 |
| Ninj2 | −1.54 | −1.64 | −2.03 | −1.05 | −1.16 | −2.04 | −1.73 | −1.67 | −1.64 | −1.95 | −1.81 | 3.91 | 4.15 | 3.06 | 2.93 |
| Nkx2-2 | −2.17 | −2.00 | −2.07 | −0.56 | −0.82 | −2.46 | −2.39 | −1.03 | −1.42 | 3.53 | 4.19 | 2.48 | 2.82 | 3.14 | 3.49 |
| Notch1 | −1.69 | −1.69 | −1.32 | −1.40 | −1.41 | −1.51 | −1.42 | −1.44 | −1.55 | 3.42 | 2.85 | −1.28 | −0.90 | 1.58 | 1.47 |
| Nrk | −1.10 | −0.92 | −1.03 | 6.91 | 6.30 | 5.61 | −1.14 | −0.83 | −0.82 | −0.09 | 0.07 | −0.68 | −0.33 | −0.67 | −0.50 |
| Olig1 | −1.51 | −1.44 | −2.25 | −1.39 | −1.90 | −1.55 | −0.88 | −1.03 | −0.43 | −2.60 | −1.92 | 3.38 | 3.45 | 3.28 | 3.43 |

TABLE 28-continued

Log2 fold change in expression for nuclei from mouse samples

| | Cell type | | | | | | | | | | | | | | |
| | Granule | | | Purkinje | | | Basket | | | Astrocytes | | Oligo | | OPCs | |
| Replicate | 861 | 862 | 996 | 327 | 329 | 639 | 640 | 859 | 860 | 993 | 994 | 855 | 856 | 857 | 858 |
|---|---|---|---|---|---|---|---|---|---|---|---|---|---|---|---|
| Olig2 | −2.33 | −2.13 | −2.94 | −1.39 | −1.17 | −1.88 | −2.43 | −1.58 | −1.79 | −2.36 | −2.21 | 2.80 | 2.16 | 3.64 | 3.32 |
| Opalin | −1.05 | −2.20 | −2.27 | −2.26 | −1.61 | −1.96 | −2.36 | −2.66 | −2.27 | −3.13 | −2.88 | 5.76 | 5.77 | 3.97 | 3.49 |
| Pax3 | −1.15 | −1.97 | −1.17 | −1.86 | −1.73 | −2.29 | −0.35 | −0.49 | −0.32 | 3.87 | 3.97 | −0.81 | −1.06 | 1.59 | 1.57 |
| Pcp2 | −0.25 | −0.76 | −0.10 | 5.21 | 4.67 | 6.46 | 0.25 | −1.10 | −0.21 | 0.51 | 0.23 | 0.49 | 0.14 | −1.15 | −1.67 |
| Pdc | −1.23 | −1.82 | −2.87 | −1.26 | −1.67 | −2.21 | −2.46 | −2.64 | −1.67 | −0.21 | −2.25 | −1.67 | −2.85 | −1.63 | −2.34 |
| Pdgfra | −2.50 | −2.23 | −2.57 | −2.33 | −2.01 | −2.87 | −0.51 | −0.93 | −1.01 | −2.63 | −2.42 | 0.63 | −0.48 | 4.48 | 4.76 |
| Pdzd3 | −1.99 | −1.33 | −0.88 | −1.15 | −1.63 | −2.02 | −1.12 | −1.44 | −2.07 | −1.20 | −1.89 | −1.20 | −1.89 | −1.02 | −1.96 |
| Penk | −1.69 | −0.89 | −0.19 | −1.68 | −2.30 | 1.99 | 4.23 | 4.99 | 4.95 | −0.27 | −2.09 | 0.06 | −0.27 | 0.20 | −0.28 |
| Pex5l | −1.76 | −1.88 | −1.73 | −2.13 | −2.11 | −0.22 | −0.94 | −1.06 | −0.97 | −1.50 | −1.32 | 4.71 | 4.50 | 2.00 | 1.80 |
| Pgghg | −0.53 | −1.81 | −1.44 | −1.65 | −1.98 | −1.58 | −1.94 | −1.16 | −1.22 | 3.25 | 3.19 | −1.35 | 0.03 | 1.26 | 1.91 |
| Phyhip | 2.41 | 1.76 | 2.88 | −1.27 | −1.94 | 0.36 | 2.80 | 2.52 | 2.33 | −0.18 | −0.27 | −1.65 | −0.77 | −1.37 | −1.46 |
| Pkp3 | 0.22 | −0.23 | −0.75 | 5.60 | 5.12 | 5.70 | −0.99 | −0.62 | −0.45 | −1.80 | −0.38 | −0.31 | 0.55 | 0.59 | 0.12 |
| Pla2g16 | −2.37 | −2.18 | −1.88 | −1.96 | −1.67 | −2.27 | −2.37 | −2.32 | −2.28 | 1.57 | 1.51 | 3.86 | 3.95 | 1.33 | 1.10 |
| Plch1 | −1.68 | −2.04 | −2.10 | −0.22 | −0.14 | 0.42 | 3.87 | 3.67 | 3.72 | −1.63 | −1.05 | −1.21 | −1.59 | −2.20 | −2.02 |
| Plekhd1 | −2.32 | −2.41 | −2.71 | 4.87 | 4.87 | 4.18 | 1.26 | 1.24 | 1.05 | −2.44 | −2.25 | −1.09 | −1.73 | −1.09 | −1.76 |
| Plekhg3 | 0.08 | 0.39 | 0.40 | −1.70 | −1.28 | −1.89 | −2.25 | −2.09 | −2.35 | −2.33 | −2.37 | 3.56 | 3.67 | 1.76 | 1.99 |
| Pllp | −1.38 | −1.69 | −1.63 | −1.72 | −1.65 | −1.68 | −1.53 | −1.36 | −1.45 | −1.18 | −1.30 | 2.83 | 2.89 | 2.45 | 2.53 |
| Plp1 | −1.92 | −1.95 | −1.53 | −1.88 | −1.63 | −1.73 | −1.82 | −1.97 | −1.95 | −1.17 | −1.01 | 4.80 | 4.84 | 3.25 | 3.07 |
| Plpp3 | −1.12 | −2.03 | −1.17 | −2.02 | −1.79 | −2.02 | −1.98 | −1.97 | −1.95 | 4.14 | 4.08 | 0.41 | 0.54 | 1.45 | 1.68 |
| Plpp4 | −2.56 | −2.22 | −2.39 | −1.61 | −1.47 | −0.83 | 3.10 | 2.94 | 2.90 | −0.25 | −0.51 | −0.29 | −0.98 | 3.24 | 3.41 |
| Plscr1 | −0.10 | −0.68 | −0.71 | −1.73 | −0.97 | −1.78 | −1.52 | −1.61 | −2.34 | 4.30 | 4.29 | −1.78 | −1.59 | 1.27 | −0.48 |
| Plxnb3 | −2.65 | −2.75 | −1.97 | −2.81 | −2.41 | −2.31 | −2.19 | −2.46 | −2.29 | 2.27 | 1.98 | 3.98 | 3.78 | 3.07 | 2.69 |
| Pmp2 | −1.13 | −1.81 | −1.77 | −1.66 | −0.58 | −1.88 | −1.94 | −1.89 | −1.94 | −1.71 | −1.74 | −0.43 | −1.74 | −1.56 | −1.09 |
| Pmp22 | −1.14 | −0.91 | −1.54 | −1.90 | −1.68 | −2.28 | −1.97 | −1.78 | −2.08 | 2.92 | 3.09 | 2.50 | 2.33 | 0.95 | 0.63 |
| Ppfibp1 | −2.49 | −2.08 | −2.66 | −2.20 | −2.01 | −2.12 | −0.64 | −1.33 | −1.11 | −0.88 | −0.75 | 0.63 | 0.27 | 4.72 | 4.78 |
| Ppp1r14a | −2.81 | −1.94 | −1.31 | −1.56 | −2.04 | −1.86 | −2.10 | −1.61 | −2.54 | −2.31 | −2.35 | 2.84 | 2.44 | −0.17 | 0.05 |
| Ppp1r17 | −1.43 | −1.17 | −2.34 | 4.86 | 4.47 | 4.45 | −1.97 | −0.74 | −1.26 | −1.07 | −1.71 | −0.56 | −0.76 | −1.46 | −1.32 |
| Prex1 | −1.53 | −2.02 | −2.07 | −2.06 | −1.91 | −1.69 | −1.82 | −2.16 | −2.17 | 3.14 | 2.73 | 0.86 | 0.80 | 1.35 | 1.20 |
| Prex2 | −0.86 | −1.70 | −1.22 | −1.99 | −2.17 | −1.59 | −1.99 | −2.39 | −2.32 | 3.72 | 3.88 | −1.73 | −1.61 | −0.28 | −0.41 |
| Prima1 | −1.61 | −2.49 | −2.05 | −1.87 | −1.54 | −2.03 | −2.91 | −2.24 | −2.23 | −1.68 | −2.26 | 3.14 | 3.13 | 1.73 | 1.62 |
| Prkcg | −2.29 | −1.47 | −1.95 | 3.69 | 3.63 | 3.45 | 1.97 | 1.98 | 1.98 | −1.21 | −1.32 | −2.30 | −2.05 | −1.06 | −1.26 |
| Prr5 | −1.57 | −1.66 | −1.40 | −0.82 | −1.13 | −0.55 | −0.93 | −0.90 | −1.02 | 4.39 | 4.48 | −1.03 | −1.26 | −1.50 | 0.70 |
| Prrg3 | 1.20 | 1.20 | 1.11 | −1.24 | −1.33 | 0.91 | 2.48 | 2.19 | 2.28 | −1.39 | −1.63 | −1.15 | −1.16 | 1.32 | 1.88 |
| Prrx1 | −1.48 | −2.08 | −1.36 | −1.29 | −1.13 | −1.69 | −1.70 | −2.07 | −1.78 | 3.10 | 2.97 | −0.46 | −0.81 | 1.82 | 1.93 |
| Ptchd4 | 1.66 | 1.58 | 1.41 | 4.16 | 3.75 | 3.73 | 1.55 | 1.33 | 1.50 | 0.24 | 0.47 | −1.96 | −1.87 | −1.37 | −1.10 |
| Ptprk | −2.34 | −2.55 | −2.42 | −1.92 | −1.88 | −1.45 | 2.58 | 2.40 | 2.52 | −2.05 | −1.90 | 2.68 | 2.43 | 1.67 | 1.71 |
| Ptprz1 | −1.60 | −1.99 | −1.77 | −2.94 | −2.96 | −2.27 | 1.88 | 1.66 | 1.77 | 2.67 | 2.83 | −1.00 | −1.49 | 2.04 | 2.06 |
| Pttg1 | 2.97 | 0.89 | 0.10 | 2.50 | 2.55 | 2.93 | 2.42 | 3.34 | 3.49 | 2.04 | 2.04 | 4.21 | 4.17 | 2.17 | 2.47 |
| Pvalb | −2.10 | −2.19 | −2.71 | 2.82 | 2.66 | 2.53 | 2.39 | 2.52 | 2.26 | −1.21 | −1.78 | −2.30 | −1.27 | −1.87 | −2.26 |
| Pxdc1 | −1.28 | −1.86 | −2.31 | −1.66 | −2.65 | −1.26 | −1.29 | −0.74 | −1.63 | −2.49 | −2.53 | −0.15 | −1.11 | 3.90 | 3.56 |
| Qk | −0.36 | −0.29 | −0.43 | −1.11 | −1.21 | −1.06 | −0.09 | −0.26 | −0.16 | 2.29 | 2.65 | 3.43 | 3.43 | 2.91 | 2.77 |
| Rapgef3 | −2.41 | −2.59 | −2.66 | −2.27 | −1.78 | −1.27 | −2.14 | −2.22 | −2.22 | 0.15 | −0.72 | 2.04 | 2.15 | 2.26 | 2.71 |
| Rassf2 | −1.72 | −2.31 | −1.93 | −0.18 | −0.28 | −1.70 | −2.32 | −2.33 | −2.15 | 2.66 | 2.86 | 3.46 | 3.48 | 1.74 | 2.03 |
| Rbp2 | −1.12 | −1.58 | −1.53 | −0.93 | −0.36 | −1.39 | −1.94 | −2.09 | −1.25 | −1.86 | −1.91 | −1.86 | −1.49 | −0.90 | −1.60 |
| Rbpjl | −0.86 | −0.78 | −1.95 | −1.83 | −0.69 | −1.77 | −1.12 | −0.30 | −0.52 | −1.88 | −1.92 | 0.11 | −0.19 | 2.05 | 2.82 |
| Rgcc | −1.26 | −0.42 | 0.35 | −1.28 | −0.55 | −1.52 | −1.31 | −2.03 | −1.73 | −1.95 | −2.28 | −0.43 | −0.71 | 3.39 | 3.34 |
| Rgma | −0.60 | −0.54 | 0.11 | −1.48 | −1.41 | −1.16 | −1.96 | −1.66 | −1.47 | 4.14 | 3.88 | 1.62 | 1.46 | 0.99 | 1.16 |
| Ryr1 | −2.32 | −2.18 | −2.79 | 4.50 | 4.53 | 4.51 | −1.14 | −1.11 | −1.21 | −2.27 | −2.24 | −1.68 | −1.76 | −1.72 | −1.87 |
| S100b | −1.55 | −0.99 | −1.86 | −1.33 | −1.07 | −0.69 | −1.59 | −2.10 | −2.32 | 1.91 | 1.81 | 0.03 | 0.50 | 1.01 | 1.17 |
| S1pr1 | −0.38 | 1.20 | 0.35 | −2.05 | −2.59 | −0.74 | −1.28 | −1.28 | −2.01 | 5.26 | 5.73 | −0.10 | −0.26 | −1.93 | 0.55 |
| Sall1 | −1.46 | −1.19 | −2.13 | −1.29 | −0.97 | −1.50 | −1.59 | −1.24 | −1.23 | −2.72 | −1.88 | 3.59 | 3.22 | 0.75 | 0.81 |
| Sec14l5 | −1.69 | −1.71 | −1.81 | −1.14 | −0.87 | −1.73 | −1.30 | −1.61 | −1.51 | −1.75 | −1.70 | 4.53 | 4.37 | 1.83 | 1.63 |
| Serpine2 | −2.21 | −2.14 | −2.33 | −2.02 | −1.37 | −1.63 | −1.05 | −1.80 | −1.29 | 1.92 | 2.05 | 0.63 | −0.02 | 3.76 | 3.90 |
| Shisa6 | −2.95 | −3.04 | −3.02 | 3.83 | 3.53 | 3.12 | 2.46 | 2.13 | 2.23 | −1.87 | −1.74 | −2.05 | −2.31 | −0.65 | −0.95 |
| Skor2 | −0.04 | 0.02 | −1.04 | 6.47 | 7.18 | 5.92 | −0.90 | 0.30 | −0.08 | −1.85 | −1.29 | −0.12 | −0.04 | −0.88 | −0.58 |
| Slc1a3 | −0.20 | −1.10 | −0.57 | −1.87 | −1.98 | −2.07 | −1.72 | −2.28 | −1.87 | 4.59 | 5.19 | 0.73 | 0.57 | −0.12 | 0.09 |
| Slc1a6 | 0.45 | 0.69 | 0.35 | 5.78 | 5.57 | 4.60 | 1.26 | 1.19 | 1.53 | −0.34 | −1.04 | −0.34 | −0.52 | 0.86 | 0.28 |
| Slc26a3 | −2.11 | −2.15 | −2.59 | −1.21 | −1.20 | −2.47 | −2.36 | −1.67 | −1.65 | −2.44 | −1.92 | −1.77 | −1.54 | −1.96 | −1.90 |
| Slc32a1 | −0.54 | −1.77 | −1.52 | 2.08 | 2.50 | 1.59 | 3.01 | 3.52 | 3.63 | −2.06 | −2.54 | −0.78 | −0.85 | −1.88 | −0.75 |
| Slc4a4 | 2.49 | 2.42 | 2.43 | −1.94 | −1.86 | −1.08 | −1.19 | −2.32 | −2.18 | 4.19 | 4.36 | −0.03 | −0.32 | −1.04 | −1.10 |
| Slc5a11 | −1.43 | −1.66 | −2.18 | −1.17 | −1.02 | −1.94 | −1.00 | −0.94 | −0.97 | −1.04 | −1.36 | 1.72 | 1.65 | −0.70 | −0.45 |
| Slc9a3 | −0.76 | −0.76 | −1.62 | 6.99 | 6.23 | 6.06 | −0.69 | −0.69 | −1.02 | −0.99 | −0.41 | 0.34 | 0.39 | −0.54 | −0.85 |
| Slitrk6 | −1.42 | −1.96 | −1.32 | −1.83 | −0.45 | −0.78 | −0.65 | −0.38 | −2.08 | −1.87 | −1.90 | −1.23 | −1.91 | 3.21 | 3.39 |
| Socs2 | −1.47 | −1.10 | −1.55 | 0.45 | 0.20 | 0.59 | 4.10 | 4.04 | 4.18 | −2.48 | −2.06 | −0.48 | −0.65 | −1.04 | −1.26 |
| Sorcs3 | −2.81 | −2.82 | −2.96 | −1.94 | −2.03 | −1.55 | 3.81 | 3.70 | 3.76 | −2.36 | −2.02 | 0.99 | 0.98 | 1.68 | 1.64 |
| Sox10 | −2.72 | −1.86 | −2.64 | −2.18 | −2.50 | −3.21 | −2.04 | −1.83 | −2.41 | −2.73 | −3.15 | 3.04 | 3.07 | 3.05 | 3.00 |
| Sox2 | −2.42 | −2.75 | −2.73 | −1.51 | −2.00 | −2.45 | −2.57 | −2.21 | −2.05 | 0.09 | 1.26 | 1.77 | 2.68 | 2.41 | 1.63 |
| Sox6 | −1.56 | −2.08 | −1.76 | −1.27 | −0.99 | −1.89 | −0.97 | −1.35 | −1.32 | 2.64 | 3.07 | 0.59 | 0.12 | 3.99 | 4.08 |
| Sox8 | −2.11 | −2.40 | −2.02 | −1.60 | −0.98 | −2.69 | −1.49 | −1.92 | −2.73 | 2.14 | 2.13 | 2.09 | 2.42 | 2.94 | 2.43 |
| Stag3 | −2.03 | −1.90 | −2.35 | −1.26 | −0.88 | −0.69 | 1.12 | 0.71 | 1.01 | −0.24 | −0.22 | −0.48 | −0.83 | 0.81 | −1.28 |
| Stk32a | −1.32 | −1.98 | −1.20 | −1.64 | −1.55 | −1.66 | −1.46 | −1.72 | −2.06 | 3.50 | 3.90 | −0.28 | −0.42 | 2.23 | 2.27 |
| Sulf2 | −1.27 | −1.67 | −2.27 | −1.39 | −1.20 | −0.10 | −1.02 | −0.81 | −1.11 | −1.52 | −1.44 | 2.05 | 1.84 | 2.52 | 2.42 |

TABLE 28-continued

Log2 fold change in expression for nuclei from mouse samples

| | Cell type | | | | | | | | | | | | | | |
| | Granule | | | Purkinje | | | Basket | | | Astrocytes | | Oligo | | OPCs | |
| Replicate | 861 | 862 | 996 | 327 | 329 | 639 | 640 | 859 | 860 | 993 | 994 | 855 | 856 | 857 | 858 |
|---|---|---|---|---|---|---|---|---|---|---|---|---|---|---|---|
| Susd5 | −1.42 | −1.58 | −2.76 | −1.01 | −1.31 | −2.32 | −0.72 | −1.14 | −0.95 | −2.55 | −1.85 | −0.15 | −0.40 | 4.07 | 4.19 |
| Tceal7 | −1.85 | −0.43 | −1.77 | −1.67 | −0.21 | −1.25 | −1.93 | −1.27 | −1.32 | −1.71 | −1.75 | −0.26 | −0.64 | −0.84 | −0.75 |
| Tfap2b | −1.70 | −1.47 | −2.36 | −1.56 | −1.54 | 0.01 | 2.95 | 2.99 | 3.17 | −2.77 | −2.28 | −1.74 | −1.70 | −1.38 | −1.22 |
| Thbs2 | −0.93 | −1.87 | −2.46 | −2.35 | −1.22 | −2.89 | −2.20 | −1.51 | −1.13 | −0.32 | 0.67 | 1.16 | 2.04 | −1.95 | −0.94 |
| Tmem | −2.29 | −2.36 | −2.80 | 2.07 | 2.06 | 1.14 | −1.55 | −1.75 | −1.88 | −2.49 | −1.98 | 2.68 | 2.62 | 2.95 | 3.00 |
| Tmem | −1.92 | −1.73 | −1.66 | −1.33 | −0.96 | −1.39 | −2.06 | −2.05 | −1.69 | −0.59 | −0.50 | 4.37 | 4.47 | 1.64 | 2.20 |
| Tmem125 | −1.40 | −1.34 | −0.87 | −1.15 | −0.87 | −2.05 | −2.10 | −1.05 | −2.10 | −1.20 | −1.92 | 4.30 | 4.28 | 2.68 | 1.95 |
| Tmem98 | −1.89 | −2.45 | −2.42 | −1.80 | −1.02 | −2.53 | −1.69 | −1.34 | −1.07 | −2.20 | −1.82 | 3.23 | 3.19 | 1.16 | 1.06 |
| Tnc | 0.24 | −1.35 | −0.18 | −0.87 | −0.66 | −1.73 | −1.47 | −1.78 | −2.01 | 6.16 | 5.00 | −1.69 | −1.70 | −0.75 | −0.04 |
| Tnfrsf13c | −0.78 | −0.09 | −0.65 | −2.02 | −0.71 | −1.69 | −1.40 | −1.34 | −1.40 | −2.06 | −1.51 | −1.07 | 0.73 | 0.77 | 0.81 |
| Tns3 | −2.19 | −2.18 | −2.11 | −2.54 | −2.28 | −1.81 | −2.42 | −2.50 | −2.54 | 1.57 | 1.80 | 1.37 | 1.20 | 2.84 | 2.65 |
| Trabd2b | −2.09 | −1.93 | −2.70 | 6.27 | 5.47 | 5.86 | −1.51 | −2.14 | −1.69 | 0.98 | 0.72 | −1.32 | −1.48 | −1.90 | −0.20 |
| Tril | −0.28 | −0.67 | −1.38 | −2.59 | −2.77 | −1.04 | −1.84 | −2.28 | −1.91 | 4.10 | 3.69 | −0.66 | 0.02 | 2.94 | 1.41 |
| Trpc3 | −2.04 | −2.32 | −2.29 | 6.07 | 5.61 | 5.07 | 0.89 | 0.77 | 0.95 | −1.74 | −1.91 | −1.62 | −1.88 | −0.27 | −0.84 |
| Trpc7 | −1.92 | −1.96 | −2.21 | 0.40 | 0.76 | 1.35 | 3.71 | 3.62 | 3.70 | −2.06 | −2.04 | −0.82 | −1.18 | −1.90 | −2.03 |
| Tshb | 0.91 | 0.82 | −0.22 | 3.91 | 3.49 | 3.63 | −1.01 | 0.12 | 0.41 | −1.68 | −0.28 | 3.42 | 3.75 | 2.99 | 1.90 |
| Tspan11 | −2.50 | −2.65 | −2.53 | 4.06 | 4.14 | 2.78 | −2.04 | −1.54 | −1.75 | −2.30 | −1.67 | −1.68 | −1.67 | −0.68 | −0.59 |
| Tspan2 | −0.95 | −1.04 | −1.06 | 2.65 | 2.39 | 2.26 | −1.95 | −1.81 | −1.53 | −2.44 | −1.00 | 4.18 | 4.15 | 2.91 | 2.89 |
| Tuba8 | −2.05 | −2.74 | −3.23 | 2.29 | 2.32 | 1.93 | 0.52 | 0.41 | 0.34 | −2.77 | −2.94 | −2.76 | −2.62 | −2.64 | −2.75 |
| Tubb2b | −2.35 | −2.69 | −2.66 | −1.11 | −1.12 | −2.11 | −2.43 | −1.24 | −1.13 | 2.12 | 2.19 | −1.31 | −0.91 | 1.33 | 1.70 |
| Txnip | −0.72 | −2.92 | −2.61 | −2.51 | −2.31 | −2.49 | −2.74 | −2.50 | −2.23 | 0.98 | 0.21 | 0.25 | 0.51 | 0.25 | −0.54 |
| Ube2b | 1.88 | 1.78 | 1.32 | 2.05 | 2.26 | 2.29 | 2.06 | 1.95 | 2.06 | 1.18 | 1.10 | 2.10 | 2.23 | 1.39 | 1.44 |
| Ugt8a | −2.28 | −2.57 | −2.24 | 0.49 | 0.55 | 0.47 | −1.55 | −1.81 | −1.66 | −2.40 | −2.60 | 4.14 | 4.12 | 2.86 | 2.80 |
| Upp1 | −1.53 | −2.32 | −2.29 | −0.98 | −1.38 | −0.92 | −2.44 | −1.58 | −1.64 | −1.33 | −1.74 | −0.82 | −1.38 | −1.12 | −1.22 |
| Vstm2b | −2.48 | −2.28 | −2.97 | −2.74 | −2.77 | −0.65 | 0.33 | 0.48 | 0.37 | −2.53 | −2.81 | −1.10 | −0.54 | 2.17 | 1.99 |
| Wfdc1 | −2.82 | −2.79 | −2.55 | −1.21 | −0.42 | −1.55 | −1.63 | −1.32 | −2.20 | 0.70 | 1.51 | −2.48 | −1.40 | −1.71 | −1.72 |
| Xrra1 | −1.41 | −0.94 | −1.06 | −0.92 | −1.56 | −1.10 | −1.54 | −1.16 | −1.04 | −0.53 | 0.48 | −1.25 | −1.91 | −1.92 | −1.70 |
| Zcchc24 | −2.41 | −2.29 | −2.05 | −2.88 | −2.90 | −2.38 | −2.11 | −2.56 | −2.43 | 2.57 | 2.70 | 1.24 | 0.82 | 1.76 | 1.82 |
| Zeb2 | −1.99 | −2.01 | −1.89 | −1.54 | −1.67 | −2.13 | −2.13 | −2.33 | −2.43 | 2.77 | 2.97 | 3.13 | 3.10 | 2.72 | 2.55 |
| Zfp36l1 | −2.01 | −2.24 | −1.49 | −1.16 | −1.33 | −2.49 | −2.00 | −1.67 | −0.93 | 2.09 | 1.80 | −1.15 | −1.36 | 2.35 | 1.82 |

Examination of the first eight principle components, Pro-protein Convertase Subtilisin/Kexin Type 1 (PCSK1, also known as PC1) through Proprotein Convertase Subtilisin/Kexin Type 8 (PCSK8, also known as (Pc1 through Pc8), which collectively account for 90.5% of the variability across all samples, revealed that expression of Pc1 and Proprotein Convertase Subtilisin/Kexin Type 3 (PCSK3, also known as PC3) categorize samples by cell type, while Pc2, Proprotein Convertase Subtilisin/Kexin Type 6 (PCSK6, also known as PC6), and PC8 split samples by species. The other principle components organize samples by both cell type and species. Because Pc1 and Pc3 account for 47% of the variability across samples, while Pc2, PCc6, and Pc8 account for only 22% of variability, the most important differences between the profiles were determined to result from cell-type specific expressed genes that are shared among species. However, it is apparent that genome-wide quantitative differences in expression profiles between species should also be considered when assessing the functional properties of a given cell type in different species.

Hierarchical clustering was used to explore the similarities and differences across species of mouse, rat, and human cell-type specific datasets based on expression in all genes outside of the 250 most variable genes revealed clustering primarily by species. However, when clustering was performed using only the 250 most variable genes across species, clustering was observed to occur primarily by cell type.

Example 13

Profiling Three Cell Types From Sixteen Post-Mortem Human Brains

Given the genetic heterogeneity of human populations, the variations in human tissue processing times, and the difficulties cited in previous studies of total RNAs isolated from human tissue (McCall, et al. (2016) Am. J. Hum. Genet. 99, 624-635.; Webster, M. J. (2006). Functional Genomics and Proteomics in the Clinical Neurosciences, (Elsevier), pp. 3-14, each of which is hereby incorporated by reference herein in its entirety), sources of variability across samples from different individuals were also of interest to assess whether the changes that are observed in a disease are caused by the disease itself or are a result of variability across individuals. To better understand the source of this variability, the cellular profiling technique described herein was used to analyze cell-type specific gene expression in an additional 14 human brain samples. In total, samples were obtained from 16 control donors, roughly equally split between genders (7 males and 9 females), and across ages (4 individuals each in the following age groups: 20-30, 40-50, 60-70, 80-90 years). All samples were obtained from unaffected subjects that received a neuropathological diagnosis of "normal adult brain". Table 29 provides additional details regarding each donor.

TABLE 29

| | | | Age | | Autolysis | Neuropathy | |
|---|---|---|---|---|---|---|---|
| ID | Tissue | Gender | (years) | Race/Ethnicity | (hours) | Diagnosis | Cause of Death |
| XK | frozen | male | 23 | Caucasian/White | 19.5 | Normal brain | Gunshot wounds |
| TM | frozen | female | 23 | Black/African American | 10.5 | Normal brain | Pulmonary thromboembolus |
| WO | frozen | female | 25 | Black/African American | 10 | Normal brain | Gunshot wounds |
| WC | frozen | male | 27 | Caucasian/White | 19.1 | Normal brain | Multiple blunt trauma injuries - motor vehicle accident |
| WI | frozen | female | 42 | Hispanic/Latino and Caucasian/White | 16.5 | Normal brain | Complications of Myxoid heart disease |
| PK | frozen | female | 44 | Hispanic/Latino and Caucasian/White | 14.8 | Normal brain | Cardiac problems |
| VM | frozen | male | 45 | Hispanic/Latino and Caucasian/White | 15.5 | Normal brain | Cardiomegaly, hypertensive type |
| WL | frozen | male | 46 | Hispanic/Latino and Caucasian/White | 13.5 | Normal brain | Coronary artery thrombosis |
| SG | frozen | male | 63 | Caucasian/White | 12 | Normal brain | Atherosclerotic and hypertensive heart disease |
| OR | frozen | female | 64 | Caucasian/White | 8 | Normal brain | Ruptured atherosclerotic abdominal aortic aneurysm |
| LT | frozen | male | 65 | Caucasian/White | 10.5 | Normal brain | Myocardial infarction |
| ZH | frozen | female | 65 | Caucasian/White | 19.4 | Normal brain | Hypertensive and arteriosclerotic cardiovascular disease |
| KO | frozen | female | 82 | Caucasian/White | 5.5 | Normal brain | Congestive heart failure, emphysema |
| KQ | frozen | female | 83 | Caucasian/White | 13 | Normal brain | Renal failure |
| KE | frozen | male | 84 | Caucasian/White | 24 | Normal brain | Dissecting abdominal aortic aneurysm |
| AI | frozen | female | 89 | Caucasian/White | 5.13 | Normal brain | Lung cancer |
| AW | fixed | male | 25 | Black/African American | 22.5 | Normal brain | Satus asthmaticus; asthma |
| AI | fixed | female | 89 | Caucasian/White | 5.13 | Normal brain | Lung cancer |

Nuclei were isolated from all 16 samples and stained using antibodies against ITPR1 and NEUN to purify the nuclei from three different cell types in a single sort: granule cells, basket cells, and total glia. Table 30 provides the percentages of each cell type from FACS analysis of the nuclei.

cells, the ITPR1+ NEUN-population containing basket cells, and the ITPR1-NEUN-population containing total glia were easily distinguishable. The only exceptions were the glial populations from individuals WC and WO in which the ITPR1-NEUN-population did not separate well from the ITPR1-NEUN+ population. Gene expression analysis of

TABLE 30

FACS results

| Cell Type | Population | Individual | Percentage | Cell Type | Population | Individual | Percentage |
|---|---|---|---|---|---|---|---|
| Granule | Itpr1– NeuN+ | TM | 87.10% | Basket | Itpr1+ NeuN– | OR | 0.70% |
| Granule | Itpr1– NeuN+ | WC | 77.90% | Basket | Itpr1+ NeuN– | SG | 0.49% |
| Granule | Itpr1– NeuN+ | WO | 89.80% | Basket | Itpr1+ NeuN– | ZH | 0.95% |
| Granule | Itpr1– NeuN+ | VM | 94.20% | Basket | Itpr1+ NeuN– | LT | 0.52% |
| Granule | Itpr1– NeuN+ | WI | 89.50% | Basket | Itpr1+ NeuN– | KO | 1.61% |
| Granule | Itpr1– NeuN+ | WL | 91.00% | Basket | Itpr1+ NeuN– | KE | 0.42% |
| Granule | Itpr1– NeuN+ | OR | 92.10% | Basket | Itpr1+ NeuN– | KQ | 1.04% |
| Granule | Itpr1– NeuN+ | SG | 92.90% | Basket | Itpr1+ NeuN– | AI | 0.83% |
| Granule | Itpr1– NeuN+ | ZH | 93.30% | Glia | Itpr1– NeuN– | TM | 8.24% |
| Granule | Itpr1– NeuN+ | LT | 93.10% | Glia | Itpr1– NeuN– | VM | 3.19% |
| Granule | Itpr1– NeuN+ | KO | 90.80% | Glia | Itpr1– NeuN– | WI | 4.84% |
| Granule | Itpr1– NeuN+ | KE | 91.60% | Glia | Itpr1– NeuN– | WL | 4.49% |
| Granule | Itpr1– NeuN+ | KQ | 92.20% | Glia | Itpr1– NeuN– | OR | 3.44% |
| Granule | Itpr1– NeuN+ | AI | 93.10% | Glia | Itpr1– NeuN– | SG | 2.44% |
| Basket | Itpr1+ NeuN– | TM | 0.78% | Glia | Itpr1– NeuN– | ZH | 3.87% |
| Basket | Itpr1+ NeuN– | WC | 1.21% | Glia | Itpr1– NeuN– | LT | 3.56% |
| Basket | Itpr1+ NeuN– | WO | 0.69% | Glia | Itpr1– NeuN– | KO | 2.43% |
| Basket | Itpr1+ NeuN– | VM | 0.48% | Glia | Itpr1– NeuN– | KE | 2.95% |
| Basket | Itpr1+ NeuN– | WI | 1.15% | Glia | Itpr1– NeuN– | KQ | 2.42% |
| Basket | Itpr1+ NeuN– | WL | 0.48% | Glia | Itpr1– NeuN– | AI | 2.60% |

Although the staining pattern varied slightly between samples, the ITPR1–NEUN+ population containing granule these two samples revealed that the sorts failed to effectively separate granule cells from glia, and the samples were excluded from further analysis. RNAseq was used to analyze the 46 human datasets: 16 from granule cells, 16 from basket cells, and 14 from glia.

The cellular profiling technique described herein was observed to reduce variability caused by differences in cell type composition, which reduced overall variability. Little variability was observed across samples analyzed herein because in a normal analysis of whole tissue, variability is due to both differences in tissue composition and variability in each cell type.

Figure 8:
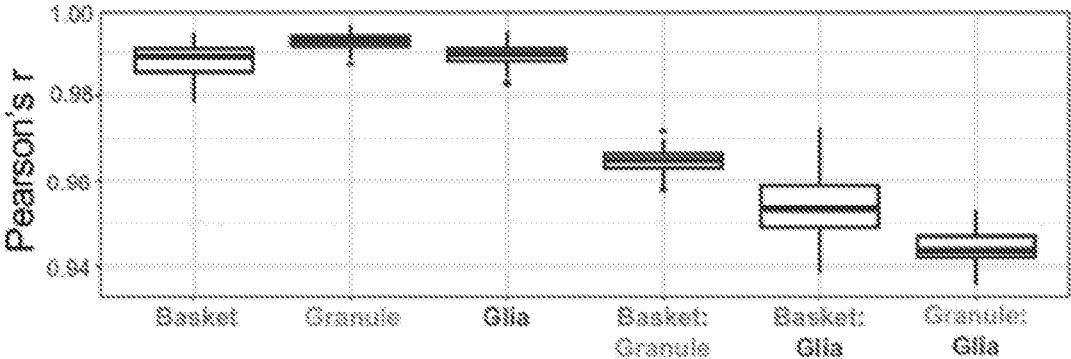
FIG. 8 provides a boxplot showing pairwise Pearson's correlation coefficient within cell types and between cell types for different individuals.

As shown in Examples 8-14, RNAseq analysis of these datasets demonstrated the high purity of each nuclei sample, as each sample was enriched for the appropriate markers for that cell type, and depleted for markers of other cerebellar cell types. For example, only samples from female individuals expressed the X-inactive specific transcript (XIST), while only samples from males expressed Y chromosome genes, such as Lysine Demethylase 5D (KDM5D). Additionally, pairwise Pearson correlation coefficients between biological replicates for each cell type were observed to be between 0.98 and 1 (FIG. 8). These data demonstrated that despite small differences between individuals in the abundance of each cell type, the cell-type specific human expression data obtained by the cellular profiling technique described herein is reproducible.

Example 14

Summarizing Differences in Cell-Type Specific Nuclear RNA Profiles Between Mice and Humans Gene expression profiles were produced for each of the five cerebellar cell types (granule, Purkinje, basket, astrocyte, and oligodendrocyte) in mice and humans by isolating RNA from the sorted nuclei and performing RNAseq.

Tables 31-34 show differences in gene expression between mouse and human. To focus on differentially expressed genes that are most likely to impact cellular function, genes with an adjusted p-value<10E-5 that changed by at least 4-fold between species, and that are expressed at significant levels in each cell type (average number of normalized counts/DEseq2 baseMean>400 and log 2(fpkm)>0). Between 119 and 410 genes that are mouse- or human-enriched were observed. To identify cell-type and species differences rather than general differences between mouse and human, genes that are differentially expressed (adjusted p<10e-5 and fold change>2) between mouse and human in all cell types analyzed were removed from the analysis. Filtering in this way yielded between 67 and 277 cell-type and species specific differentially expressed genes that were approximately equally distributed between those enriched in mouse and those enriched in human.

The log 2 fold change for markers of granule cells in sorted nuclei from human granule cells compared to the normalized RNAseq results from the nuclei of granule cells from mice are shown in Table 31. Negative values indicate reduced expression in the nuclei of the cell type compared to the normalized value for the nuclei of granule cells from mice analyzed, and a positive value indicates increased expression compared to the normalized value for the nuclei of granule cells from mice analyzed.

TABLE 31

| Log2 fold change of expression in granule cells | |
|---|---|
| Gene | Log2 fold change |
| Nectin3 | 11.56 |
| Ybx3 | 9.24 |
| Cdh8 | 9.22 |
| Plppr4 | 9.14 |
| Cnksr3 | 8.88 |
| Chst15 | 8.82 |
| Heg1 | 8.58 |
| Tbata | 8.56 |
| Sema6d | 8.51 |
| Wnt7a | 8.46 |
| Mbp | 8.40 |
| Ptprt | 8.19 |
| Osbpl3 | 8.06 |
| Fyco1 | 8.06 |
| Ece1 | 7.99 |
| Yes1 | 7.84 |
| Trps1 | 7.75 |
| Ttyh2 | 7.44 |
| Ncam2 | 7.35 |
| Epha3 | 7.24 |
| Adamts10 | 7.21 |
| Pls3 | 7.03 |
| Ncald | 6.96 |
| Clstn2 | 6.94 |
| Ano3 | 6.93 |
| Prom1 | 6.83 |
| Daam2 | 6.75 |
| Ntn4 | 6.74 |
| Arhgap10 | 6.71 |
| Kank2 | 6.71 |
| Tgfbr3 | 6.59 |
| Mitf | 6.55 |
| Cgnl1 | 6.55 |
| Cdh4 | 6.47 |
| Kcnb2 | 6.44 |
| Ephb2 | 6.27 |
| Fgf13 | 6.20 |
| Rgl3 | 6.19 |
| D630045J12Rik | 6.11 |
| Vipr2 | 6.09 |
| Angpt1 | 5.93 |
| Tmem150c | 5.86 |
| Gria1 | 5.84 |
| Dpp10 | 5.76 |
| Fat3 | 5.74 |
| Bmp5 | 5.55 |
| Ptchd4 | 5.48 |
| Pard3 | 5.48 |
| Frmpd4 | 5.38 |
| Pxylp1 | 5.37 |
| Man2a1 | 5.35 |
| Nfatc2 | 5.33 |
| Inpp4b | 5.23 |
| Slc44a5 | 5.20 |
| Eml1 | 5.08 |
| D930015E06Rik | 5.01 |
| Mcc | 4.99 |
| Slc1a3 | 4.97 |
| Abca8b | 4.96 |
| Gpc6 | 4.96 |
| Ptpn22 | 4.95 |
| Aifm3 | 4.91 |
| Cux2 | 4.90 |
| Mapk12 | 4.79 |
| Fgd4 | 4.76 |
| Slc9a9 | 4.72 |
| Hs3st5 | 4.70 |
| Lgi3 | 4.69 |
| Bcl2l15 | 4.67 |
| Parp8 | 4.62 |
| Utrn | 4.61 |
| Stk3 | 4.59 |
| Phf21b | 4.55 |
| Etv6 | 4.54 |
| Diaph2 | 4.49 |
| Sipa1l2 | 4.49 |

TABLE 31-continued

| Log2 fold change of expression in granule cells | |
| --- | --- |
| Gene | Log2 fold change |
| Fmn1 | 4.46 |
| Dcc | 4.41 |
| Tesc | 4.34 |
| Scn9a | 4.28 |
| Tshz3 | 4.25 |
| Slc29a4 | 4.24 |
| Btbd11 | 4.23 |
| Lrrtm4 | 4.22 |
| Ttyh1 | 4.20 |
| Dgkz | 4.15 |
| Brinp2 | 4.06 |
| Rasgef1b | 4.05 |
| Slc24a3 | 4.05 |
| Mpp6 | 4.04 |
| Lgr5 | 4.03 |
| Cdc14b | 3.98 |
| Kcnq3 | 3.95 |
| Kcnip3 | 3.94 |
| Dpysl4 | 3.93 |
| Gpsm1 | 3.87 |
| Timp3 | 3.78 |
| Tango2 | 3.75 |
| Ltbp2 | 3.69 |
| Plec | 3.69 |
| Tmtc4 | 3.68 |
| Syn3 | 3.65 |
| Mmd2 | 3.65 |
| Tecpr1 | 3.61 |
| Hcfc2 | 3.60 |
| Gramd4 | 3.54 |
| St3gal5 | 3.52 |
| Rasa3 | 3.52 |
| Nxn | 3.47 |
| Pcdh9 | 3.37 |
| Pde4d | 3.19 |
| Them4 | −3.14 |
| BC003331 | −3.17 |
| Flt3 | −3.29 |
| Tgfbr1 | −3.33 |
| Trpm2 | −3.38 |
| Chd1l | −3.40 |
| Wdsub1 | −3.42 |
| Nin | −3.44 |
| Dpy19l1 | −3.45 |
| Tpm4 | −3.46 |
| Cdk14 | −3.46 |
| Khdrbs3 | −3.49 |
| Slc1a4 | −3.51 |
| Slc35f4 | −3.57 |
| Shroom3 | −3.60 |
| Ptprb | −3.62 |
| Lingo2 | −3.62 |
| Cflar | −3.65 |
| Glra2 | −3.67 |
| Slc36a1 | −3.67 |
| Tubb4a | −3.75 |
| Pam | −3.77 |
| Palld | −3.78 |
| Rnf43 | −3.78 |
| Skap2 | −3.78 |
| Ctdspl | −3.78 |
| Rnls | −3.78 |
| Ell2 | −3.82 |
| Crtac1 | −3.84 |
| Tenm3 | −3.87 |
| Slc16a9 | −3.89 |
| Vipr1 | −3.90 |
| Acmsd | −3.97 |
| Mob3b | −3.99 |
| Ankrd6 | −4.01 |
| Rai14 | −4.03 |
| Gpsm2 | −4.09 |
| Lima1 | −4.09 |
| Me1 | −4.12 |
| Gatm | −4.14 |
| Gk5 | −4.19 |

TABLE 31-continued

| Log2 fold change of expression in granule cells | |
| --- | --- |
| Gene | Log2 fold change |
| Cdh10 | −4.23 |
| Antxr1 | −4.23 |
| Sfmbt2 | −4.38 |
| Cep112 | −4.39 |
| Zdhhc15 | −4.57 |
| Epb41l5 | −4.62 |
| Efna5 | −4.62 |
| Lrfn2 | −4.63 |
| Agbl3 | −4.67 |
| Spag16 | −4.68 |
| Itga9 | −4.70 |
| Col13a1 | −4.71 |
| Dkk3 | −4.76 |
| Fnbp1l | −4.86 |
| Prkd3 | −4.87 |
| Rapgef5 | −4.87 |
| Zcwpw1 | −4.89 |
| Kank1 | −4.90 |
| Ddah1 | −4.91 |
| Slc25a13 | −4.94 |
| Cdk15 | −4.95 |
| Ppp1r16b | −5.01 |
| Sh3pxd2b | −5.06 |
| Epha4 | −5.12 |
| Zfp618 | −5.13 |
| Sncaip | −5.17 |
| Glis1 | −5.19 |
| Fggy | −5.22 |
| Frem1 | −5.24 |
| Pacsin2 | −5.33 |
| Cdh11 | −5.40 |
| Dok6 | −5.47 |
| Slc26a5 | −5.58 |
| Arhgap29 | −5.71 |
| Map3k21 | −5.78 |
| Slc41a3 | −5.78 |
| Hacl1 | −5.80 |
| Kcnh7 | −5.80 |
| Colgalt2 | −5.93 |
| Spats2l | −6.06 |
| Mal2 | −6.09 |
| Sgcz | −6.32 |
| Nkain2 | −6.45 |
| Iqsec3 | −6.66 |
| Dab1 | −6.67 |
| Stac | −6.71 |
| Sh3gl3 | −7.10 |
| Adamts16 | −7.23 |
| Rasgrp1 | −7.36 |
| Pde5a | −7.79 |
| Clip4 | −7.83 |
| Basp1 | −7.85 |
| Ifit2 | −8.21 |
| Galnt5 | −8.22 |
| Cobl | −8.89 |
| Meis2 | −8.97 |
| Clvs2 | −9.10 |
| Pde1a | −10.26 |
| Vwc2 | −10.39 |

Granule cell markers RNA Binding Protein, Fox-1 Homolog 3 (Rbfox3, also known as NeuN) and FAT Atypical Cadherin 2 (Fat2) were observed to be highly expressed in granule cells and were not observed to be significantly expressed in the other four cell types. Genes having greater value of the log 2 fold change in expression between nuclei of granule cells in humans and mice would be more effective as a marker for nuclei from human granule cells.

The log 2 fold change in expression in sorted nuclei from human basket cells compared to the normalized expression results for the sorted nuclei from mice basket cells are shown in Table 32. Negative values indicate reduced expression in the nuclei of the human basket cells compared to the normalized value for nuclei from mice basket cells, and a positive value indicates increased expression compared to the normalized value from nuclei from mice basket cells.

TABLE 32

| Log2 fold change of expression in basket cells | |
|---|---|
| Gene | Log2 fold change |
| Cntn3 | 7.56 |
| Luzp2 | 7.28 |
| Plpp4 | 6.83 |
| Gldc | 6.62 |
| Mpp7 | 6.43 |
| Slc6a7 | 6.39 |
| Ccdc88c | 6.24 |
| Mkx | 6.18 |
| Gng12 | 6.16 |
| Prom1 | 6.14 |
| Syt4 | 6.14 |
| Nkain1 | 6.03 |
| Ust | 6.02 |
| Arhgef26 | 6.01 |
| Adamts15 | 5.97 |
| Trpm2 | 5.95 |
| Vav2 | 5.84 |
| Nrp2 | 5.84 |
| Ar | 5.81 |
| Lrrc7 | 5.79 |
| Rit2 | 5.75 |
| Fyco1 | 5.73 |
| Lrrc1 | 5.73 |
| Lrtm1 | 5.71 |
| Cacna1e | 5.69 |
| Lingo2 | 5.67 |
| Atp11c | 5.65 |
| Lrrtm4 | 5.62 |
| Dcc | 5.41 |
| Kcnip3 | 5.39 |
| Adamts3 | 5.37 |
| Notch3 | 5.25 |
| Cdh4 | 5.24 |
| Pgr | 5.24 |
| L3mbtl4 | 5.23 |
| Lats2 | 5.21 |
| Sdk2 | 5.15 |
| Ntn4 | 5.11 |
| Chchd7 | 5.10 |
| Sphkap | 5.10 |
| Ebf4 | 5.04 |
| D930015E06Rik | 4.97 |
| Tmem47 | 4.94 |
| Dab1 | 4.90 |
| Chrna7 | 4.87 |
| Frmd6 | 4.86 |
| Ivd | 4.78 |
| Foxo1 | 4.76 |
| Prickle2 | 4.74 |
| Fah | 4.59 |
| Mbp | 4.56 |
| Chst9 | 4.51 |
| Cacna2d3 | 4.46 |
| Trpc3 | 4.46 |
| Sh3rf3 | 4.45 |
| St6gal1 | 4.44 |
| Inhba | 4.28 |
| Tmem196 | 4.24 |
| Prtg | 4.23 |
| Bcat1 | 4.23 |
| Tmtc1 | 4.20 |
| Ano3 | 4.19 |
| Rarb | 4.17 |
| Cdh1 | 4.17 |
| Zdhhc2 | 4.17 |
| Cstf2 | 4.16 |
| Ablim1 | 4.16 |
| Vegfa | 4.15 |
| Ddo | 4.14 |
| Chl1 | 4.12 |
| Pld5 | 4.12 |

TABLE 32-continued

| Log2 fold change of expression in basket cells | |
|---|---|
| Gene | Log2 fold change |
| Rsrp1 | 4.09 |
| Osbpl10 | 4.05 |
| Adamtsl1 | 3.98 |
| Sla | 3.98 |
| Brinp3 | 3.98 |
| Peli1 | 3.98 |
| Caln1 | 3.98 |
| Farp1 | 3.95 |
| Trpc7 | 3.91 |
| Ipcef1 | 3.91 |
| Tle4 | 3.90 |
| Sema4a | 3.83 |
| Pfkp | 3.79 |
| Pcsk5 | 3.79 |
| Serpini1 | 3.78 |
| Blm | 3.76 |
| Cnpy1 | 3.76 |
| Hacd1 | 3.74 |
| Ntn1 | 3.68 |
| Gpr171 | 3.66 |
| Gdpd5 | 3.65 |
| Dpp10 | 3.65 |
| Etl4 | 3.62 |
| Cachd1 | 3.61 |
| Phf24 | 3.60 |
| Mfsd4a | 3.56 |
| Rasa3 | 3.55 |
| Dgkq | 3.54 |
| Rreb1 | 3.54 |
| Smad3 | 3.52 |
| Cxxc4 | 3.50 |
| Tmx1 | 3.50 |
| Arhgef37 | 3.47 |
| Rdh10 | 3.45 |
| Pcsk6 | 3.41 |
| Nrcam | 3.38 |
| Prkca | 3.37 |
| Cotl1 | 3.37 |
| Dok6 | 3.37 |
| Igsf9b | 3.34 |
| Abtb2 | 3.30 |
| Shc4 | 3.25 |
| Zkscan2 | 3.24 |
| Arhgap10 | 3.24 |
| Cdh11 | 3.23 |
| Kcnt1 | 3.20 |
| Ccdc15 | 3.19 |
| Pparg | 3.19 |
| Kcnc1 | 3.18 |
| Arhgef2 | 3.17 |
| Kirrel3 | 3.16 |
| Eaf2 | 3.15 |
| Mei4 | 3.12 |
| Tmem2 | 3.12 |
| Tgfbr3 | 3.09 |
| Scn9a | 3.07 |
| Fndc3b | 3.06 |
| Zfp385b | 3.01 |
| Pcdh9 | 2.96 |
| Vsnl1 | 2.90 |
| Vldlr | 2.76 |
| Ica1l | −2.76 |
| Atp8a2 | −2.76 |
| Klhl3 | −2.79 |
| Il15 | −2.85 |
| Ubxn2b | −2.90 |
| Tarbp1 | −2.93 |
| Appl2 | −2.93 |
| St6gal2 | −2.95 |
| Ccdc138 | −3.01 |
| Phyhipl | −3.01 |
| Faim2 | −3.03 |
| Fam65b | −3.07 |
| Nefh | −3.07 |
| Gsap | −3.08 |
| Epb41l5 | −3.10 |

TABLE 32-continued

| Log2 fold change of expression in basket cells | |
|---|---|
| Gene | Log2 fold change |
| Grk4 | −3.10 |
| Dnaja4 | −3.11 |
| Itgav | −3.11 |
| Wdpcp | −3.11 |
| Camk2b | −3.11 |
| Atp1a1 | −3.14 |
| Pappa | −3.16 |
| Rgmb | −3.16 |
| Amotl1 | −3.17 |
| Qsox1 | −3.17 |
| Traf5 | −3.18 |
| Angpt1 | −3.18 |
| Hpcal4 | −3.20 |
| Arhgef33 | −3.21 |
| Sidt1 | −3.21 |
| Ntng1 | −3.23 |
| Eml1 | −3.26 |
| Fut10 | −3.27 |
| Lzts3 | −3.28 |
| Kcnip1 | −3.30 |
| Cntfr | −3.33 |
| Sh3rf1 | −3.36 |
| Itga9 | −3.39 |
| Col23a1 | −3.39 |
| Lrrk2 | −3.39 |
| Psd3 | −3.40 |
| Sfmbt2 | −3.40 |
| Coro2b | −3.41 |
| Tanc1 | −3.44 |
| Spg20 | −3.46 |
| Mgll | −3.46 |
| Gpsm2 | −3.47 |
| Slc12a8 | −3.48 |
| Plekhh1 | −3.48 |
| Ptprf | −3.49 |
| Slc25a13 | −3.51 |
| Tgfbr1 | −3.52 |
| Wwc2 | −3.54 |
| Tubb4a | −3.55 |
| Unc5a | −3.55 |
| Arhgef10l | −3.57 |
| Jph4 | −3.58 |
| Efhc1 | −3.61 |
| Hhip | −3.61 |
| Cobll1 | −3.64 |
| Slc22a4 | −3.65 |
| Tcerg1l | −3.66 |
| Ccnd2 | −3.69 |
| Rnf213 | −3.70 |
| Ttc28 | −3.71 |
| Pdzrn3 | −3.73 |
| Klhl5 | −3.73 |
| Ano4 | −3.83 |
| Slc35f4 | −3.89 |
| Stard13 | −3.89 |
| Gucy1a3 | −3.89 |
| Cdon | −3.92 |
| Trim66 | −3.92 |
| Vcan | −4.02 |
| Rab3b | −4.04 |
| Sema5a | −4.05 |
| Runx2 | −4.07 |
| Capn5 | −4.07 |
| Ehd3 | −4.13 |
| Cep112 | −4.13 |
| Mamdc2 | −4.17 |
| Kitl | −4.19 |
| Tub | −4.24 |
| Ift122 | −4.25 |
| Ak4 | −4.39 |
| Mob3b | −4.40 |
| Scrg1 | −4.45 |
| Adcyap1r1 | −4.51 |
| Tnfrsf19 | −4.55 |
| Prkd3 | −4.59 |
| Abca6 | −4.61 |

TABLE 32-continued

| Log2 fold change of expression in basket cells | |
|---|---|
| Gene | Log2 fold change |
| Pde9a | −4.61 |
| Map3k20 | −4.64 |
| Kalrn | −4.65 |
| Col26a1 | −4.69 |
| Basp1 | −4.80 |
| Cmya5 | −4.85 |
| Susd1 | −4.88 |
| Cdh22 | −4.88 |
| Fam19a2 | −4.93 |
| Fam135b | −4.93 |
| Ap1s3 | −4.96 |
| Rin2 | −5.03 |
| Tns1 | −5.09 |
| Abca9 | −5.20 |
| Ccdc146 | −5.28 |
| Zfp804b | −5.28 |
| Thsd7b | −5.34 |
| Garnl3 | −5.34 |
| Clstn2 | −5.36 |
| Iqca | −5.39 |
| Cemip | −5.42 |
| Rhbdl2 | −5.42 |
| Bazla | −5.46 |
| Antxrl | −5.46 |
| Kcnb1 | −5.46 |
| Mei1 | −5.52 |
| Exph5 | −5.54 |
| Spag16 | −5.57 |
| Golm1 | −5.60 |
| Epb41l4b | −5.73 |
| Ptprb | −5.76 |
| Pkd1l1 | −5.84 |
| Spats2l | −5.86 |
| Wdsub1 | −5.88 |
| Unc5d | −5.97 |
| Arsg | −6.00 |
| Ano5 | −6.01 |
| Slc13a3 | −6.02 |
| 1810041L15Rik | −6.05 |
| Galntl6 | −6.08 |
| Adra1b | −6.08 |
| Ky | −6.16 |
| Timp2 | −6.16 |
| Lrfn2 | −6.23 |
| Galnt14 | −6.26 |
| Smoc2 | −6.33 |
| Maats1 | −6.38 |
| Gramd3 | −6.56 |
| Bean1 | −6.66 |
| Slc37a1 | −7.30 |
| Tctex1d1 | −7.80 |
| Siah3 | −8.02 |
| Lmcd1 | −8.36 |

Basket cell markers Sorcs3 and Membrane Associated Ring-CH-Type Finger 11 (March11) were observed to be enriched in basket cells and were not observed to be significantly expressed in the other four cell types.

The log 2 fold change in expression in sorted nuclei from human astrocytes compared to the normalized expression results for the sorted nuclei from mice astrocytes are shown in Table 33. Negative values indicate reduced expression in the nuclei of the human astrocytes compared to the normalized value for nuclei from mice astrocytes, and a positive value indicates increased expression compared to the normalized value from nuclei from mice astrocytes.

TABLE 33

Log2 fold change of expression in astrocytes

| Gene | Log2 fold change |
|------|------------------|
| Pla2g7 | 11.22 |
| Folh1 | 10.51 |
| Cdh19 | 10.00 |
| Mybpc1 | 9.98 |
| Slco4a1 | 9.10 |
| Syt10 | 8.56 |
| Nwd1 | 8.15 |
| Itih3 | 8.13 |
| Adgra1 | 8.06 |
| Eva1a | 7.73 |
| Gpr153 | 7.50 |
| Micalcl | 7.14 |
| Ttll8 | 6.94 |
| Fam20a | 6.92 |
| Slc14a2 | 6.89 |
| Luzp2 | 6.83 |
| Rgs7bp | 6.36 |
| Cdc42ep1 | 6.11 |
| Cmtm5 | 6.03 |
| Plce1 | 5.98 |
| Afap1l2 | 5.95 |
| Gpld1 | 5.94 |
| Adamts20 | 5.77 |
| Ntsr2 | 5.73 |
| Ddo | 5.68 |
| Drp2 | 5.67 |
| Frmpd1 | 5.62 |
| Igdcc4 | 5.62 |
| Tmc7 | 5.59 |
| Prickle1 | 5.44 |
| Cspg5 | 5.43 |
| Rarb | 5.43 |
| Plcb1 | 5.38 |
| Kcnip3 | 5.30 |
| Grhl1 | 5.26 |
| Col9a3 | 5.19 |
| Stard8 | 5.18 |
| Tnc | 5.17 |
| Chst8 | 5.15 |
| Efhd1 | 5.07 |
| Adam11 | 5.06 |
| Plekhg1 | 5.04 |
| Plcb4 | 5.02 |
| Zfp467 | 4.98 |
| Fam234b | 4.79 |
| Tspan15 | 4.71 |
| Kcnj3 | 4.60 |
| Gdf10 | 4.59 |
| Irak2 | 4.58 |
| Gas2l3 | 4.58 |
| Slc14a1 | 4.56 |
| Whrn | 4.54 |
| Pde7b | 4.51 |
| Slc7a10 | 4.46 |
| Tsc22d3 | 4.44 |
| Mfn1 | 4.42 |
| Arrb1 | 4.38 |
| Gsap | 4.36 |
| Gjb6 | 4.35 |
| Dok5 | 4.34 |
| Clmn | 4.27 |
| Man1c1 | 4.22 |
| Cdh22 | 4.21 |
| Ppm1h | 4.19 |
| Cacng7 | 4.15 |
| Actr3b | 4.11 |
| Stox2 | 4.07 |
| Rgs7 | −4.17 |
| Dner | −4.36 |
| Slc25a13 | −4.48 |
| Fam171b | −4.54 |
| Fgf14 | −4.55 |
| Pik3c2b | −4.56 |
| Rnf144b | −4.59 |
| Mdfic | −4.60 |
| Sh3bgrl2 | −4.61 |

TABLE 33-continued

Log2 fold change of expression in astrocytes

| Gene | Log2 fold change |
|------|------------------|
| Pcsk5 | −4.67 |
| 2900011O08Rik | −4.68 |
| Dab2 | −4.69 |
| Srpx | −4.71 |
| Matn2 | −4.71 |
| Alk | −4.72 |
| St8sia1 | −4.74 |
| Crmp1 | −4.76 |
| Ppp4r4 | −4.81 |
| Snca | −4.82 |
| Cemip | −4.86 |
| Slc7a11 | −4.93 |
| Vav3 | −4.94 |
| Rftn1 | −4.95 |
| Dscam | −4.95 |
| Ldb2 | −4.98 |
| Galnt13 | −4.99 |
| Pde8a | −5.01 |
| Pde1a | −5.02 |
| Arhgef28 | −5.10 |
| Fstl5 | −5.14 |
| Dpp6 | −5.17 |
| Pde5a | −5.21 |
| Fmnl3 | −5.23 |
| Fam135b | −5.23 |
| Rgs6 | −5.23 |
| Plxdc2 | −5.25 |
| Syt17 | −5.29 |
| Apcdd1 | −5.32 |
| Dcc | −5.37 |
| Elmo1 | −5.45 |
| Plch1 | −5.53 |
| Angpt1 | −5.55 |
| Rerg | −5.57 |
| Dock2 | −5.58 |
| Grik3 | −5.66 |
| Efemp1 | −5.70 |
| Gas6 | −5.73 |
| Etl4 | −5.79 |
| Faim2 | −5.81 |
| Ncan | −5.85 |
| Lama4 | −5.87 |
| Lrrc3b | −5.89 |
| Ndrg4 | −5.97 |
| Pdzd2 | −6.14 |
| Ntng1 | −6.17 |
| Sh3bp2 | −6.18 |
| Masp1 | −6.19 |
| Lrp1b | −6.19 |
| Prkcq | −6.22 |
| Adamtsl1 | −6.24 |
| Sntb1 | −6.28 |
| Adamtsl3 | −6.31 |
| Prkar1b | −6.33 |
| Ryr3 | −6.38 |
| Asb18 | −6.38 |
| Dlgap2 | −6.40 |
| Dgkg | −6.42 |
| Shtn1 | −6.46 |
| Aif1l | −6.55 |
| Pdzrn3 | −6.60 |
| Inpp5d | −6.62 |
| Scn3a | −6.63 |
| Frmpd2 | −6.73 |
| Lmo3 | −6.75 |
| Mrvi1 | −6.77 |
| Tmem108 | −6.79 |
| Col22a1 | −6.80 |
| Nrg3 | −6.84 |
| Tub | −6.90 |
| Grm5 | −6.91 |
| Kcnt2 | −7.14 |
| Trim66 | −7.15 |
| Il17d | −7.38 |
| Mal | −7.43 |
| Lrrc7 | −7.50 |

TABLE 33-continued

| Log2 fold change of expression in astrocytes | |
| --- | --- |
| Gene | Log2 fold change |
| Vat1l | −7.54 |
| Fam198b | −7.57 |
| Fign | −7.80 |
| Lrrtm4 | −7.84 |
| Lmo2 | −8.08 |
| Rgcc | −8.10 |
| Smtn | −8.25 |
| C3 | −8.27 |
| Ccnd2 | −8.81 |

Aldehyde Dehydrogenase 1 Family Member L1 (Aldh1L1) and Slc1a3 was observed to be enriched in astrocytes and were not observed to be significantly expressed in the other four cell types. The log 2 fold change in expression in sorted nuclei from human oligodrocytes compared to the normalized expression results for the sorted nuclei from mice oligodendrocytes are shown in Table 34. Negative values indicate reduced expression in the nuclei of the human oligodendrocytes compared to the normalized value for nuclei from mice oligodendrocytes, and a positive value indicates increased expression compared to the normalized value from nuclei from mice oligodendrocytes.

TABLE 34

| Log2 fold change of expression in oligodendrocytes | |
| --- | --- |
| Gene | Log2 fold change |
| Kcnk13 | 8.44 |
| Il33 | 8.23 |
| Pkd2l1 | 7.46 |
| Insc | 7.39 |
| Rtkn2 | 7.16 |
| Efnb3 | 6.88 |
| Asah2 | 6.77 |
| Kndc1 | 6.76 |
| Galnt5 | 6.61 |
| Cobll1 | 6.60 |
| Pls1 | 6.36 |
| Adamtsl4 | 6.36 |
| Tenm2 | 6.31 |
| Pter | 6.08 |
| Mbp | 6.03 |
| Pla2g4a | 6.01 |
| Rnf43 | 6.01 |
| Fah | 5.99 |
| Bfsp2 | 5.68 |
| Il18 | 5.26 |
| Kcnq3 | 5.25 |
| Jph1 | 5.20 |
| Shroom3 | 5.19 |
| Sez6l2 | 5.04 |
| Skap2 | 4.94 |
| Gdpd5 | 4.81 |
| Rcbtb1 | 4.77 |
| Epha4 | 4.63 |
| Adamts20 | 4.59 |
| Tle1 | 4.57 |
| Arsg | 4.53 |
| Arhgef28 | 4.49 |
| Cacna2d1 | −4.35 |
| Pld5 | −4.41 |
| Dlc1 | −4.52 |
| Ttll11 | −4.53 |
| Rhobtb1 | −4.62 |
| Arfgef3 | −4.62 |
| Capn3 | −4.63 |
| Suclg2 | −4.64 |
| Piezo2 | −4.77 |
| Dpysl5 | −4.80 |
| Ttl | −4.81 |

TABLE 34-continued

| Log2 fold change of expression in oligodendrocytes | |
| --- | --- |
| Gene | Log2 fold change |
| Col9a2 | −4.88 |
| Ak5 | −4.97 |
| Dock2 | −4.98 |
| Tyms | −5.01 |
| Col18a1 | −5.01 |
| Pde5a | −5.01 |
| L3mbtl1 | −5.02 |
| Rgcc | −5.04 |
| Atp2b4 | −5.04 |
| L3mbtl4 | −5.05 |
| Slc35d2 | −5.06 |
| Cpne2 | −5.09 |
| Myh11 | −5.10 |
| Fbxl7 | −5.12 |
| Shroom4 | −5.14 |
| Syndig1 | −5.18 |
| Galnt15 | −5.24 |
| Prune2 | −5.26 |
| Fam196b | −5.28 |
| Glra2 | −5.31 |
| Snph | −5.32 |
| Cemip | −5.33 |
| Aass | −5.34 |
| Kcnh8 | −5.35 |
| Slc39a11 | −5.37 |
| Prex2 | −5.41 |
| Cntnap4 | −5.42 |
| Mcf2l | −5.46 |
| Shisa7 | −5.48 |
| Slc13a3 | −5.67 |
| Whrn | −5.68 |
| Trim66 | −5.69 |
| Plppr1 | −5.73 |
| Ajap1 | −5.74 |
| Tcfl5 | −5.75 |
| Rai14 | −5.78 |
| Ppp2r2b | −5.84 |
| Necab1 | −5.85 |
| Man2a1 | −5.94 |
| Hhatl | −5.96 |
| Grb10 | −6.14 |
| Vstm2b | −6.18 |
| Hs3st5 | −6.23 |
| Lrp2 | −6.35 |
| Ephx1 | −6.41 |
| Pde1a | −6.51 |
| Colgalt2 | −6.54 |
| Itga2 | −6.55 |
| D630003M21Rik | −6.78 |
| Fam124a | −6.98 |
| Eln | −7.10 |
| Baiap2 | −7.30 |
| Hpn | −7.35 |
| Clip4 | −7.42 |
| Cd22 | −7.54 |
| Zic4 | −7.65 |
| Gldn | −9.14 |

The log 2 fold change for gene expression of differentially expressed genes in nuclei from human OPCs compared to normalized gene expression for OPCs in mice nuclei is shown in Table 35. Negative values indicate a reduced gene expression in the nuclei of human OPCs, and positive values indicate increased gene expression in the nuclei of human OPCs compared to nuclei from mice OPCs.

TABLE 35

| Log2 fold change of expression in OPCs | |
| --- | --- |
| Gene | Log2 fold change |
| Tes | 7.74 |
| Lpcat2 | 7.58 |
| 1810041L15Rik | 7.01 |
| Eya1 | 6.66 |
| Fli1 | 6.60 |
| Scel | 6.32 |
| Foxp2 | 6.27 |
| Mro | 6.15 |
| Angpt1 | 5.97 |
| Rgs20 | 5.64 |
| Bfsp2 | 5.64 |
| Nrg1 | 5.57 |
| Rorb | 5.56 |
| Kcnk13 | 5.56 |
| Enpp6 | 5.52 |
| Nkain1 | 5.31 |
| Epha4 | 5.28 |
| Prr16 | 5.27 |
| Synpr | 5.26 |
| Sdc2 | 5.24 |
| Sulf1 | 5.10 |
| Nkain2 | 5.09 |
| Tenm2 | 5.07 |
| Arhgap24 | 5.06 |
| Nedd4l | 4.89 |
| Kndc1 | 4.88 |
| Mbp | 4.66 |
| Neu4 | 4.63 |
| Plekhg1 | 4.58 |
| Fmn1 | 4.52 |
| Cobll1 | 4.50 |
| Kcnb2 | 4.46 |
| Sel1l3 | −4.47 |
| Fgfr1 | −4.64 |
| Etl4 | −4.67 |
| Hecw1 | −4.68 |
| Golm1 | −4.76 |
| Htr2c | −4.84 |
| Rgmb | −4.90 |
| 9030617O03Rik | −4.98 |
| Atp13a4 | −5.05 |
| Pou6f2 | −5.09 |
| Dgkg | −5.17 |
| Col15a1 | −5.22 |
| Pde5a | −5.36 |
| Cemip | −5.40 |
| Ccdc146 | −5.41 |
| Acacb | −5.42 |
| Dab1 | −5.44 |
| Cdkl1 | −5.57 |
| Apod | −5.65 |
| Ntng1 | −5.85 |
| Kcnip4 | −5.86 |
| Slc25a43 | −5.90 |
| Nos1 | −5.91 |
| Apcdd1 | −5.95 |
| Chst9 | −6.01 |
| Tmem132c | −6.01 |
| Snph | −6.07 |
| Egfr | −6.26 |
| Ankrd55 | −6.29 |
| Cacng2 | −6.30 |
| Ano5 | −6.38 |
| Cmya5 | −6.54 |
| Scn9a | −6.84 |
| Crispld1 | −6.87 |
| Thbs2 | −7.56 |

Olig2 and Mog were observed to be enriched in both mature oligodendrocytes and oligodendrocyte progenitor cells (OPCs) and were not observed to be significantly expressed in the other four cell types. Hierarchical clustering of nuclear RNAseq profiles from all cerebellar cell types confirmed that the oligodendrocyte lineage splits into two groups, mature oligodendrocytes and OPCs, with the set of all oligodendrocytes clustering with mature oligodendrocytes.

Example 15

Identifying Factors That Impact Human Cell-Type Specific Gene Expression

A main reason for development of the cellular profiling technique described herein was to enable direct examination of human cell-type specific expression and its relationship to biological and clinical factors that might influence cellular function. Although the characterized nuclei were obtained from normal cerebellar samples, differences in gender, age, and the time between death and tissue preservation (autolysis time) may influence the expression data. Table 36 provides the number of genes observed to significantly change (adjusted p-value<0.01, baseMean>50) in the nuclei as a result of autolysis, gender, and age.

TABLE 36

| Number of genes with significantly changed expression | | | | |
| --- | --- | --- | --- | --- |
| | All | Granule | Basket | Glia |
| Autolysis | 12 | 4 | 1 | 1 |
| Gender | 27 | 15 | 35 | 25 |
| Age | 42 | 274 | 139 | 31 |

Age was observed to affect significant changes in expression in the most genes.

Example 16

Applying Antibody-Based Sorting of Cell Types to Post-Mortem Human Tissue

Inbred animals have been used previously for these types of studies, but heterogeneity has been observed across human individuals. To determine whether the cellular profiling technique described herein was effective for analysis of cell types in the human brain, post-mortem human cerebellar tissue from two donors (codes XK and PK), then isolated and stained nuclei using the cell-type specific antibodies defined previously. FACS of granule, basket, all glial, astrocyte, mature oligodendrocyte, and oligodendrocyte progenitor cell (OPC) nuclei from the cerebellum of the two individuals (XK and PK) was performed. Percentage of population in each gate is indicated in Table 37.

TABLE 37

| FACS results for post-mortem human tissue | | | |
| --- | --- | --- | --- |
| Cell Type | Population | Individual | Percentage |
| Granule | Itpr1− NeuN+ | XK | 91.40% |
| Basket | Itpr1+ NeuN− | XK | 0.85% |
| Glia | Itpr1− NeuN− | XK | 3.36% |
| Astrocytes | Itpr1− Olig2− NeuN− | XK | 3.05% |
| Oligodendrocytes - Mature | Olig2+ Low | XK | 1.18% |
| Oligodendrocytes - Precursors | Olig2+ High | XK | 0.40% |
| Cytoplasmic | — | XK | — |
| Granule | Itpr1− NeuN+ | PK | 92.00% |
| Basket | Itpr1+ NeuN− | PK | 0.75% |
| Glia | Itpr1− NeuN− | PK | 3.58% |
| Astrocytes | Itpr1− Olig2− NeuN− | PK | 1.33% |

TABLE 37-continued

| FACS results for post-mortem human tissue | | | |
|---|---|---|---|
| Cell Type | Population | Individual | Percentage |
| Oligodendrocytes - Mature | Olig2+ Low | PK | 3.07% |
| Oligodendrocytes - Precursors | Olig2+ High | PK | 0.23% |
| Cytoplasmic | — | PK | — |

Further analysis of the expression profiling from the results in Table 37 revealed two distinct populations: OLIG2+ low nuclei coming from mature oligodendrocytes and OLIG2+ high nuclei come from both oligodendrocyte precursor cells (OPCs) and mature oligodendrocytes.

After further flow cytometry analysis of oligodendrocytes, the OLIG2+ population appeared subdividable based on its level. Approximately 20% of all OLIG2+ nuclei have high levels of OLIG2 (High) while 80% have lower levels (Low).

Although the profile of stained human cerebellar nuclei was generally similar to rodent data, there were differences. For example, the conditions used to sort granule and basket neurons, astrocytes, oligodendrocytes, and OPCs were directly transferrable to human postmortem tissue, whereas those used to sort mouse and rat Purkinje cell nuclei were not successful for isolation of human Purkinje cell nuclei. Slight differences in staining were observed between the two postmortem human samples: in XK the oligodendrocyte and OPC populations were well separated, whereas they are more difficult to distinguish in individual PK.

To assess whether these differences would prevent cell type specific analysis of human postmortem samples, gene expression of nuclei isolated from five cell types (granule, basket, astrocyte, oligodendrocyte, OPC) was analyzed in these two individual brains using RNAseq. Examination of known markers from each of these cell types established that relevant cell specific markers were enriched for each cell type and depleted from the other cell types.

The log 2 fold change between the normalized RNAseq results from the nuclei of unsorted nuclei from mice, rat, and human samples compared to the RNAseq results for the sorted nuclei from granule cells, basket cells, astrocytes, oligodendrocytes, and OPCs cells from 2 human samples are shown in Table 38. Negative values indicate reduced expression in the nuclei of the cell type compared to the normalized value across nuclei from all cell types analyzed, and a positive value indicates increased expression compared to the normalized value across nuclei from all cell types analyzed. Table 38 shows the RNAseq results for the 250 most differentially expressed genes across all species for 2 post-mortem human samples.

TABLE 38

| | Log2 fold change in expression in 2 post-mortem human samples | | | | | | | | | |
|---|---|---|---|---|---|---|---|---|---|---|
| | Log2 fold change of expression in XK | | | | | Log2 fold change of expression in PK | | | | |
| Gene | Granule | Basket | Astro | Oligo | OPC | Granule | Basket | Astro | Oligo | OPC |
| A2m | 2.41 | 1.36 | 3.86 | 0.99 | 0.66 | 2.65 | 1.44 | 2.45 | 2.57 | 2.73 |
| Adamts15 | −2.61 | −0.51 | −0.64 | −0.72 | −1.50 | −2.43 | −0.26 | −2.45 | −1.26 | −0.92 |
| Adra1a | −2.41 | −2.40 | 3.14 | −0.23 | 2.91 | −2.23 | −1.26 | 4.46 | 2.68 | 3.83 |
| AI593442 | 0.83 | 2.50 | −1.57 | −1.63 | −2.32 | 0.21 | 2.32 | −2.05 | −2.04 | −2.20 |
| Aldh1a1 | −1.90 | −0.45 | 4.81 | 0.15 | −0.88 | −1.96 | 0.39 | 7.46 | −0.34 | −1.84 |
| Anln | −2.38 | −1.95 | −2.05 | 4.71 | −0.26 | −1.90 | −1.04 | −2.06 | 3.84 | 0.36 |
| Apcdd1 | −2.35 | −1.62 | 3.37 | 1.71 | 4.22 | −2.40 | −1.00 | 4.50 | 3.52 | 4.55 |
| Apod | −3.07 | −1.83 | −2.15 | 3.12 | 3.18 | −2.92 | −1.94 | −2.83 | 3.28 | 4.01 |
| Aqp4 | −3.01 | −1.95 | 2.79 | −1.84 | −2.37 | −2.01 | −0.63 | 3.97 | −0.68 | −2.69 |
| Arhgef33 | 0.21 | 1.04 | 0.48 | −1.25 | −0.66 | −0.01 | 0.87 | 0.74 | −0.48 | −1.03 |
| Ascl1 | −2.03 | −2.17 | 0.41 | 1.89 | 3.80 | −2.08 | −2.05 | 3.36 | 4.11 | 4.87 |
| Asgr1 | 1.53 | 2.81 | 3.77 | 1.12 | 3.31 | 2.43 | 4.46 | 2.58 | 0.65 | 3.71 |
| Aspa | −2.60 | −2.42 | 0.96 | 3.46 | −1.94 | −2.00 | −0.89 | 2.42 | 3.37 | 1.79 |
| Atp1a2 | −3.04 | −2.46 | 2.88 | −2.44 | 0.94 | −2.94 | −1.05 | 4.37 | 0.75 | 1.71 |
| Atp2a3 | −1.80 | −0.11 | −1.03 | −0.43 | −0.93 | −1.54 | 0.20 | −1.32 | −1.79 | −1.02 |
| B3gnt5 | 2.23 | 2.79 | 3.43 | 0.75 | −0.09 | 2.60 | 2.96 | 1.15 | 2.28 | 2.34 |
| B3gnt7 | −1.95 | −0.60 | −0.07 | 2.42 | 5.26 | −2.00 | −0.38 | −2.02 | 3.98 | 5.95 |
| Bcl11a | −2.16 | −0.08 | −1.62 | −1.37 | −0.99 | −2.32 | −0.52 | −2.02 | −0.60 | −0.22 |
| Bhlhe22 | −2.29 | 4.50 | 1.94 | 0.45 | −0.57 | −0.70 | 4.65 | −2.36 | 0.79 | −2.26 |
| C1ql1 | −1.66 | −2.24 | −1.40 | 0.37 | 4.31 | −2.13 | −1.86 | −0.60 | 2.85 | 4.35 |
| C1ql2 | −1.58 | −1.73 | −1.29 | −1.33 | 5.46 | −1.63 | −1.60 | −1.65 | 3.45 | 3.83 |
| C2orf72 | −0.17 | 2.68 | 2.49 | 2.83 | 4.01 | −1.10 | 2.57 | 4.69 | 3.25 | 3.71 |
| C8orf46 | −0.49 | −0.08 | 0.85 | 2.85 | 1.66 | −0.55 | −0.03 | 2.12 | 3.31 | 3.44 |
| Cacna1g | −2.86 | −0.09 | −1.63 | −1.49 | −0.21 | −2.64 | −1.13 | −3.21 | −0.52 | 0.22 |
| Cacng4 | −2.92 | −1.09 | 1.58 | −0.37 | 3.35 | −2.99 | −0.66 | 2.57 | 2.29 | 3.70 |
| Calb1 | −1.05 | 1.28 | −1.13 | −1.82 | −1.41 | −0.74 | 1.14 | −0.08 | −0.48 | −1.21 |
| Camk1g | −1.48 | 0.55 | −1.86 | −2.41 | −2.30 | −0.10 | 1.40 | −2.52 | −2.18 | −2.40 |
| Car8 | −0.67 | −1.26 | −1.71 | −1.20 | 1.97 | −0.68 | −2.91 | 0.09 | 0.62 | 1.56 |
| Carns1 | −0.92 | −0.05 | −0.15 | 5.08 | 1.53 | −1.37 | 0.67 | −0.90 | 5.63 | 3.11 |
| Casq2 | −1.41 | −0.49 | −2.05 | −0.96 | −0.99 | −1.11 | −0.50 | −2.52 | −0.87 | −2.39 |
| Cbln2 | −1.24 | 5.79 | 1.69 | 2.28 | 1.55 | −0.42 | 7.34 | 4.37 | 2.12 | −1.20 |
| Ccdc152 | −0.49 | −0.03 | 1.92 | 4.77 | −0.08 | −0.55 | 0.69 | 2.25 | 3.43 | 2.24 |
| Ccdc180 | 3.52 | 3.48 | 2.82 | 2.78 | 3.11 | 3.12 | 3.25 | 3.46 | 3.44 | 3.37 |
| Ccnd2 | −2.30 | 3.76 | 3.20 | −1.64 | 2.71 | −2.17 | 4.06 | 3.55 | 3.24 | 4.31 |
| Cd82 | −2.45 | −2.44 | −0.47 | 3.52 | 4.42 | −2.33 | −1.69 | −0.51 | 2.75 | 2.70 |
| Cd9 | −2.66 | −2.72 | 0.59 | 3.09 | 2.05 | −2.17 | −2.17 | 1.33 | 1.89 | 1.23 |
| Cdh19 | −2.44 | −2.51 | −2.34 | 3.25 | −0.53 | −2.85 | −1.92 | −2.86 | 2.50 | 1.26 |
| Cdhr1 | −0.93 | 4.68 | 1.09 | 3.02 | 1.04 | −1.29 | 3.82 | 2.46 | 4.17 | 4.19 |
| Cldn11 | −2.94 | −2.13 | 0.42 | 4.50 | −0.81 | −2.85 | −1.85 | 1.38 | 2.79 | 0.23 |

TABLE 38-continued

| | Log2 fold change in expression in 2 post-mortem human samples | | | | | | | | | |
| | Log2 fold change of expression in XK | | | | | Log2 fold change of expression in PK | | | | |
| Gene | Granule | Basket | Astro | Oligo | OPC | Granule | Basket | Astro | Oligo | OPC |
|---|---|---|---|---|---|---|---|---|---|---|
| Clec7a | −1.21 | 0.43 | 10.56 | 1.18 | 1.38 | −1.25 | 0.97 | 2.78 | −1.26 | −1.17 |
| Clmn | −3.08 | −2.35 | −0.82 | 2.88 | −1.27 | −3.21 | −2.22 | −0.80 | 2.22 | −0.31 |
| Cmtm5 | −2.87 | −2.44 | −1.92 | 0.30 | −0.60 | −2.89 | −2.87 | −0.39 | 1.79 | 0.75 |
| Cntn3 | −2.51 | −2.47 | −1.79 | −1.52 | 1.81 | −2.53 | −2.26 | −1.18 | 0.68 | 1.91 |
| Cntnap5a | −2.16 | 4.27 | 0.75 | 0.18 | 2.67 | −2.04 | 4.40 | −1.68 | 2.26 | 3.37 |
| Cobl | 2.98 | −1.71 | −0.27 | 4.05 | 3.26 | 2.78 | −1.15 | 0.19 | 4.00 | 3.74 |
| Col5a3 | −2.44 | −0.81 | 3.56 | 0.85 | 3.37 | −2.04 | −0.19 | 3.09 | 0.82 | 2.66 |
| Col6a1 | 2.85 | 3.11 | 2.76 | 3.48 | 2.62 | 2.23 | 2.77 | 3.54 | 2.57 | 3.35 |
| Cpm | −1.87 | −2.19 | −0.51 | 3.99 | 0.06 | −1.79 | −1.49 | −0.77 | 3.15 | 0.97 |
| Cryab | 1.42 | 0.27 | 1.05 | 3.91 | −1.31 | 1.36 | 0.66 | 2.77 | 3.93 | 1.88 |
| Cspg4 | −1.04 | −2.06 | −1.06 | −1.04 | 3.65 | −1.18 | −1.96 | 1.83 | 2.85 | 4.10 |
| Csrp1 | −2.74 | −2.27 | 1.46 | 2.02 | −0.46 | −2.70 | −2.10 | 2.33 | 1.82 | 0.03 |
| D7Ertd443e | −2.77 | −1.25 | −1.26 | 4.86 | 2.99 | −2.91 | −0.87 | −1.99 | 4.25 | 3.80 |
| Ddx3y | 0.89 | 1.06 | 1.36 | 1.69 | 0.90 | −2.85 | −2.63 | −2.87 | −3.09 | −3.04 |
| Dock5 | −2.58 | −2.02 | 2.11 | 4.77 | 0.92 | −2.35 | −1.12 | 3.09 | 4.05 | 0.87 |
| Dpy19l2 | 3.23 | 4.93 | 1.87 | 0.84 | 4.99 | 3.17 | 4.75 | 0.42 | 3.13 | 4.45 |
| Ebf2 | −1.85 | −2.39 | −1.00 | −0.23 | −0.79 | −1.76 | −1.74 | −1.99 | −1.64 | −1.41 |
| Echdc2 | 3.68 | 3.01 | 3.72 | 1.22 | 3.45 | 3.14 | 2.67 | 3.64 | 2.55 | 3.38 |
| Efna5 | 2.31 | 3.69 | −0.13 | −2.00 | −1.62 | 1.26 | 3.52 | −2.28 | −1.34 | −2.95 |
| Enpp2 | −3.16 | −1.20 | −2.64 | 3.57 | −0.53 | −3.10 | −1.25 | −3.29 | 3.16 | 0.49 |
| Erbb3 | −1.74 | −0.32 | 0.27 | 2.98 | 2.63 | −1.53 | −0.70 | −0.31 | 3.43 | 2.22 |
| Ermn | −1.03 | −2.26 | −2.00 | 5.41 | −1.92 | −0.30 | −1.27 | −2.44 | 4.04 | 1.87 |
| Etnppl | −2.06 | −1.77 | 3.56 | −1.04 | −0.87 | −1.64 | −1.36 | 4.68 | −2.31 | −1.82 |
| Fa2h | −1.41 | −2.44 | −1.69 | 3.82 | 1.65 | −2.35 | −1.81 | −1.54 | 3.21 | 2.20 |
| Fam46a | 2.20 | −2.32 | 4.19 | −1.29 | 1.64 | 2.15 | −0.44 | 4.17 | 2.28 | 3.67 |
| Fgfr2 | −3.05 | −2.83 | 2.84 | 2.78 | −2.01 | −3.25 | −1.63 | 3.67 | 1.97 | −0.45 |
| Flrt2 | −3.08 | 3.26 | 0.41 | −1.63 | 2.09 | −2.69 | 3.01 | −2.89 | 1.93 | 3.04 |
| Fmo3 | −1.13 | −0.98 | 1.07 | 2.39 | 6.18 | −1.21 | −1.00 | 0.78 | 6.05 | 8.59 |
| Folh1 | −3.04 | −2.23 | −2.45 | 4.57 | −2.77 | −3.25 | −1.45 | −3.25 | 3.85 | 1.11 |
| Foxh1 | 2.19 | 1.78 | 1.91 | −0.80 | 1.73 | 2.31 | 1.48 | 2.06 | −0.11 | 0.55 |
| Fsip2 | 2.31 | 4.18 | 3.53 | 4.22 | 3.88 | 3.08 | 4.64 | 4.04 | 3.91 | 4.58 |
| Fxyd1 | −2.23 | −2.40 | 2.43 | 0.51 | −0.30 | −1.58 | −1.95 | 3.01 | −0.43 | −2.18 |
| Fxyd7 | −1.93 | −1.90 | 3.07 | −0.78 | 0.34 | −1.77 | −1.38 | 3.20 | −0.65 | −1.88 |
| Gad2 | −2.78 | 4.02 | 0.22 | −1.66 | −2.40 | −2.43 | 4.13 | −2.30 | −1.48 | −2.97 |
| Gal3st1 | −2.77 | −1.52 | −2.22 | 1.10 | −1.25 | −2.61 | −1.47 | −2.33 | 1.51 | 1.16 |
| Galnt5 | 4.41 | −1.44 | 1.19 | −1.28 | 2.73 | 5.32 | −1.16 | 0.08 | 0.33 | −0.94 |
| Galnt6 | −1.80 | −1.34 | −1.82 | 2.72 | −1.25 | −2.12 | −1.38 | −1.90 | 3.05 | −0.64 |
| Galr1 | −2.37 | 0.00 | −1.44 | 1.58 | 4.83 | −0.90 | −0.84 | −1.94 | 5.66 | 7.65 |
| Gdf10 | −2.59 | −2.34 | 2.65 | −1.29 | −1.13 | −2.63 | −1.92 | 2.74 | −0.51 | −1.85 |
| Gfap | −2.78 | −1.96 | 3.97 | −1.81 | 0.03 | −2.21 | −1.27 | 4.28 | 0.74 | 1.43 |
| Gja1 | −2.60 | −2.34 | 3.59 | −0.45 | −1.32 | −2.08 | −0.52 | 3.80 | −0.63 | −2.89 |
| Gjb1 | −2.35 | −1.26 | −1.45 | 4.60 | 2.11 | −0.65 | −0.58 | −1.60 | 3.31 | 0.02 |
| Gjc2 | −1.03 | −0.99 | −1.72 | 2.19 | 2.77 | −1.65 | −1.74 | −2.00 | 0.76 | −2.34 |
| Gldn | −1.53 | −0.27 | 2.48 | 9.37 | 0.28 | −1.51 | 0.90 | −0.29 | 5.65 | 2.75 |
| Gli1 | 0.44 | −0.83 | 2.86 | −0.73 | −0.55 | 0.41 | −1.04 | 4.76 | −0.98 | −2.04 |
| Glp2r | −2.75 | −2.29 | −1.99 | −1.26 | −0.66 | −2.53 | −1.80 | −2.45 | −2.44 | −1.83 |
| Glul | −1.90 | −1.71 | 2.11 | 2.13 | −0.55 | −1.14 | −0.75 | 3.79 | 2.18 | 0.35 |
| Gm136 | 2.77 | 3.74 | 3.36 | 2.23 | 1.81 | 3.02 | 3.90 | 4.40 | 3.58 | 4.21 |
| Gnb3 | 3.39 | 4.09 | 0.67 | −0.35 | 1.45 | 3.14 | 3.73 | 1.88 | 1.41 | 1.14 |
| Gng11 | −1.29 | −1.43 | 0.99 | −1.05 | −0.95 | 0.00 | −1.30 | 2.01 | −1.34 | −1.25 |
| Gpr37 | −2.52 | −3.22 | −1.98 | 4.85 | −0.68 | −2.93 | −1.74 | −3.19 | 2.70 | −0.47 |
| Gpr37l1 | −2.04 | −2.04 | 1.65 | 0.88 | 2.47 | −2.14 | −1.30 | 3.10 | 1.80 | 2.70 |
| Gpr63 | −2.62 | −0.49 | −1.62 | −1.83 | −0.90 | −2.96 | −1.46 | −1.87 | −1.76 | −1.17 |
| Gpx2 | 3.29 | 3.11 | 2.80 | 3.10 | 3.40 | 3.71 | 3.28 | 4.46 | 4.05 | 3.00 |
| Gramd3 | −2.95 | 2.52 | 0.90 | 1.57 | 0.98 | −2.99 | 1.82 | 2.25 | 2.09 | 2.41 |
| Grb14 | −2.22 | −2.20 | −1.97 | −2.35 | −2.22 | −2.36 | −2.36 | −2.54 | −2.02 | −2.63 |
| Gria3 | −3.12 | 2.38 | −0.89 | −0.68 | 1.21 | −3.02 | 2.36 | −1.79 | 0.80 | 1.56 |
| Grik3 | −3.18 | 2.77 | 0.74 | −1.49 | 1.37 | −3.18 | 2.85 | 1.54 | 0.44 | 1.42 |
| Grm1 | 1.03 | 2.32 | −0.68 | −2.27 | −2.98 | 1.13 | 2.07 | −1.96 | −2.22 | −3.10 |
| Grm5 | −1.58 | −1.68 | 3.29 | 1.40 | 3.53 | −1.62 | −1.15 | 3.72 | 2.82 | 3.92 |
| Gsn | −2.00 | −2.33 | 2.05 | 4.20 | 2.19 | −2.22 | −1.63 | 1.52 | 2.49 | 1.03 |
| Hapln2 | 0.41 | 1.73 | 0.78 | 3.25 | −0.98 | 0.22 | 1.70 | 0.56 | 2.98 | 1.23 |
| Hepacam | −3.19 | −2.84 | 2.06 | 2.98 | 0.65 | −2.70 | −1.80 | 3.28 | 2.63 | 1.63 |
| Hhatl | −1.39 | −1.36 | 2.34 | 8.76 | 0.31 | −1.25 | −0.10 | 3.39 | 5.15 | 1.44 |
| Hspa1b | 2.20 | 3.24 | 8.76 | 5.40 | 6.45 | 3.24 | 3.50 | 1.56 | 1.27 | 0.52 |
| Htr1b | −1.24 | −1.38 | −0.94 | −1.00 | −0.88 | −1.29 | −1.25 | −1.30 | −1.29 | −1.20 |
| Id4 | −0.56 | −2.55 | 2.72 | −1.22 | −1.47 | 1.25 | −0.58 | 3.53 | −0.37 | −2.38 |
| Igsf11 | −1.91 | −2.07 | 1.35 | 2.67 | −0.37 | −1.34 | −0.79 | 1.60 | 1.64 | 0.57 |
| Il22 | −1.75 | 1.98 | −1.44 | 0.49 | −1.38 | −1.80 | 0.54 | −1.82 | 0.12 | −1.70 |
| Il33 | −2.08 | −2.26 | 2.09 | −0.83 | −1.59 | −1.99 | −1.67 | 3.67 | −1.36 | 0.56 |
| Insc | 0.59 | −2.21 | −0.62 | −1.20 | 0.22 | −0.44 | −1.78 | −0.66 | −0.81 | 0.87 |
| Itgb8 | −2.85 | −2.42 | 1.33 | 1.91 | 2.88 | −3.17 | −1.78 | 2.21 | 2.34 | 2.84 |
| Itih3 | −0.95 | −1.14 | −1.71 | −2.00 | −1.62 | −1.55 | −1.98 | −0.49 | −2.04 | −2.28 |

TABLE 38-continued

| | Log2 fold change in expression in 2 post-mortem human samples | | | | | | | | |
|---|---|---|---|---|---|---|---|---|---|
| | Log2 fold change of expression in XK | | | | | Log2 fold change of expression in PK | | | | |
| Gene | Granule | Basket | Astro | Oligo | OPC | Granule | Basket | Astro | Oligo | OPC |
| Itpr1 | −1.85 | 0.63 | −1.29 | −1.70 | −2.17 | −1.80 | −0.03 | −1.37 | −1.59 | −1.34 |
| Kcnc2 | −2.39 | −0.02 | −1.21 | −1.09 | −1.15 | −2.27 | −0.22 | −2.97 | −2.52 | −2.67 |
| Kcnj10 | −2.18 | −2.58 | 2.11 | 3.23 | 2.38 | −2.43 | −1.29 | 3.09 | 2.66 | 2.33 |
| Kiaa1644 | −1.40 | 1.86 | 0.88 | −2.16 | −2.15 | −1.50 | 2.78 | −2.86 | −1.95 | −2.21 |
| Kif19a | −1.73 | −2.27 | −1.37 | −1.12 | −0.42 | −2.48 | −1.41 | −0.09 | 0.25 | 0.15 |
| Kit | −3.23 | 3.60 | 0.01 | −1.09 | 0.23 | −2.93 | 3.64 | −2.11 | −0.35 | −0.64 |
| Kitl | −3.12 | 1.96 | 1.64 | −2.53 | −2.65 | −2.84 | 1.95 | 1.84 | −2.06 | −2.65 |
| Klk6 | −2.36 | −0.93 | −0.73 | 7.59 | −0.94 | −1.91 | −0.23 | −1.13 | 4.87 | 0.81 |
| Leng9 | 0.00 | −0.23 | 2.39 | 2.70 | 2.40 | 0.95 | 0.56 | 0.63 | 0.19 | 0.84 |
| Lfng | −1.63 | −2.14 | 2.80 | −0.97 | −0.80 | −1.08 | −1.65 | 2.77 | −1.71 | −2.40 |
| Lgi4 | −2.39 | −2.54 | 3.54 | 1.63 | −1.96 | −1.99 | −1.72 | 4.07 | 0.60 | −2.35 |
| Lims2 | −3.14 | −2.00 | −2.29 | −0.06 | 3.86 | −2.67 | −2.41 | −2.47 | 2.89 | 3.73 |
| Mag | −2.74 | −2.16 | −2.22 | 4.46 | −0.79 | −2.97 | −1.36 | −2.41 | 4.79 | 2.41 |
| Mak | 3.71 | 3.16 | 2.58 | 2.09 | 2.87 | 3.91 | 3.32 | 3.56 | 3.00 | 3.69 |
| Mal | −2.84 | −2.57 | 1.76 | 5.43 | 2.66 | −2.76 | −1.37 | 2.55 | 4.79 | 3.19 |
| March11 | −1.83 | 4.42 | 0.50 | −1.87 | −2.54 | −1.93 | 4.23 | −3.13 | −1.61 | −2.11 |
| Marcksl1 | 1.55 | 2.26 | 2.02 | 4.82 | 4.50 | 1.48 | 1.85 | 1.78 | 3.76 | 4.56 |
| Mcam | 0.45 | −0.41 | −0.87 | 1.32 | 1.96 | 0.50 | −1.08 | −1.96 | 1.46 | 0.45 |
| Mff | 0.80 | 0.77 | 0.51 | 1.28 | 0.83 | 1.05 | 0.79 | 1.33 | 1.27 | 1.52 |
| Mfge8 | −1.73 | −2.18 | 3.64 | 2.95 | 0.98 | −1.70 | −1.64 | 4.40 | 0.96 | 0.04 |
| Mlc1 | −2.26 | −2.15 | 3.43 | −0.67 | −1.19 | −1.32 | −1.41 | 4.45 | −1.63 | −0.94 |
| Mog | −2.53 | −2.69 | −2.16 | 4.30 | −1.38 | −2.81 | −1.68 | −2.61 | 4.03 | 0.91 |
| mt-Co1 | 2.94 | 3.32 | 1.79 | 2.88 | 2.79 | 3.88 | 4.61 | 3.85 | 5.43 | 4.54 |
| mt-Nd4 | 3.62 | 3.90 | 3.53 | 4.81 | 4.63 | 4.91 | 7.50 | 4.65 | 6.23 | 7.28 |
| Mybpc1 | −2.18 | −1.80 | −1.23 | −0.85 | −1.22 | −1.66 | −0.95 | −1.08 | −2.14 | −1.65 |
| Myot | 3.17 | 2.62 | 2.75 | 4.10 | 4.61 | 3.03 | 2.90 | 2.57 | 3.36 | 3.44 |
| Myrf | −1.61 | −1.46 | −1.85 | 3.71 | −0.77 | −1.96 | −0.99 | −1.29 | 4.02 | 1.17 |
| Ndrg1 | −3.13 | −0.72 | 0.71 | 4.48 | 2.96 | −2.28 | −0.34 | 1.48 | 3.30 | 1.92 |
| Nell1 | −1.82 | −1.49 | −0.68 | −0.86 | 1.11 | −1.52 | −1.29 | −1.58 | 0.48 | 1.11 |
| Neto1 | −2.79 | −2.45 | −1.87 | 0.86 | 2.37 | −2.83 | −2.60 | −2.85 | 2.81 | 3.38 |
| Neu4 | −1.96 | −2.10 | −0.45 | 0.07 | 3.45 | −1.01 | −1.97 | −0.32 | 2.79 | 3.83 |
| Ninj2 | −1.94 | −0.97 | −0.57 | 3.23 | 0.66 | −1.85 | −1.31 | −1.14 | 2.41 | −0.03 |
| Nkx2-2 | −2.92 | −2.74 | 2.51 | 2.93 | 3.70 | −2.95 | −2.62 | 2.29 | 1.32 | 1.39 |
| Notch1 | −2.76 | −2.66 | 0.87 | 0.05 | 2.69 | −3.09 | −2.44 | 2.22 | 1.69 | 2.12 |
| Nrk | −2.87 | −2.18 | 2.06 | −0.29 | −0.52 | −1.46 | −0.80 | 3.49 | −1.59 | −1.20 |
| Olig1 | −2.09 | −2.65 | −0.84 | 3.55 | 4.71 | −2.58 | −1.55 | −2.59 | 2.55 | 3.62 |
| Olig2 | −2.27 | −2.95 | −1.16 | 4.16 | 5.20 | −2.57 | −2.53 | −2.90 | 3.56 | 4.31 |
| Opalin | −2.78 | −2.54 | −1.08 | 5.29 | 2.73 | −2.28 | −1.03 | −2.18 | 5.00 | 1.78 |
| Pax3 | −2.05 | −2.66 | 2.92 | −0.57 | 2.55 | −2.24 | −1.70 | 4.08 | 1.79 | 3.10 |
| Pcp2 | −1.74 | −1.16 | −0.36 | 0.84 | 0.25 | −1.81 | −1.98 | −2.73 | −2.33 | −2.64 |
| Pdc | 2.65 | 2.93 | 1.60 | 1.96 | 5.97 | 3.00 | 2.87 | 0.74 | 1.70 | 1.71 |
| Pdgfra | −2.12 | −1.63 | −0.94 | 1.02 | 4.77 | −1.60 | −1.28 | −1.97 | 3.68 | 5.24 |
| Pdzd3 | −0.09 | −1.92 | −1.48 | −0.24 | −1.42 | −0.18 | −1.12 | −0.77 | −1.84 | −0.59 |
| Penk | −1.96 | −1.59 | −1.57 | −2.20 | −1.49 | −2.49 | −2.46 | −2.51 | −1.46 | −2.40 |
| Pex5l | −2.56 | −0.46 | −0.67 | 3.35 | 1.42 | −2.65 | −0.46 | −0.38 | 3.17 | 1.78 |
| Pgghg | −2.11 | −2.22 | 4.45 | −1.27 | 1.58 | −2.15 | −1.62 | 3.35 | −1.67 | −1.55 |
| Phyhip | 2.84 | 3.78 | 0.56 | −1.80 | 2.33 | 2.24 | 3.40 | 1.10 | 1.43 | −0.37 |
| Pkp3 | −0.52 | −1.87 | −0.02 | −0.09 | −1.35 | −1.06 | −1.73 | −1.09 | −1.78 | −1.68 |
| Pla2g16 | −1.14 | −1.56 | 0.86 | 3.61 | −0.06 | −0.83 | −1.03 | 1.23 | 2.77 | 0.75 |
| Plch1 | −1.51 | 4.35 | 2.55 | −0.52 | −0.73 | −1.76 | 4.00 | 2.93 | −0.94 | −1.67 |
| Plekhd1 | 1.47 | 3.20 | 0.43 | −2.37 | −2.40 | 0.45 | 2.91 | −2.29 | −1.58 | −2.65 |
| Plekhg3 | 0.41 | −2.15 | 0.10 | 3.81 | 1.29 | −0.18 | −1.49 | −0.09 | 2.34 | 1.31 |
| Pllp | −2.33 | −2.69 | −2.41 | 3.43 | 2.91 | −2.22 | −1.60 | −2.70 | 2.98 | 3.09 |
| Plp1 | −1.44 | −0.64 | −2.18 | 3.38 | −1.12 | −1.05 | −0.39 | −1.39 | 2.94 | 0.79 |
| Plpp3 | −3.04 | −1.43 | 2.24 | 1.27 | 1.60 | −2.75 | −1.70 | 3.26 | 1.64 | 2.15 |
| Plpp4 | −2.72 | −2.34 | −0.50 | 0.45 | 3.55 | −2.12 | −1.48 | −0.47 | 2.69 | 3.61 |
| Plscr1 | 1.91 | 3.22 | 3.21 | 0.29 | 2.00 | 2.64 | 3.63 | 1.59 | 1.55 | 3.28 |
| Plxnb3 | −0.44 | −2.33 | −0.24 | 1.42 | −0.20 | −0.62 | −2.17 | 1.73 | 2.86 | 2.00 |
| Pmp2 | −0.82 | −1.03 | 2.73 | 7.15 | 6.88 | −0.40 | 1.29 | 5.89 | 7.26 | 7.23 |
| Pmp22 | −2.04 | −2.68 | 1.23 | 3.34 | 2.40 | −1.95 | −1.73 | 2.49 | 2.74 | 1.75 |
| Ppfibp1 | −2.73 | −2.15 | −1.44 | 2.96 | 1.84 | −2.53 | −1.59 | −1.83 | 2.64 | 2.73 |
| Ppp1r14a | −2.22 | −1.90 | −1.24 | 3.87 | 1.45 | −1.99 | −0.43 | −1.80 | 3.62 | 3.55 |
| Ppp1r17 | −0.65 | −2.01 | −2.53 | 1.60 | −0.22 | −1.62 | −2.78 | −0.88 | 1.58 | 1.05 |
| Prex1 | −3.30 | −2.72 | 2.75 | 2.26 | 1.13 | −3.15 | −1.87 | 3.05 | 2.17 | 2.34 |
| Prex2 | −3.07 | −0.31 | 3.06 | 2.25 | 2.39 | −3.15 | −0.81 | 3.36 | 2.03 | 2.57 |
| Prima1 | 1.17 | −0.57 | 1.41 | 3.97 | 0.08 | 0.75 | −1.03 | 1.71 | 2.93 | 1.14 |
| Prkcg | −3.31 | 2.38 | −0.69 | −2.45 | −0.83 | −2.72 | 2.30 | −2.41 | −1.38 | −0.57 |
| Prr5 | −2.07 | 0.39 | 1.24 | −1.36 | −1.19 | −1.92 | 0.08 | 2.39 | −2.03 | −1.70 |
| Prrg3 | 0.78 | 0.83 | 4.51 | 4.67 | 4.51 | 1.33 | 1.82 | 0.98 | 0.80 | 1.18 |
| Prrx1 | −0.87 | −2.28 | 2.61 | −0.21 | 3.56 | −2.53 | −2.13 | 3.09 | 3.14 | 4.46 |
| Ptchd4 | −1.96 | 2.17 | −1.08 | −2.66 | −2.40 | −2.25 | 2.11 | −3.03 | −2.71 | −3.03 |
| Ptprk | −3.02 | 3.05 | −0.27 | 2.24 | 0.48 | −3.13 | 3.27 | −0.50 | 1.60 | 0.96 |
| Ptprz1 | −3.08 | 0.57 | 0.72 | −0.97 | 2.44 | −2.82 | 0.48 | 1.74 | 1.79 | 3.10 |

TABLE 38-continued

| | Log2 fold change in expression in 2 post-mortem human samples | | | | | | | | | |
|---|---|---|---|---|---|---|---|---|---|---|
| | Log2 fold change of expression in XK | | | | | Log2 fold change of expression in PK | | | | |
| Gene | Granule | Basket | Astro | Oligo | OPC | Granule | Basket | Astro | Oligo | OPC |
| Pttg1 | −1.72 | −0.90 | −1.53 | 0.35 | −2.33 | −2.01 | −2.66 | −2.32 | −2.02 | −2.62 |
| Pvalb | −2.69 | 3.17 | −0.09 | −2.29 | −2.31 | −2.74 | 2.81 | −2.76 | −0.55 | −1.84 |
| Pxdc1 | −2.14 | −1.59 | 1.57 | 0.50 | 1.98 | −1.44 | −0.42 | 1.41 | 2.10 | 3.10 |
| Qk | −1.35 | 0.30 | 2.02 | 3.33 | 2.10 | −1.04 | 0.60 | 2.17 | 2.58 | 2.25 |
| Rapgef3 | −2.15 | −1.31 | 1.14 | 3.22 | 0.93 | −2.57 | −0.73 | 2.17 | 2.45 | 0.29 |
| Rassf2 | −0.45 | −2.43 | 0.90 | 2.03 | 0.80 | −1.05 | −1.86 | 1.53 | 1.88 | 1.30 |
| Rbp2 | 3.10 | 4.06 | 2.78 | 2.44 | 3.23 | 3.38 | 3.82 | 4.93 | 4.26 | 4.27 |
| Rbpjl | −1.78 | −1.39 | −1.38 | −0.01 | −0.58 | −1.24 | −1.80 | −1.07 | −1.85 | 1.19 |
| Rgcc | −2.71 | −1.82 | 3.45 | 3.46 | 2.67 | −2.92 | −1.44 | 3.69 | 3.08 | 2.72 |
| Rgma | −3.15 | −2.86 | 1.50 | −1.67 | −1.38 | −2.78 | −2.25 | 3.11 | −2.17 | −1.88 |
| Ryr1 | −0.51 | 3.88 | 2.16 | −0.89 | 0.17 | −0.52 | 3.98 | −0.35 | −0.13 | 0.53 |
| S100b | −2.84 | −2.35 | 3.12 | 3.41 | 2.58 | −3.01 | −1.80 | 3.36 | 2.53 | 1.93 |
| S1pr1 | −2.31 | −1.39 | 3.17 | −1.99 | −2.39 | −2.77 | −1.30 | 5.33 | −1.03 | −1.95 |
| Sall1 | −2.25 | −2.14 | 1.98 | 4.65 | 1.19 | −2.70 | −1.13 | 1.35 | 4.40 | 2.70 |
| Sec14l5 | −0.57 | −0.07 | −0.37 | 4.65 | −0.46 | −0.79 | 0.46 | 0.01 | 3.72 | 0.39 |
| Serpine2 | −2.58 | −0.89 | 2.34 | −0.66 | 1.38 | −2.88 | −0.19 | 4.15 | 2.08 | 2.47 |
| Shisa6 | −3.31 | 2.04 | 0.23 | −2.18 | −1.75 | −3.24 | 1.94 | 0.86 | −1.28 | −0.62 |
| Skor2 | −1.74 | −1.05 | −0.04 | −0.78 | −1.17 | −2.05 | −0.81 | −2.37 | −2.36 | −2.24 |
| Slc1a3 | −3.01 | −2.31 | 3.60 | 1.34 | 0.51 | −2.90 | −0.86 | 4.60 | 1.57 | 1.22 |
| Slc1a6 | 0.42 | 0.81 | −0.88 | −1.49 | −1.92 | 0.38 | 0.98 | −2.28 | −1.39 | −1.06 |
| Slc26a3 | 2.32 | 2.47 | 7.99 | 6.23 | 5.77 | 2.96 | 2.83 | 3.07 | 2.63 | 2.59 |
| Slc32a1 | −2.78 | 2.32 | −1.54 | −1.84 | −1.70 | −2.81 | 1.64 | −2.25 | −1.73 | −2.75 |
| Slc4a4 | 0.50 | −2.75 | 3.17 | −1.65 | −2.15 | 0.56 | −1.84 | 3.40 | −2.46 | −2.57 |
| Slc5a11 | −1.31 | −0.76 | 0.30 | 7.86 | 0.54 | −1.46 | −0.56 | −0.87 | 4.64 | 1.51 |
| Slc9a3 | −1.15 | −1.58 | −1.67 | −0.93 | −1.58 | −0.48 | −1.58 | −0.02 | −0.99 | −1.49 |
| Slitrk6 | 3.16 | −1.94 | −1.50 | −1.54 | 1.70 | 3.66 | −1.15 | −0.26 | 2.71 | 4.04 |
| Socs2 | −2.41 | 2.72 | −1.54 | −0.93 | −0.77 | −2.46 | 3.10 | −1.25 | −2.46 | −2.37 |
| Sorcs3 | −2.79 | 3.68 | 0.56 | 0.21 | 2.21 | −2.54 | 3.88 | −2.07 | 1.08 | 2.33 |
| Sox10 | 0.30 | 0.19 | −1.32 | 2.37 | 2.74 | −0.09 | 0.55 | 0.92 | 4.44 | 4.74 |
| Sox2 | −2.61 | −1.27 | 3.23 | 4.07 | 4.33 | −2.24 | −1.17 | 4.05 | 3.95 | 4.09 |
| Sox6 | −2.80 | −2.46 | 1.64 | 0.72 | 3.53 | −2.68 | −1.95 | 2.13 | 2.68 | 3.94 |
| Sox8 | −2.80 | −2.37 | 1.00 | 3.60 | 2.23 | −2.51 | −2.22 | 1.18 | 2.59 | 2.37 |
| Stag3 | 4.19 | 3.01 | 3.18 | 4.59 | 3.98 | 4.26 | 3.50 | 4.05 | 4.13 | 4.32 |
| Stk32a | −2.24 | −2.59 | 2.86 | 0.49 | 3.14 | −2.17 | −1.40 | 3.71 | 2.45 | 3.72 |
| Sulf2 | −2.64 | 1.55 | −1.54 | −0.29 | 3.18 | −2.55 | 0.56 | −2.34 | 2.48 | 3.48 |
| Susd5 | −0.39 | 0.94 | −0.94 | 1.31 | 3.55 | −0.16 | 1.13 | −0.58 | 2.78 | 3.58 |
| Tceal7 | 2.95 | 3.03 | 3.95 | 4.01 | 4.71 | 3.35 | 2.90 | 2.14 | 3.93 | 2.05 |
| Tfap2b | −3.00 | 4.27 | 0.56 | −2.53 | −0.23 | −3.03 | 4.14 | −1.26 | −0.41 | 0.08 |
| Thbs2 | −2.31 | −1.08 | 2.27 | 4.41 | 4.32 | −2.47 | −0.40 | 2.42 | 4.46 | 4.37 |
| Tmem125 | −1.10 | −0.88 | −1.49 | 6.09 | −0.57 | −1.85 | −1.12 | −1.87 | 2.71 | −1.04 |
| Tmem132d | −2.17 | −2.32 | −1.26 | −0.05 | 3.41 | −1.90 | −1.83 | −2.54 | 2.02 | 3.33 |
| Tmem63a | −1.69 | −1.10 | 0.54 | 3.69 | −1.49 | −1.72 | −0.63 | 1.90 | 3.72 | 0.14 |
| Tmem98 | −0.31 | −2.16 | 1.38 | 5.10 | −0.89 | −0.06 | −1.37 | 1.08 | 4.56 | 1.05 |
| Tnc | −2.88 | −2.98 | 1.48 | −0.74 | −0.92 | −2.47 | −2.43 | 1.17 | −1.19 | −0.17 |
| Tnfrsf13c | 2.29 | 2.17 | 6.91 | 5.64 | 5.16 | 2.16 | 2.56 | 2.18 | 1.70 | 2.34 |
| Tns3 | −0.95 | −2.56 | 2.26 | −0.22 | 3.18 | −0.80 | −2.36 | 2.08 | 1.17 | 3.02 |
| Trabd2b | −2.47 | −0.95 | −0.47 | −0.60 | 0.21 | −2.26 | −1.29 | −0.50 | −0.06 | −0.82 |
| Tril | −2.31 | −2.70 | 2.89 | −1.05 | 0.04 | −2.37 | −1.71 | 3.19 | −0.59 | 0.37 |
| Trpc3 | −3.25 | −1.84 | −0.98 | −2.17 | 0.27 | −3.35 | −2.36 | −1.73 | −0.26 | 1.17 |
| Trpc7 | −2.19 | 0.47 | −1.20 | −1.48 | −1.35 | −1.86 | 0.70 | −2.16 | −1.71 | −2.09 |
| Tshb | −2.14 | −1.76 | −1.84 | −1.89 | −1.78 | −2.19 | −2.15 | −2.20 | −1.65 | −2.10 |
| Tspan11 | 0.28 | 0.70 | 1.39 | −1.67 | 0.99 | 0.15 | 0.22 | 3.74 | 1.47 | 2.72 |
| Tspan2 | −2.96 | −3.35 | −2.38 | −2.13 | −2.41 | −2.63 | −2.65 | −3.10 | −1.33 | −2.20 |
| Tuba8 | 0.92 | 1.20 | −0.70 | −2.06 | 0.89 | 0.41 | 0.99 | −0.85 | −0.63 | −0.67 |
| Tubb2b | −0.31 | −0.45 | 4.05 | −1.44 | 4.03 | −0.62 | 0.50 | 3.82 | 1.62 | 0.90 |
| Txnip | −0.03 | −1.79 | 2.51 | 2.45 | 2.28 | 1.77 | −1.29 | 2.32 | 2.84 | 3.25 |
| Ube2b | 1.08 | 0.52 | 0.59 | 1.08 | −0.08 | 1.24 | 0.86 | 0.38 | 0.40 | 0.25 |
| Ugt8a | −1.09 | −1.48 | −1.94 | 3.83 | 1.77 | −1.30 | −1.52 | −1.15 | 2.84 | 1.63 |
| Upp1 | 3.95 | 5.09 | 3.54 | −0.04 | 1.73 | 3.95 | 4.50 | 2.99 | 2.13 | 3.73 |
| Vstm2b | 2.04 | 0.41 | 0.02 | 4.35 | 4.22 | 2.53 | 0.86 | −0.99 | 3.35 | 3.37 |
| Wfdc1 | −2.94 | −0.50 | 3.60 | −0.63 | 2.28 | −1.99 | −1.62 | 4.45 | 1.32 | 2.29 |
| Xrra1 | 3.12 | 2.91 | 3.26 | 3.87 | 3.29 | 3.33 | 3.08 | 3.28 | 3.22 | 3.00 |
| Zcchc24 | −3.21 | −2.59 | 1.32 | 2.51 | 3.14 | −3.16 | −2.14 | 1.58 | 2.50 | 3.08 |
| Zeb2 | −3.40 | −3.14 | 1.72 | 2.88 | 1.47 | −3.39 | −2.03 | 1.85 | 2.78 | 1.95 |
| Zfp36l1 | −2.48 | −0.30 | 4.35 | −1.90 | 3.68 | −2.08 | −0.02 | 4.68 | 2.67 | 4.00 |

RBFOX3 (also known as NeuN) and FAT2 were observed to be significantly enriched in granule cells for both samples. MARCH11 was observed to be significantly enriched in basket cells from both samples. ALDH1L1 and SLC1A3 were observed to be significantly enriched in astrocytes from both samples. Olig2 was observed to be significantly enriched in oligodendrocytes and OPCs from both samples. MOG was observed to be significantly enriched in oligodendrocytes from both samples. PDGFRA was observed to be significantly enriched in OPCs from both samples. Only Olig2+ High nuclei express genes such as Pdgfra and Chondroitin Sulfate Proteoglycan 4 (Cspg4) that mark oligodendrocyte precursor cells (OPCs). Olig2+ Low nuclei were from mature oligodendrocytes, while Olig2+ High nuclei were from a mixture of mature oligodendrocytes and immature OPCs. In all cases, high expression of markers only in the expected cell type was observed. Therefore, Olig2 (all oligodendrocytes), Pdgra and Cspg4 (OPCs), Mag and Mog (mature oligodendrocytes) were identified as effective for performing cellular profiling technique described herein.

These results highlight the utility of the cellular profiling technique described herein for identification of unexpected subpopulations as a result of its highly quantitative nature. Heterogeneity in the results may be used to identify biomarkers in patients. For example, heterogeneity may be able to predict how different individuals respond to drugs or identify therapeutic targets.

Example 17

Correlation Between the RNAseq Results for Each Sample

Table 39 shows Pearson coefficients between the 2 postmortem human samples, XK and PK for each cell type.

TABLE 39

| | Pearson coefficients between XK and PK samples | | | | | | | | | |
|---|---|---|---|---|---|---|---|---|---|---|
| | granule | | basket | | astrocyte | | oligo | | opc | |
| | xk | pk | xk | pk | xk | pk | xk | pk | xk | pk |
| xk.granule | 1.00 | 0.99 | 0.96 | 0.97 | 0.94 | 0.94 | 0.93 | 0.95 | 0.93 | 0.94 |
| pk.granule | 0.99 | 1.00 | 0.96 | 0.97 | 0.94 | 0.94 | 0.93 | 0.95 | 0.93 | 0.94 |
| xk.basket | 0.96 | 0.96 | 1.00 | 0.99 | 0.94 | 0.94 | 0.93 | 0.95 | 0.94 | 0.94 |
| pk.basket | 0.97 | 0.97 | 0.99 | 1.00 | 0.95 | 0.95 | 0.94 | 0.96 | 0.94 | 0.95 |
| xk.astrocyte | 0.94 | 0.94 | 0.94 | 0.95 | 1.00 | 0.97 | 0.94 | 0.95 | 0.94 | 0.94 |
| pk.astrocyte | 0.94 | 0.94 | 0.94 | 0.95 | 0.97 | 1.00 | 0.93 | 0.95 | 0.94 | 0.95 |
| xk.oligo | 0.93 | 0.93 | 0.93 | 0.94 | 0.94 | 0.93 | 1.00 | 0.97 | 0.95 | 0.95 |
| pk.oligo | 0.95 | 0.95 | 0.95 | 0.96 | 0.95 | 0.95 | 0.97 | 1.00 | 0.96 | 0.97 |
| xk.opc | 0.93 | 0.93 | 0.94 | 0.94 | 0.94 | 0.94 | 0.95 | 0.96 | 1.00 | 0.96 |
| pk.opc | 0.94 | 0.94 | 0.94 | 0.95 | 0.94 | 0.95 | 0.95 | 0.97 | 0.96 | 1.00 |

Figure 9:
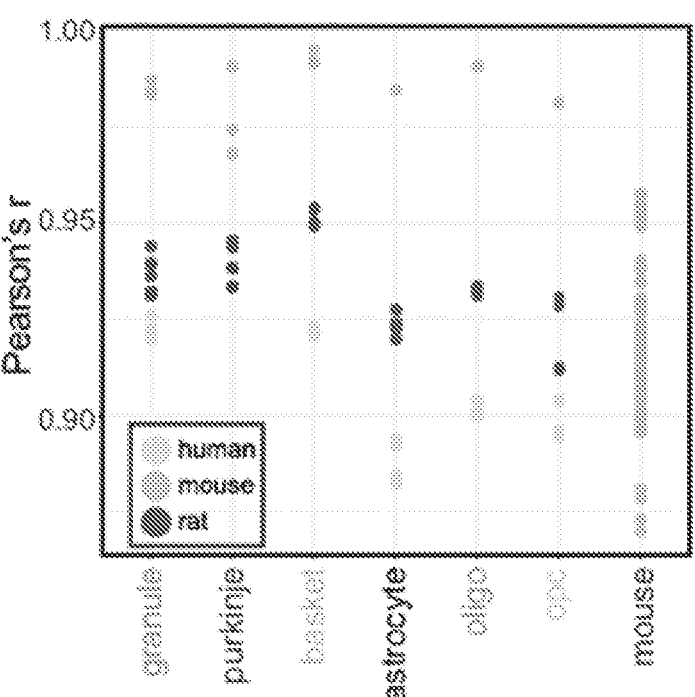
FIG. 9 provides a dot plot showing pairwise Pearson's correlation coefficient for each sample, broken down by cell type and species.

FIG. 9 provides a dot plot showing pairwise Pearson's correlation coefficient for each sample, broken down by cell type to compare results among human, rat, and mouse samples. Calculation of pairwise Pearson correlation coefficient across the ten datasets revealed that the two neuronal cell types (granule and basket) were highly correlated between samples (r=0.99 for both), while the glial data had slightly lower correlations (r=0.96-0.97). Furthermore, hierarchical clustering revealed separation by cell type, indicating that the variation across cell types is stronger than variation among individual samples. The range of correlation coefficients between the samples for the same cell type across species was observed to be similar to clustering for cell types isolated from the same species, suggesting that both cell type and species are important properties of the expression profiles.

Example 18

Determining Effects of Autolysis on Human Cell-Type Specific Gene Expression Prior literature how shown that autolysis time, defined as the time between death and when the tissue is frozen, does not correlate with RNA quality and has only minor effects on gene expression (Gupta et al., 2012, BMC Genomics13, 26, which is hereby incorporated by reference herein in its entirety). Because post-mortem human samples have been previously observed to vary widely in autolysis time, the effect of autolysis time on gene expression in the nuclear samples from the 16 human subjects previously characterized to determine whether clinical attributes affect gene expression.

The shortest autolysis time among the samples was 5.13 hours and the longest autolysis time among the samples was 24 hours as shown in Table 40.

TABLE 40

| | Autolysis time in human samples | | |
|---|---|---|---|
| Sample | Autolysis (h) | Sample | Autolysis (h) |
| XK | 19.5 | SG | 12 |
| TM | 10.5 | OR | 8 |
| WO | 10 | LT | 10.5 |
| WC | 19.1 | ZH | 19.4 |
| WI | 16.5 | KO | 5.5 |
| PK | 14.8 | KQ | 13 |
| VM | 15.5 | KE | 24 |
| WL | 13.5 | AI | 5.13 |

Only a few genes were observed have significantly altered expression with autolysis time: 12 across all post-mortem human tissue samples, four in granule cells, one in basket cells, and one in glia. The log 2 fold change for differentially expressed genes across the human samples with differing autolysis times. Table 41 provides analysis of differentially expressed genes (adjusted p<0.01, baseMean>50) due to autolysis time across all samples.

TABLE 41

| | Differentially expressed genes across all human samples | | | |
|---|---|---|---|---|
| Gene | baseMean | log2FoldChange | p-value | p-adj |
| NPAS4 | 509.499 | 0.901 | 1.31E-18 | 2.72E-14 |
| FOSB | 128.225 | 0.748 | 5.09E-16 | 3.51E-12 |
| EGR1 | 470.894 | 0.469 | 1.58E-11 | 8.18E-08 |
| NR4A1 | 374.351 | 0.403 | 1.08E-10 | 4.46E-07 |
| FOS | 369.433 | 0.373 | 5.78E-07 | 1.10E-03 |
| HSPA1A | 967.333 | 0.336 | 9.07E-08 | 2.35E-04 |
| PPP1R15A | 79.021 | 0.272 | 1.36E-08 | 4.02E-05 |
| NR4A3 | 552.102 | 0.242 | 5.85E-07 | 1.10E-03 |
| DNAJB1 | 383.949 | 0.216 | 8.56E-07 | 1.48E-03 |
| BCAS2 | 321.395 | 0.183 | 2.91E-06 | 3.61E-03 |
| LINC01515 | 262.569 | -0.283 | 2.96E-06 | 3.61E-03 |
| MIR6723 | 5535.414 | -0.733 | 8.02E-17 | 8.30E-13 |

Npas4 was observed to have the greatest fold change in expression across nuclei compared to normalized expression in unsorted nuclei from the same samples.

Table 42 provides the genes in granule cells that are differentially expressed (adjusted p<0.01, fold change>2) compared to normalized expression across human samples with differing autolysis times.

TABLE 42

Differentially expressed genes in granule cells

| Gene | baseMean | log2 Fold Change | p-value | p-adj |
|------|----------|------------------|---------|-------|
| NPAS4 | 1337.014 | 0.925 | 2.46E−10 | 3.93E−06 |
| FOSB | 305.432 | 0.827 | 9.37E−09 | 4.98E−05 |
| FOS | 689.775 | 0.812 | 1.06E−09 | 8.49E−06 |
| EGR1 | 1085.415 | 0.505 | 2.32E−06 | 9.24E−03 |

The four genes observed to be differentially expressed in the nuclei of granule cells were also differentially expressed in unsorted nuclei from all samples as shown in Table 42.

Inhibin Beta A Subunit (Inhba) was observed to be the only gene in the nuclei of basket cells being differentially expressed (baseMean: 6.673; $\log_2$ Fold Change: 0.466; p-value: 1.15E-08; padj: 2.18E-04).

Figure 10:
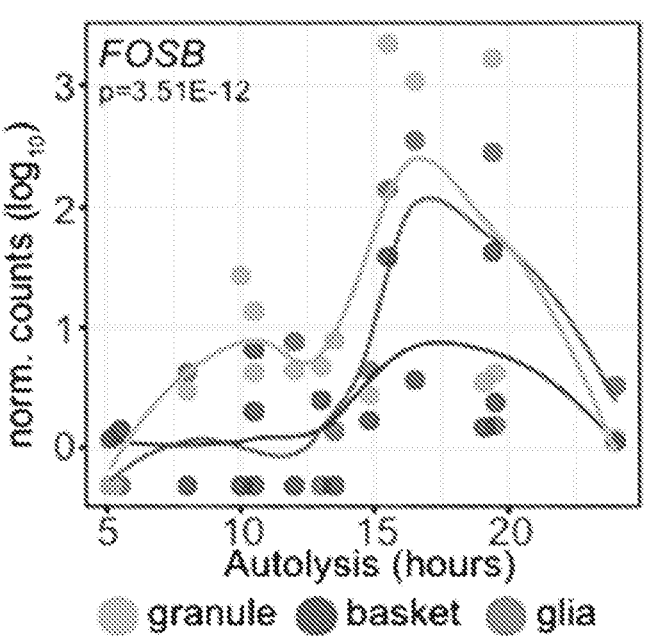
FIG. 10 is a graph showing changes in expression of FosB in granule, basket, and glial cells for an autolysis time of 5 to about 25 hours.

Only Kinesin Family Member 19 (Kif19) in glia (base-Mean: 126.311, $\log_2$ Fold Change: –0.160, p-value: 7.76E-09, padj: 1.25E-04) was observed to change linearly with autolysis time. Additional genes, such as FosB Proto-Onco-gene, AP-1 Transcription Factor Subunit (FosB) (p-adj=3.51E-12), were observed to have increased expression with intermediate autolysis times in all 3 cell types (FIG. 10).

Example 19

Determining Effects of Gender on Human Cell-Type Specific Gene Expression

To examine the effect of gender on the expression profile, gene expression was compared among samples from males and females to identify genes that are differentially expressed (adjusted p-value<0.01, baseMean>50). As expected, a majority of gender-specific genes identified herein resided on the X or Y chromosomes, with expression of X-chromosome genes enriched in female samples and Y-chromosome genes enriched in male samples. Twenty-seven genes exhibiting gender specific differential expression (adjusted p-value<0.01, baseMean>50) in males compared to females are shown in Table 43.

TABLE 43

Genes exhibiting gender specific differential expression

| Gene | baseMean | log2 Fold Change | p-value | p-adj |
|------|----------|------------------|---------|-------|
| KDM5D | 920.33 | 9.42 | 0 | 0 |
| RPS4Y1 | 252.82 | 9.37 | 5.16E−198 | 1.01E−194 |
| ZFY | 329.53 | 8.81 | 0 | 0 |
| DDX3Y | 187.3 | 8.67 | 2.67E−152 | 4.82E−149 |
| TTTY15 | 213.46 | 8.33 | 1.07E−234 | 2.57E−231 |
| TTTY14 | 6136.13 | 8.05 | 0 | 0 |
| USP9Y | 1725.45 | 7.99 | 0 | 0 |
| UTY | 3612.95 | 7.89 | 0 | 0 |
| GYG2P1 | 65.6 | 7.28 | 6.25E−26 | 7.51E−23 |
| NLGN4Y | 4612.32 | 7.19 | 0 | 0 |
| TXLNGY | 383.6 | 7.1 | 3.04E−258 | 8.23E−255 |

TABLE 43-continued

Genes exhibiting gender specific differential expression

| Gene | baseMean | log2 Fold Change | p-value | p-adj |
|------|----------|------------------|---------|-------|
| LINC00278 | 342.2 | 6.37 | 3.61E−28 | 4.59E−25 |
| PRKY | 87.03 | 4.71 | 1.26E−29 | 1.81E−26 |
| TTY10 | 547.65 | 4.57 | 9.79E−233 | 2.12E−229 |
| ZFX | 1438.28 | −0.54 | 5.98E−06 | 4.17E−03 |
| PUDP | 502.81 | −0.57 | 4.51E−11 | 4.64E−08 |
| KDM5C | 726.02 | −0.66 | 1.44E−11 | 1.56E−08 |
| LOC389906 | 288.35 | −0.68 | 4.34E−09 | 4.09E−06 |
| PIN4 | 334.45 | −0.73 | 2.61E−08 | 2.35E−05 |
| MTRNR2L8 | 621.81 | −1.78 | 2.21E−07 | 1.77E−04 |
| MTRNR2L6 | 123.59 | −1.78 | 8.09E−07 | 6.03E−04 |
| COL4A1 | 51.32 | −1.83 | 1.63E−07 | 1.36E−04 |
| DHFR | 699.43 | −1.91 | 5.75E−07 | 4.44E−04 |
| LOC101929541 | 63.31 | −2.02 | 1.78E−10 | 1.75E−07 |
| TSIX | 60.52 | −3.88 | 3.49E−28 | 4.59E−25 |
| MIR6723 | 603.22 | −5.15 | 3.27E−14 | 3.73E−11 |
| XIST | 20369.6 | −10.61 | 0 | 0 |

Seven of these genes are located on the X chromosome, 14 are on Y, and 6 are on autosomes. In some cases, gender-specific genes can be more differentially expressed in some cell types than in others. For example, Long Intergenic Non-Protein Coding RNA 278 (LINC00278) was observed to be male-enriched, and was even more differentially expressed in glia than in granule or basket cells. Further, expression of Protein Kinase, Y-Linked, Pseudo-gene (Prky) was observed to be highest in granule cells, at intermediate levels in glia, and low in basket cells.

In contrast, Glycogenin 2 Pseudogene 1 (GYG2P1) was identified as a male-enriched gene across all samples (p=3.74E-42), although it was more male-enriched in basket cells than granule cells and glia. This is not due to mis-mapped reads from duplication because Glycogenin 2 (GYG2) was significantly expressed only in glia and does not exhibit gender-specific expression. Examination of the Y chromosome locus containing GYG2P1 revealed male-specific basket cell expression across a large region, including GYG2P1 and approximately 300kb downstream. The nearby genes testis-specific transcript Y 15 (Ttty15) and Ubiquitin Specific Peptidase 9, Y-Linked (Usp9y) were also male-enriched but were not observed to be cell type specific in results form glia, basket, and granule cells. Additionally, Y-Linked Zinc Finger Protein (Zfy) and KDM5D were also observed to be male-enriched but not cell-type specific, and XIST was observed to be female-enriched in Table 43 but not cell-type specific among glia, basket, and granule cells. Genes that exhibit gender and cell-type specific expression in both glia and granule cells were also evident. Results herein provide a potential source of sexually dimorphic, cell specific function in the mammalian brain.

Transcription was observed only in males and only in stellate/basket cells for genes: Family With Sequence Similarity 8 Member A4, Pseudogene (Fam8a4p), Arylsulfatase D Pseudogene 1 (Arsdp1), and Gyg2p1.

Therefore, gender specific gene expression was observed to confirm the known gender of the individual, and cell-type specific gender-specific gene expression was also observed.

Example 20

Determining Effects of Age on Human Cell-Type Specific Gene Expression

A fundamental question in aging research is whether aging occurs uniformly across the brain, or whether some cell types are more susceptible to the effects of aging than others. To address this issue, the effects of age on gene expression in each of the three cerebellar cell types was examined. DESeq2 (Love, et al. (2014) Genome Biology 15, 550, which is hereby incorporated by reference herein in its entirety) was used as described in Example 1 to identify genes that were differentially expressed (adjusted p<0.01, fold change>2) with age in all samples, or specifically in granule cells, basket cells, or glia. Two hundred seventy-four genes with differential expression were identified in granule cells, 139 in basket cells, 31 in glia, and 42 across all samples regardless of cell type.

The RNAseq results for the 274 genes in granule cells with significantly altered expression with age are shown in Table 44. The log 2 fold change for the sorted nuclei from granule cells from each human sample compared to the normalized expression of sorted nuclei from granule cells from all samples are shown in Table 44. Negative values indicate reduced expression in the nuclei of the subject compared to the normalized value across nuclei from all samples, and a positive value indicates increased expression compared to the normalized value across nuclei from all cell types analyzed.

TABLE 44

| Log2 fold change of expression for genes in granule cells | | | | | | | | | | | | | | | |
| --- | --- | --- | --- | --- | --- | --- | --- | --- | --- | --- | --- | --- | --- | --- | --- |
| | Log2 fold change of expression Subject | | | | | | | | | | | | | | |
| Gene | xk | tm | wo | wc | wi | pk | vm | wl | sg | or | lt | zh | ko | kq | ke | ai |
| KCNQ3 | 0.51 | 0.04 | 1.63 | 1.08 | 2.20 | 0.45 | 0.22 | −1.07 | −0.86 | −0.27 | 0.32 | 0.38 | −1.32 | −1.06 | −1.25 | −1.02 |
| SCHLAP1 | 2.39 | 0.66 | 0.21 | 1.22 | −0.53 | 1.63 | 0.58 | −0.67 | −0.78 | −0.87 | −0.21 | −0.55 | −0.97 | −0.72 | −0.89 | −0.47 |
| UGGT2 | 2.15 | 1.34 | 0.92 | 1.19 | 0.12 | 0.86 | −0.14 | −0.04 | −1.01 | −1.41 | −0.32 | 0.71 | −1.06 | −1.64 | −1.41 | −0.25 |
| PLXDC2 | 2.02 | 0.67 | 0.77 | 0.92 | −0.86 | 0.60 | 1.26 | −0.08 | −1.01 | −0.90 | −0.78 | 0.34 | −0.29 | −0.98 | −1.05 | −0.63 |
| ITGB5 | 1.83 | −0.09 | 1.42 | 0.98 | 0.27 | 0.10 | −0.11 | −0.36 | −0.10 | −0.13 | −0.26 | −0.81 | −0.92 | −0.23 | −0.51 | −1.06 |
| DCLK1 | 0.88 | 0.31 | 0.72 | 0.38 | 0.39 | 0.01 | 1.69 | 0.45 | −0.46 | −0.34 | 0.04 | 0.58 | −1.90 | −1.02 | −0.30 | −1.43 |
| AQP7 | 0.63 | 0.60 | 1.17 | 0.67 | 0.65 | −0.14 | −0.57 | 0.49 | 0.06 | −0.17 | 0.16 | −0.08 | −1.01 | −0.89 | −0.54 | −1.03 |
| PTPN3 | 1.18 | 0.53 | 0.69 | 0.75 | −0.01 | 0.44 | 0.43 | −0.14 | 0.01 | −0.57 | 0.14 | 0.10 | −0.69 | −1.22 | −0.31 | −1.31 |
| FAT1 | 1.31 | 0.45 | 0.40 | 0.67 | 0.51 | 0.21 | 1.45 | −0.06 | −1.00 | 0.16 | −1.22 | 0.10 | −1.10 | −1.05 | −0.27 | −0.56 |
| CMTM8 | 0.99 | 1.66 | 1.02 | 0.25 | 0.61 | −0.31 | −0.75 | 0.17 | −0.82 | 0.03 | −0.69 | −0.56 | −0.12 | −0.95 | −0.37 | −0.16 |
| FARP1 | 1.10 | 0.52 | 0.53 | 0.56 | 0.68 | −0.03 | −0.61 | 0.56 | −0.46 | −0.38 | 0.52 | 0.34 | −1.06 | −0.42 | −0.98 | −0.86 |
| PIP4K2A | 0.64 | 0.67 | 0.60 | 0.36 | 0.12 | 0.34 | 0.52 | 0.51 | −0.15 | −0.78 | 0.11 | 0.35 | −0.98 | −1.10 | −0.55 | −0.67 |
| NEDD4 | 0.95 | 0.11 | 0.40 | 0.58 | −0.53 | 0.57 | 0.95 | 0.43 | −0.48 | −0.78 | −0.04 | 0.43 | −0.85 | −0.79 | −0.65 | −0.29 |
| CATSPERG | 0.05 | 0.70 | 1.02 | 1.01 | 0.20 | −0.26 | 0.10 | 0.20 | 0.04 | −0.12 | −0.12 | −0.15 | −1.02 | −0.53 | 0.00 | −1.11 |
| LOC101926941 | 0.36 | 0.43 | 0.77 | 0.90 | −0.07 | −0.69 | 0.25 | 0.66 | −0.05 | −0.36 | −0.32 | 0.76 | −0.76 | −0.81 | 0.05 | −1.12 |
| WWC2 | 1.00 | 0.47 | 0.37 | 0.66 | 0.21 | 0.18 | 0.58 | 0.49 | −0.12 | −0.42 | −0.73 | −0.19 | −1.06 | −0.26 | −1.07 | −0.12 |
| MPP6 | 1.17 | −0.12 | 0.28 | 0.70 | 0.42 | 0.04 | 0.04 | −0.12 | 0.32 | −0.61 | −0.41 | 0.18 | −0.70 | −0.61 | −0.51 | −0.08 |
| SDK1 | 0.04 | 0.64 | 0.81 | 0.34 | 0.56 | 0.33 | 0.35 | 0.05 | 0.16 | −0.25 | −0.37 | 0.40 | −1.45 | −0.71 | −0.74 | −0.17 |
| NAB2 | 0.22 | 0.22 | 0.92 | 0.53 | 0.46 | −0.16 | −0.01 | −0.04 | −0.08 | 0.40 | −0.19 | 0.02 | −0.60 | −0.61 | −0.19 | −0.88 |
| NTNG2 | 0.29 | −0.18 | 1.32 | 0.57 | −0.19 | 0.00 | −0.01 | 0.09 | 0.41 | −0.62 | 0.17 | 0.49 | −0.90 | −0.47 | −0.30 | −0.67 |
| LMNTD2 | 0.36 | 0.86 | 0.48 | 0.36 | 0.34 | 0.07 | −0.20 | 0.05 | −0.01 | 0.10 | −0.21 | −0.44 | −0.89 | −0.41 | 0.11 | −0.57 |
| PLCH2 | 0.24 | 0.83 | 0.78 | 0.81 | 0.23 | −0.24 | −0.36 | 0.02 | −0.35 | 0.41 | −0.10 | −0.47 | −0.55 | 0.04 | −0.30 | −0.98 |
| PTPRJ | 0.33 | 0.30 | 0.90 | 0.55 | 0.38 | −0.18 | 0.28 | −0.06 | −0.01 | −0.23 | −0.07 | 0.46 | −0.84 | −0.79 | −0.15 | −0.88 |
| MRAP2 | 0.48 | 0.58 | 0.41 | 0.12 | 0.22 | 0.29 | 0.56 | 0.24 | −0.47 | −0.17 | 0.18 | 0.39 | −1.09 | −0.84 | −0.34 | −0.55 |
| PTMS | 0.22 | 0.53 | 1.38 | 0.66 | 0.25 | −0.13 | −0.27 | −0.38 | −0.23 | 0.04 | −0.52 | −0.35 | 0.26 | −0.02 | −0.59 | −0.86 |
| CDH23 | 0.24 | 0.28 | 0.91 | 0.63 | 0.24 | 0.03 | 0.14 | −0.05 | −0.30 | 0.26 | −0.19 | 0.20 | −0.83 | −0.79 | −0.20 | −0.56 |
| SYT7 | 0.51 | 0.41 | 0.86 | 0.51 | 0.23 | −0.16 | −0.11 | 0.05 | 0.07 | 0.21 | −0.39 | −0.15 | −0.45 | −0.20 | −0.30 | −1.10 |
| SPRED3 | 0.25 | 0.66 | 0.51 | 0.65 | 0.00 | −0.37 | 0.19 | 0.41 | 0.23 | −0.28 | −0.35 | −0.09 | −0.77 | −0.15 | 0.03 | −0.92 |
| PLXNA1 | 0.05 | 0.18 | 0.98 | 0.67 | 0.54 | −0.49 | −0.16 | 0.03 | −0.17 | 0.12 | −0.15 | 0.23 | −0.46 | −0.35 | −0.28 | −0.74 |
| GRK5 | 0.61 | 0.19 | 0.66 | 0.63 | 0.01 | 0.24 | 0.16 | −0.14 | −0.27 | −0.19 | 0.06 | 0.19 | −0.55 | −0.66 | −0.05 | −0.89 |
| ZYX | 0.28 | 0.07 | 1.28 | 0.86 | 0.09 | −0.14 | −0.37 | −0.05 | −0.08 | −0.02 | −0.22 | −0.33 | −0.34 | −0.71 | −0.06 | −0.25 |
| FGF3 | 0.06 | 0.09 | 0.66 | 0.59 | 0.22 | 0.40 | −0.11 | 0.27 | 0.05 | 0.31 | −0.32 | −0.18 | −0.75 | −0.52 | −0.27 | −0.50 |
| LINC01544 | 0.49 | 0.96 | 0.35 | 0.25 | 0.16 | 0.37 | −0.48 | 0.12 | −0.43 | 0.03 | 0.00 | −0.25 | −0.67 | −0.63 | −0.08 | −0.19 |
| PCYT1B | 0.69 | 0.45 | 0.38 | 0.25 | 0.18 | 0.16 | 0.13 | −0.04 | −0.32 | −0.14 | 0.22 | −0.32 | −0.46 | −0.65 | −0.42 | −0.10 |
| RHBG | 0.72 | 0.33 | 0.42 | 0.34 | 0.12 | 0.01 | −0.04 | 0.14 | 0.05 | 0.67 | −0.03 | −0.49 | −0.70 | −0.53 | 0.00 | −1.02 |
| HCN2 | 0.16 | 0.39 | 1.02 | 0.39 | 0.03 | −0.20 | −0.10 | −0.20 | −0.14 | 0.15 | −0.14 | −0.18 | 0.08 | −0.41 | −0.45 | −0.41 |
| ACAP3 | 0.10 | 0.42 | 0.95 | 0.71 | 0.34 | −0.17 | −0.24 | −0.14 | −0.11 | 0.27 | −0.57 | −0.26 | −0.28 | −0.32 | −0.28 | −0.43 |
| MGAT3 | 0.18 | 0.50 | 0.87 | 0.69 | 0.19 | −0.27 | −0.34 | −0.01 | −0.06 | 0.28 | −0.29 | −0.22 | −0.30 | −0.40 | −0.11 | −0.71 |
| C1orf61 | 0.45 | 0.39 | 0.68 | 0.55 | −0.02 | −0.06 | 0.09 | −0.02 | −0.02 | −0.05 | −0.08 | −0.03 | −0.66 | −0.26 | 0.00 | −0.95 |
| SURF2 | 0.27 | 0.23 | 0.85 | 0.61 | −0.31 | −0.13 | 0.17 | −0.07 | −0.07 | −0.19 | −0.06 | −0.25 | −0.27 | 0.00 | −0.20 | −0.57 |
| AHRR | 0.25 | 0.30 | 0.22 | 0.36 | 0.32 | 0.44 | 0.37 | −0.19 | −0.04 | −0.12 | −0.26 | −0.24 | −0.17 | −0.35 | −0.41 | −0.47 |
| FAM131A | 0.16 | 0.36 | 1.02 | 0.28 | 0.24 | −0.57 | 0.31 | −0.10 | −0.21 | −0.05 | −0.28 | 0.17 | −0.14 | −0.22 | −0.31 | −0.67 |
| CHGB | 0.19 | −0.02 | 0.47 | 0.20 | 0.43 | −0.07 | 1.03 | −0.03 | 0.07 | 0.01 | −0.18 | 0.21 | −0.79 | −0.66 | −0.23 | −0.64 |
| PLXNA4 | 0.19 | 0.13 | 0.43 | 0.46 | 0.62 | 0.03 | 0.00 | 0.14 | −0.04 | 0.12 | 0.06 | 0.41 | −0.93 | −0.37 | −0.17 | −1.09 |
| ACHE | 0.08 | 0.43 | 0.84 | 0.38 | 0.15 | −0.14 | −0.07 | −0.23 | 0.01 | 0.17 | −0.24 | 0.00 | −0.09 | −0.54 | −0.28 | −0.47 |
| DYRK1B | 0.26 | 0.44 | 0.83 | 0.77 | −0.06 | −0.13 | −0.22 | −0.16 | −0.10 | 0.07 | −0.27 | −0.53 | −0.03 | −0.18 | −0.25 | −0.43 |
| CDK5R2 | 0.03 | 0.15 | 1.04 | 0.36 | 0.10 | 0.15 | 0.17 | −0.12 | 0.15 | −0.18 | −0.34 | −0.17 | −0.32 | −0.32 | −0.06 | −0.64 |
| GDPD5 | 0.24 | 0.45 | 0.68 | 0.55 | −0.10 | −0.34 | 0.09 | 0.11 | −0.04 | 0.23 | −0.14 | 0.08 | −0.38 | −0.45 | −0.18 | −0.80 |
| ZNF703 | 0.07 | 0.22 | 0.80 | 0.57 | −0.09 | 0.21 | −0.08 | 0.01 | −0.12 | −0.09 | −0.30 | −0.10 | −0.13 | −0.07 | −0.15 | −0.75 |
| FHDC1 | 0.53 | 0.00 | 0.64 | 0.36 | 0.08 | −0.11 | 0.30 | 0.08 | −0.50 | −0.01 | 0.00 | 0.59 | −0.91 | −0.23 | −0.42 | −0.41 |
| LOC101927078 | 0.34 | 0.54 | 0.31 | 0.85 | −0.03 | −0.08 | −0.09 | −0.35 | −0.13 | −0.27 | −0.01 | 0.20 | −0.56 | −0.14 | −0.38 | −0.23 |
| CREB3L2 | 0.24 | −0.02 | 0.95 | 0.11 | 0.32 | 0.02 | 0.16 | −0.17 | −0.03 | −0.14 | 0.25 | 0.31 | −0.52 | −0.71 | −0.07 | −0.70 |
| AP1S3 | 0.52 | −0.18 | 0.80 | 0.14 | −0.01 | 0.10 | 0.30 | −0.06 | 0.16 | −0.01 | 0.12 | 0.12 | −0.55 | −0.52 | −0.21 | −0.72 |
| DYSF | 0.89 | −0.42 | 0.48 | 0.55 | −0.39 | 0.22 | 0.17 | 0.23 | −0.29 | −0.15 | 0.04 | 0.30 | −0.59 | −0.60 | −0.15 | −0.31 |
| MAMSTR | 0.27 | 0.73 | 0.47 | 0.26 | 0.00 | 0.05 | −0.30 | 0.16 | −0.15 | −0.08 | −0.34 | −0.05 | −0.07 | −0.26 | 0.04 | −0.72 |
| KIAA0895L | 0.42 | 0.24 | 0.40 | 0.64 | 0.17 | −0.04 | 0.10 | 0.00 | −0.03 | 0.16 | −0.32 | 0.03 | −0.24 | −0.46 | −0.14 | −0.93 |
| TP73 | 0.13 | 0.13 | 0.95 | 0.38 | −0.06 | 0.41 | −0.08 | 0.03 | −0.30 | −0.15 | 0.01 | −0.14 | −0.34 | −0.21 | −0.09 | −0.68 |

TABLE 44-continued

Log2 fold change of expression for genes in granule cells

| Gene | Log2 fold change of expression Subject | | | | | | | | | | | | | | | |
|---|---|---|---|---|---|---|---|---|---|---|---|---|---|---|---|---|
| | xk | tm | wo | wc | wi | pk | vm | wl | sg | or | lt | zh | ko | kq | ke | ai |
| PDE3A | 0.44 | 0.42 | 0.05 | 0.04 | 0.30 | 0.00 | 0.66 | 0.36 | −0.10 | −0.42 | 0.01 | 0.43 | −0.84 | −0.78 | −0.11 | −0.44 |
| LINC00963 | −0.16 | 0.27 | 0.54 | 0.52 | 0.11 | 0.11 | 0.03 | −0.06 | −0.19 | 0.17 | −0.06 | −0.01 | −0.39 | −0.05 | −0.37 | −0.46 |
| ELAVL3 | 0.11 | 0.34 | 0.94 | 0.56 | −0.04 | −0.02 | −0.17 | −0.17 | −0.12 | 0.11 | −0.16 | −0.14 | −0.13 | −0.20 | −0.20 | −0.70 |
| TTYH3 | 0.19 | 0.49 | 0.69 | 0.53 | 0.09 | −0.18 | −0.33 | −0.09 | 0.03 | 0.47 | −0.28 | −0.12 | −0.13 | −0.15 | −0.28 | −0.91 |
| HPN | 0.30 | 0.29 | 0.64 | 0.49 | 0.16 | −0.14 | −0.25 | −0.21 | −0.15 | 0.20 | −0.05 | −0.16 | −0.51 | 0.09 | −0.13 | −0.58 |
| PTPRE | 0.41 | 0.45 | 0.27 | 0.46 | 0.15 | 0.08 | 0.00 | −0.04 | −0.11 | −0.13 | −0.09 | 0.14 | −0.58 | −0.35 | −0.15 | −0.50 |
| SLC17A7 | 0.32 | 0.32 | 0.47 | −0.02 | 0.31 | 0.20 | 0.17 | 0.10 | 0.20 | 0.20 | −0.22 | 0.01 | −0.41 | −0.55 | 0.00 | −1.08 |
| GRIN2C | 0.16 | 0.46 | 0.81 | 0.58 | 0.17 | −0.37 | −0.25 | 0.02 | −0.20 | 0.24 | −0.31 | −0.18 | −0.10 | −0.32 | −0.15 | −0.53 |
| PXN | 0.34 | 0.61 | 0.47 | 0.38 | −0.19 | 0.16 | −0.17 | 0.07 | −0.06 | 0.14 | −0.18 | −0.33 | −0.18 | −0.30 | 0.02 | −0.80 |
| TMEM130 | 0.37 | 0.19 | 0.81 | 0.46 | −0.19 | 0.07 | −0.04 | 0.00 | −0.10 | 0.12 | −0.09 | −0.47 | −0.26 | −0.22 | −0.17 | −0.47 |
| LRPAP1 | 0.23 | 0.35 | 0.95 | 0.36 | −0.03 | −0.12 | −0.39 | −0.11 | −0.04 | 0.21 | 0.01 | −0.15 | −0.13 | −0.21 | −0.16 | −0.78 |
| GRM4 | 0.02 | 0.14 | 0.97 | 0.57 | 0.02 | 0.24 | −0.15 | −0.28 | −0.17 | −0.07 | −0.07 | 0.05 | −0.43 | −0.30 | −0.29 | −0.25 |
| STEAP3 | 0.37 | 0.66 | 0.39 | 0.44 | −0.34 | 0.04 | −0.05 | 0.23 | −0.28 | 0.18 | −0.06 | −0.51 | −0.37 | −0.38 | 0.00 | −0.33 |
| CHRD | 0.60 | −0.17 | 0.64 | 0.61 | 0.04 | −0.03 | −0.15 | −0.05 | −0.16 | 0.18 | −0.17 | −0.27 | −0.15 | −0.33 | −0.11 | −0.48 |
| SBNO2 | 0.02 | 0.15 | 0.85 | 0.43 | 0.09 | 0.10 | −0.05 | −0.23 | −0.21 | 0.12 | −0.23 | −0.11 | −0.10 | −0.16 | −0.36 | −0.31 |
| ZDHHC23 | 0.33 | −0.17 | 0.44 | 0.16 | 0.50 | 0.07 | −0.06 | 0.40 | 0.00 | 0.05 | −0.36 | 0.22 | −0.48 | −0.44 | −0.10 | −0.55 |
| GACAT2 | 0.53 | 0.55 | 0.04 | 0.33 | −0.26 | 0.04 | 0.24 | 0.12 | 0.05 | −0.11 | 0.26 | −0.43 | −0.19 | −0.43 | −0.28 | −0.45 |
| MAP6D1 | 0.26 | −0.01 | 0.80 | 0.50 | −0.02 | −0.08 | −0.17 | 0.12 | 0.06 | 0.24 | −0.07 | −0.25 | −0.30 | −0.32 | −0.07 | −0.69 |
| FAM53A | 0.50 | 0.11 | 0.61 | 0.10 | 0.10 | −0.43 | 0.10 | 0.17 | −0.21 | −0.07 | −0.02 | 0.17 | −0.27 | −0.30 | −0.21 | −0.35 |
| KIAA1549L | 0.47 | 0.45 | −0.04 | 0.02 | 0.05 | 0.40 | 0.46 | 0.18 | −0.11 | −0.26 | 0.11 | −0.08 | −0.76 | −0.26 | −0.02 | −0.61 |
| SLC38A7 | 0.18 | 0.50 | 0.45 | 0.33 | 0.14 | −0.20 | −0.24 | 0.05 | 0.04 | 0.42 | −0.15 | −0.29 | −0.44 | −0.06 | −0.28 | −0.46 |
| CDK16 | 0.09 | 0.26 | 0.73 | 0.73 | −0.04 | −0.30 | −0.01 | −0.10 | −0.15 | 0.08 | −0.15 | −0.07 | −0.26 | −0.24 | −0.17 | −0.40 |
| CALY | 0.00 | 0.45 | 0.50 | 0.12 | 0.63 | −0.06 | −0.13 | 0.03 | 0.02 | 0.07 | −0.13 | 0.04 | −0.38 | −0.38 | 0.00 | −0.78 |
| LPCAT4 | 0.39 | 0.14 | 0.74 | 0.74 | −0.10 | −0.07 | −0.26 | −0.06 | −0.01 | −0.05 | −0.22 | −0.42 | 0.14 | −0.35 | −0.10 | −0.53 |
| SLC25A6 | 0.40 | 0.43 | 0.41 | 0.48 | 0.14 | −0.43 | 0.09 | −0.02 | −0.17 | 0.25 | −0.33 | −0.35 | −0.20 | 0.02 | −0.19 | −0.51 |
| SRCIN1 | 0.24 | 0.42 | 0.65 | 0.48 | 0.02 | −0.06 | −0.24 | 0.00 | −0.12 | 0.21 | −0.18 | −0.27 | −0.17 | −0.20 | −0.16 | −0.60 |
| ELMO1 | 0.37 | 0.35 | 0.10 | 0.07 | 0.46 | 0.19 | 0.34 | −0.01 | −0.11 | −0.34 | −0.02 | 0.31 | −0.68 | −0.33 | −0.17 | −0.53 |
| GRAMD4 | 0.02 | 0.44 | 0.48 | 0.35 | 0.18 | −0.21 | 0.00 | 0.03 | 0.06 | −0.01 | −0.05 | 0.12 | −0.44 | −0.54 | −0.09 | −0.32 |
| RIMS3 | 0.16 | 0.28 | 0.58 | 0.21 | 0.10 | −0.33 | 0.33 | 0.20 | −0.17 | 0.20 | −0.09 | 0.09 | −0.19 | −0.35 | −0.17 | −0.84 |
| CPLX2 | 0.11 | 0.42 | 0.78 | 0.42 | 0.18 | −0.21 | −0.14 | −0.03 | −0.22 | 0.01 | −0.16 | −0.09 | −0.42 | −0.04 | −0.23 | −0.37 |
| PIP5K1C | 0.21 | 0.41 | 0.75 | 0.34 | 0.24 | −0.24 | −0.28 | −0.04 | −0.17 | 0.18 | −0.33 | 0.11 | −0.07 | −0.10 | −0.23 | −0.76 |
| SDC3 | 0.15 | 0.14 | 0.42 | 0.38 | 0.26 | 0.16 | −0.02 | −0.02 | 0.22 | 0.34 | −0.17 | −0.34 | −0.47 | −0.35 | −0.04 | −0.65 |
| CBLN3 | 0.48 | 0.06 | 0.50 | 0.32 | 0.05 | −0.13 | −0.02 | 0.19 | 0.09 | 0.37 | −0.03 | −0.18 | −0.43 | −0.66 | 0.01 | −0.62 |
| PDZD7 | 0.32 | 0.60 | 0.39 | 0.21 | −0.12 | 0.05 | −0.28 | −0.01 | 0.20 | 0.24 | −0.03 | −0.09 | −0.22 | −0.45 | −0.02 | −0.78 |
| VWA5B2 | 0.24 | 0.65 | 0.41 | 0.38 | 0.10 | −0.22 | −0.12 | 0.14 | −0.21 | 0.13 | −0.52 | −0.19 | −0.07 | −0.16 | 0.00 | −0.57 |
| ZNF219 | 0.27 | 0.62 | 0.59 | 0.16 | 0.10 | −0.18 | −0.31 | 0.10 | −0.07 | −0.04 | −0.34 | 0.06 | 0.03 | −0.35 | −0.07 | −0.57 |
| FAM212B | 0.46 | 0.38 | 0.49 | 0.45 | −0.02 | −0.07 | −0.20 | 0.00 | −0.43 | −0.11 | −0.27 | 0.05 | 0.01 | −0.05 | −0.13 | −0.56 |
| RASIP1 | 0.19 | 0.27 | 0.53 | 0.10 | 0.08 | 0.09 | −0.13 | 0.11 | −0.16 | 0.22 | −0.12 | −0.01 | −0.46 | −0.22 | −0.06 | −0.43 |
| GYS1 | 0.04 | 0.28 | 0.72 | 0.39 | 0.23 | −0.39 | 0.24 | −0.13 | −0.11 | −0.06 | −0.31 | 0.17 | −0.15 | −0.19 | −0.22 | −0.52 |
| ATP6V0B | 0.49 | −0.23 | 0.43 | 0.39 | 0.31 | −0.09 | −0.06 | 0.02 | −0.04 | 0.15 | 0.07 | −0.04 | −0.09 | −0.66 | −0.15 | −0.50 |
| NKD1 | 0.42 | 0.56 | 0.36 | 0.59 | −0.35 | −0.32 | 0.03 | −0.11 | 0.04 | −0.05 | 0.07 | −0.31 | −0.16 | −0.25 | 0.05 | −0.55 |
| ST3GAL2 | 0.24 | 0.34 | 0.60 | 0.38 | 0.15 | −0.03 | −0.35 | −0.03 | 0.00 | 0.22 | −0.15 | −0.23 | −0.06 | −0.33 | −0.13 | −0.62 |
| PTK7 | 0.30 | 0.30 | 0.25 | 0.57 | −0.13 | 0.03 | −0.05 | 0.08 | −0.03 | −0.07 | −0.08 | −0.15 | −0.17 | −0.18 | 0.06 | −0.74 |
| ACOT7 | 0.16 | 0.45 | 0.66 | 0.42 | 0.08 | −0.37 | −0.24 | −0.05 | −0.03 | 0.19 | −0.11 | −0.09 | −0.17 | −0.20 | −0.06 | −0.66 |
| ATXN7L2 | 0.11 | 0.45 | 0.53 | 0.34 | 0.17 | −0.22 | −0.14 | 0.01 | −0.07 | 0.19 | −0.26 | −0.26 | −0.17 | −0.28 | 0.05 | −0.43 |
| DAO | 0.06 | 0.47 | 0.43 | 0.09 | 0.10 | 0.10 | 0.23 | 0.01 | 0.17 | −0.26 | −0.21 | 0.19 | −0.32 | −0.46 | −0.19 | −0.40 |
| SYT12 | 0.36 | 0.38 | 0.28 | 0.41 | 0.03 | −0.30 | −0.12 | 0.13 | 0.12 | 0.32 | −0.14 | −0.12 | −0.29 | −0.16 | −0.16 | −0.75 |
| ADAM19 | 0.02 | 0.32 | 0.46 | 0.42 | 0.35 | −0.10 | −0.02 | −0.19 | −0.12 | −0.04 | 0.01 | 0.25 | −0.16 | −0.55 | −0.18 | −0.47 |
| HIP1 | 0.03 | 0.12 | 0.79 | 0.54 | −0.03 | 0.19 | −0.13 | −0.32 | −0.11 | −0.09 | −0.03 | 0.02 | −0.11 | −0.33 | −0.25 | −0.28 |
| GABBR1 | 0.19 | 0.10 | 0.68 | 0.40 | 0.06 | 0.00 | −0.04 | −0.02 | −0.02 | 0.00 | −0.20 | −0.11 | −0.09 | −0.35 | −0.09 | −0.52 |
| SYT3 | 0.29 | 0.00 | 0.57 | 0.40 | −0.01 | 0.10 | 0.20 | −0.07 | 0.07 | −0.16 | −0.28 | −0.14 | −0.02 | −0.35 | −0.06 | −0.54 |
| TP53INP2 | 0.24 | 0.21 | 0.33 | 0.08 | 0.25 | −0.24 | 0.37 | −0.09 | 0.00 | −0.07 | −0.04 | 0.25 | −0.28 | −0.15 | −0.30 | −0.58 |
| KCNK3 | 0.15 | 0.46 | 0.47 | 0.48 | 0.04 | −0.18 | −0.16 | 0.10 | −0.11 | 0.00 | −0.39 | 0.03 | −0.22 | 0.02 | −0.08 | −0.61 |
| TPM4 | 0.16 | 0.16 | 0.52 | 0.32 | 0.15 | 0.16 | −0.15 | 0.02 | 0.01 | 0.02 | −0.09 | −0.01 | −0.32 | −0.27 | −0.19 | −0.48 |
| RNF152 | 0.39 | 0.43 | 0.13 | 0.06 | 0.18 | 0.24 | −0.04 | 0.10 | −0.05 | −0.10 | −0.04 | 0.02 | −0.35 | −0.56 | 0.09 | −0.51 |
| KCNK10 | 0.59 | 0.38 | 0.08 | 0.38 | −0.42 | −0.02 | −0.02 | 0.35 | −0.20 | −0.03 | 0.01 | −0.07 | −0.34 | −0.35 | 0.09 | −0.43 |
| EPB41L1 | 0.40 | 0.39 | 0.26 | 0.09 | −0.02 | 0.10 | 0.06 | 0.10 | 0.03 | 0.14 | −0.01 | −0.31 | −0.14 | −0.31 | −0.09 | −0.69 |
| ABCC10 | 0.23 | 0.31 | 0.45 | 0.35 | 0.07 | −0.37 | 0.05 | 0.13 | −0.07 | 0.29 | −0.44 | −0.09 | −0.10 | −0.11 | −0.23 | −0.46 |
| NAV2 | 0.25 | 0.37 | 0.44 | 0.10 | 0.08 | 0.00 | 0.03 | 0.16 | −0.08 | −0.16 | 0.00 | 0.01 | −0.50 | −0.21 | −0.01 | −0.48 |
| ERGIC1 | 0.12 | 0.40 | 0.54 | 0.40 | 0.11 | −0.25 | −0.14 | −0.03 | −0.11 | 0.07 | −0.06 | 0.00 | −0.03 | −0.25 | −0.07 | −0.72 |
| BAD | 0.23 | 0.46 | 0.42 | 0.32 | −0.01 | −0.23 | −0.21 | 0.12 | −0.15 | 0.21 | −0.11 | −0.20 | 0.00 | −0.12 | −0.19 | −0.53 |
| KIF3B | 0.12 | 0.14 | 0.45 | 0.18 | −0.05 | 0.39 | 0.01 | 0.04 | −0.01 | 0.06 | 0.04 | 0.04 | −0.24 | −0.42 | −0.15 | −0.60 |
| RAI2 | 0.43 | 0.39 | 0.26 | 0.17 | −0.04 | 0.00 | 0.16 | 0.15 | −0.22 | −0.40 | −0.07 | 0.20 | −0.47 | −0.28 | 0.05 | −0.33 |
| XKR7 | 0.11 | 0.37 | 0.52 | 0.34 | 0.13 | 0.25 | −0.13 | −0.11 | −0.01 | −0.25 | −0.27 | −0.21 | −0.20 | −0.04 | −0.06 | −0.45 |
| PTK2B | 0.14 | 0.27 | 0.50 | 0.19 | 0.17 | −0.01 | 0.00 | 0.02 | −0.05 | 0.04 | 0.02 | −0.04 | −0.38 | −0.39 | −0.05 | −0.46 |
| CHST12 | 0.07 | 0.50 | 0.46 | 0.36 | 0.02 | −0.22 | 0.16 | −0.17 | −0.31 | −0.11 | −0.04 | 0.14 | −0.24 | −0.02 | −0.17 | −0.43 |
| TRIM67 | 0.59 | 0.35 | 0.20 | 0.28 | 0.04 | 0.09 | −0.16 | −0.14 | 0.12 | −0.06 | −0.29 | −0.11 | −0.19 | −0.29 | 0.03 | −0.45 |
| DHDDS | 0.45 | 0.08 | 0.33 | 0.18 | −0.05 | 0.22 | −0.01 | 0.10 | 0.02 | 0.16 | −0.02 | −0.20 | −0.38 | −0.16 | −0.08 | −0.64 |
| NUMBL | 0.17 | 0.49 | 0.52 | 0.13 | −0.13 | 0.36 | −0.14 | 0.07 | −0.02 | −0.11 | −0.44 | −0.20 | −0.23 | 0.01 | −0.24 | −0.25 |
| KCND3 | 0.24 | 0.45 | 0.21 | 0.17 | 0.07 | 0.09 | −0.04 | 0.16 | −0.13 | −0.03 | −0.12 | 0.10 | −0.49 | −0.19 | −0.08 | −0.42 |
| LRRC1 | 0.41 | 0.30 | 0.19 | 0.08 | 0.33 | 0.08 | 0.03 | −0.01 | −0.43 | −0.17 | −0.09 | 0.32 | −0.03 | −0.37 | −0.38 | −0.27 |
| RAB37 | 0.27 | 0.24 | 0.64 | 0.15 | 0.16 | 0.03 | −0.16 | −0.10 | −0.07 | −0.11 | −0.14 | −0.01 | −0.16 | −0.35 | −0.15 | −0.23 |
| KCNIP2 | 0.23 | 0.34 | 0.59 | 0.39 | −0.01 | 0.00 | −0.22 | −0.10 | 0.01 | −0.11 | −0.31 | −0.22 | −0.06 | −0.17 | −0.04 | −0.32 |

TABLE 44-continued

Log2 fold change of expression for genes in granule cells

|  | Log2 fold change of expression Subject | | | | | | | | | | | | | | | |
| Gene | xk | tm | wo | wc | wi | pk | vm | wl | sg | or | lt | zh | ko | kq | ke | ai |
| --- | --- | --- | --- | --- | --- | --- | --- | --- | --- | --- | --- | --- | --- | --- | --- | --- |
| RAB6B | 0.22 | 0.13 | 0.48 | 0.38 | 0.09 | −0.16 | −0.07 | −0.07 | 0.03 | 0.05 | −0.08 | 0.11 | −0.31 | −0.34 | −0.15 | −0.32 |
| PC | 0.10 | 0.36 | 0.51 | 0.31 | 0.09 | −0.38 | −0.14 | 0.13 | −0.01 | 0.17 | −0.05 | −0.03 | −0.12 | −0.35 | −0.09 | −0.48 |
| TCEAL2 | −0.10 | 0.21 | 0.50 | 0.12 | 0.34 | 0.04 | 0.29 | 0.08 | −0.25 | −0.14 | −0.13 | 0.00 | −0.20 | −0.13 | −0.50 | −0.14 |
| MEG8 | 0.33 | 0.19 | 0.39 | 0.27 | 0.01 | −0.13 | −0.04 | 0.10 | 0.10 | 0.16 | −0.07 | −0.17 | −0.29 | −0.16 | −0.01 | −0.67 |
| FMNL3 | 0.12 | 0.15 | 0.50 | 0.38 | 0.14 | −0.39 | 0.15 | 0.05 | −0.12 | −0.01 | 0.01 | 0.06 | −0.14 | −0.35 | −0.05 | −0.48 |
| MAPK4 | 0.49 | 0.38 | 0.05 | 0.15 | 0.10 | −0.03 | −0.11 | 0.06 | −0.03 | 0.12 | −0.14 | 0.09 | −0.31 | −0.31 | −0.19 | −0.31 |
| DGCR5 | 0.12 | 0.24 | 0.29 | 0.20 | 0.21 | 0.00 | 0.01 | 0.05 | 0.03 | −0.04 | −0.12 | 0.32 | −0.42 | −0.17 | −0.24 | −0.50 |
| REEP1 | 0.30 | 0.22 | 0.41 | 0.22 | 0.05 | −0.06 | −0.14 | −0.01 | 0.11 | −0.05 | 0.04 | 0.02 | −0.29 | −0.36 | 0.05 | −0.50 |
| GTPBP2 | 0.26 | 0.29 | 0.30 | 0.30 | 0.17 | −0.11 | 0.09 | −0.07 | −0.02 | 0.04 | −0.30 | −0.23 | −0.09 | 0.00 | −0.02 | −0.60 |
| KIF26B | 0.39 | 0.19 | −0.03 | 0.29 | 0.03 | 0.09 | 0.13 | 0.23 | −0.22 | −0.08 | 0.07 | 0.04 | −0.53 | −0.04 | −0.10 | −0.46 |
| NRXN2 | 0.13 | 0.39 | 0.51 | 0.27 | 0.08 | −0.10 | −0.22 | 0.00 | −0.04 | 0.08 | −0.26 | −0.14 | −0.08 | −0.23 | −0.03 | −0.37 |
| ZNRF1 | 0.16 | 0.20 | 0.31 | 0.24 | 0.13 | −0.12 | 0.03 | 0.15 | −0.02 | −0.05 | −0.16 | 0.27 | −0.29 | −0.42 | −0.01 | −0.43 |
| C14orf132 | 0.20 | 0.33 | 0.43 | 0.29 | 0.06 | −0.15 | −0.35 | 0.12 | −0.03 | 0.13 | −0.09 | −0.12 | −0.18 | −0.11 | −0.11 | −0.42 |
| FLNB | 0.43 | 0.34 | 0.08 | 0.14 | 0.04 | 0.10 | −0.07 | −0.01 | −0.13 | −0.18 | 0.15 | 0.09 | −0.24 | −0.23 | −0.03 | −0.47 |
| EFR3B | 0.22 | 0.26 | 0.28 | 0.21 | 0.11 | −0.15 | 0.10 | 0.02 | −0.08 | 0.10 | −0.15 | 0.13 | −0.23 | −0.20 | −0.01 | −0.60 |
| RBFOX3 | 0.01 | 0.42 | 0.32 | 0.20 | 0.17 | 0.05 | −0.03 | −0.05 | −0.12 | 0.09 | −0.20 | 0.03 | −0.35 | −0.05 | −0.11 | −0.38 |
| PPP2R2C | 0.17 | 0.47 | 0.30 | 0.40 | 0.01 | −0.28 | −0.06 | −0.01 | −0.24 | 0.00 | −0.22 | 0.08 | −0.28 | −0.15 | 0.01 | −0.21 |
| KLHDC4 | 0.19 | 0.38 | 0.35 | 0.34 | 0.16 | −0.09 | −0.09 | −0.15 | −0.20 | 0.11 | −0.14 | −0.30 | −0.13 | −0.03 | −0.30 | −0.11 |
| PILRA | 0.20 | 0.34 | 0.30 | 0.07 | 0.03 | 0.06 | −0.03 | 0.21 | 0.15 | −0.02 | −0.03 | −0.35 | −0.44 | −0.16 | 0.08 | −0.39 |
| CLSTN3 | 0.13 | 0.01 | 0.46 | 0.39 | −0.10 | 0.07 | 0.11 | −0.08 | −0.17 | 0.05 | −0.10 | 0.09 | −0.12 | −0.35 | −0.11 | −0.27 |
| CABIN1 | 0.11 | 0.19 | 0.43 | 0.24 | −0.01 | −0.05 | −0.10 | 0.07 | 0.07 | 0.18 | 0.06 | −0.16 | −0.24 | −0.45 | −0.01 | −0.34 |
| NHSL2 | 0.23 | 0.36 | 0.11 | 0.13 | 0.04 | 0.11 | 0.03 | 0.07 | −0.05 | −0.09 | −0.03 | −0.01 | −0.34 | −0.22 | 0.06 | −0.41 |
| LYRM1 | 0.13 | 0.30 | 0.32 | 0.37 | 0.12 | −0.20 | −0.07 | −0.11 | 0.01 | 0.08 | −0.02 | −0.22 | −0.21 | −0.29 | −0.15 | −0.05 |
| KCNA2 | 0.39 | 0.03 | 0.24 | 0.10 | −0.05 | 0.04 | −0.03 | 0.25 | 0.12 | 0.08 | −0.15 | −0.07 | −0.13 | −0.13 | −0.13 | −0.56 |
| SLC38A10 | 0.17 | 0.32 | 0.40 | 0.24 | 0.09 | −0.10 | 0.01 | −0.14 | −0.17 | 0.01 | −0.22 | −0.14 | −0.03 | −0.04 | −0.14 | −0.25 |
| DGKA | 0.25 | 0.26 | 0.19 | 0.31 | −0.13 | −0.07 | 0.20 | 0.05 | −0.11 | 0.01 | −0.20 | −0.11 | −0.31 | −0.05 | −0.02 | −0.27 |
| TMEM266 | 0.14 | 0.26 | 0.25 | 0.40 | −0.04 | −0.04 | −0.24 | 0.12 | 0.04 | 0.03 | −0.04 | −0.08 | −0.32 | −0.17 | −0.05 | −0.25 |
| FAM135B | 0.31 | 0.05 | 0.12 | 0.30 | 0.20 | 0.00 | 0.11 | −0.06 | −0.15 | −0.10 | 0.04 | 0.08 | −0.33 | −0.27 | −0.10 | −0.18 |
| ATP2B2 | 0.31 | 0.24 | 0.30 | 0.15 | 0.18 | −0.14 | −0.17 | 0.01 | −0.02 | 0.11 | −0.23 | −0.01 | −0.23 | −0.01 | −0.11 | −0.38 |
| TMEM163 | 0.15 | 0.08 | 0.27 | 0.18 | 0.16 | 0.06 | 0.15 | 0.02 | −0.03 | −0.37 | 0.01 | 0.23 | −0.18 | −0.34 | −0.12 | −0.28 |
| UNC5B | 0.20 | 0.35 | 0.23 | 0.16 | 0.00 | −0.01 | −0.09 | 0.11 | −0.20 | 0.13 | −0.23 | 0.10 | −0.22 | −0.18 | −0.01 | −0.33 |
| TPM3 | 0.17 | 0.05 | 0.26 | 0.30 | 0.06 | 0.01 | −0.09 | 0.05 | −0.04 | 0.00 | 0.12 | 0.08 | −0.21 | −0.34 | −0.06 | −0.37 |
| MICAL2 | 0.09 | 0.28 | 0.38 | 0.13 | −0.01 | 0.02 | −0.22 | 0.11 | 0.02 | 0.04 | 0.02 | −0.06 | −0.20 | −0.20 | 0.00 | −0.40 |
| GNAO1 | 0.14 | 0.30 | 0.19 | 0.08 | 0.13 | −0.09 | 0.22 | 0.02 | −0.13 | −0.09 | −0.11 | 0.10 | −0.19 | −0.17 | −0.07 | −0.31 |
| GABBR2 | 0.16 | 0.33 | 0.15 | 0.14 | 0.08 | 0.03 | 0.02 | 0.09 | −0.14 | −0.09 | −0.07 | 0.05 | −0.35 | −0.12 | 0.03 | −0.30 |
| KCNK1 | 0.27 | 0.38 | 0.09 | 0.13 | 0.17 | −0.06 | −0.14 | 0.01 | −0.03 | −0.16 | 0.09 | −0.08 | −0.18 | −0.22 | −0.09 | −0.18 |
| USP4 | 0.20 | 0.23 | 0.24 | 0.13 | 0.03 | 0.02 | −0.05 | 0.08 | −0.11 | 0.02 | −0.04 | −0.03 | −0.35 | −0.13 | 0.02 | −0.28 |
| TEX2 | 0.20 | 0.25 | 0.12 | 0.18 | 0.08 | −0.22 | 0.04 | 0.11 | −0.02 | 0.00 | 0.08 | 0.02 | −0.20 | −0.26 | 0.01 | −0.39 |
| PRKAG2 | 0.04 | 0.30 | 0.17 | 0.00 | 0.20 | 0.18 | 0.04 | −0.05 | −0.08 | −0.06 | 0.02 | 0.03 | −0.24 | −0.19 | −0.06 | −0.29 |
| APBA2 | 0.01 | 0.10 | 0.21 | 0.21 | −0.04 | 0.01 | 0.12 | 0.03 | −0.09 | −0.05 | −0.04 | 0.05 | −0.15 | −0.21 | −0.04 | −0.12 |
| SUSD6 | 0.10 | 0.16 | 0.12 | 0.13 | 0.05 | −0.07 | −0.06 | 0.05 | −0.06 | 0.05 | −0.01 | 0.03 | −0.10 | −0.09 | −0.08 | −0.24 |
| HDHD2 | −0.18 | −0.05 | −0.30 | −0.20 | −0.02 | 0.00 | −0.01 | 0.09 | 0.02 | −0.02 | 0.14 | −0.07 | 0.04 | 0.21 | 0.11 | 0.25 |
| NAA20 | −0.23 | −0.24 | −0.20 | −0.07 | −0.12 | 0.05 | −0.02 | 0.00 | 0.11 | −0.08 | 0.18 | −0.02 | 0.22 | 0.11 | 0.17 | 0.14 |
| CRIPT | −0.06 | −0.35 | −0.30 | −0.29 | −0.24 | 0.15 | 0.06 | −0.03 | 0.11 | 0.15 | 0.17 | −0.03 | 0.26 | 0.05 | −0.02 | 0.37 |
| KNTC1 | −0.06 | −0.06 | −0.26 | −0.30 | −0.15 | 0.03 | 0.02 | −0.09 | −0.06 | −0.06 | −0.07 | 0.06 | 0.27 | 0.22 | 0.14 | 0.39 |
| RPS6KA5 | −0.25 | −0.17 | −0.43 | −0.31 | −0.13 | 0.25 | 0.13 | −0.01 | 0.07 | −0.05 | 0.10 | 0.02 | 0.17 | 0.17 | 0.08 | 0.37 |
| PHF10 | −0.25 | −0.45 | −0.32 | −0.13 | −0.09 | 0.12 | 0.18 | 0.03 | 0.13 | 0.05 | −0.01 | −0.01 | 0.20 | 0.16 | 0.07 | 0.32 |
| PCGF5 | −0.27 | −0.12 | −0.38 | −0.15 | 0.00 | −0.06 | 0.05 | −0.02 | 0.11 | −0.22 | 0.02 | 0.17 | 0.06 | 0.17 | 0.08 | 0.55 |
| DPY19L4 | −0.05 | −0.26 | −0.40 | −0.36 | −0.02 | 0.05 | −0.05 | 0.06 | 0.03 | −0.06 | 0.26 | 0.01 | 0.37 | −0.07 | 0.18 | 0.30 |
| APH1B | −0.08 | −0.37 | −0.44 | −0.29 | −0.23 | 0.21 | 0.12 | 0.05 | 0.06 | 0.03 | 0.20 | −0.09 | 0.36 | 0.18 | 0.26 | 0.03 |
| ZNF546 | −0.04 | −0.23 | −0.47 | −0.29 | −0.13 | 0.11 | 0.01 | 0.02 | 0.09 | −0.02 | 0.09 | −0.04 | 0.13 | 0.39 | 0.09 | 0.28 |
| ABCA17P | −0.38 | −0.14 | −0.18 | −0.15 | −0.10 | 0.03 | −0.10 | −0.03 | −0.01 | −0.16 | 0.25 | −0.04 | 0.35 | 0.09 | 0.19 | 0.38 |
| CDH26 | −0.26 | −0.15 | −0.47 | −0.26 | −0.01 | 0.23 | 0.06 | −0.04 | 0.00 | −0.02 | −0.11 | 0.23 | 0.09 | 0.07 | 0.19 | 0.45 |
| CBWD6 | −0.09 | −0.26 | −0.25 | −0.19 | −0.19 | 0.03 | −0.12 | 0.20 | 0.04 | −0.07 | −0.05 | −0.30 | 0.42 | 0.11 | 0.26 | 0.46 |
| ZNF736 | −0.05 | −0.32 | −0.46 | −0.26 | −0.11 | 0.07 | 0.10 | 0.02 | 0.08 | −0.16 | 0.11 | −0.04 | 0.10 | 0.24 | 0.02 | 0.65 |
| CFAP70 | −0.09 | −0.30 | −0.40 | −0.20 | −0.35 | 0.07 | 0.17 | −0.10 | 0.05 | −0.13 | 0.31 | 0.02 | 0.08 | 0.29 | 0.08 | 0.51 |
| UBE4A | −0.02 | −0.14 | −0.49 | −0.43 | −0.01 | −0.17 | −0.19 | 0.09 | 0.03 | 0.15 | 0.02 | −0.03 | 0.25 | 0.43 | 0.23 | 0.29 |
| TTC32 | −0.24 | −0.23 | −0.61 | −0.36 | 0.05 | 0.08 | 0.05 | 0.14 | 0.14 | −0.10 | 0.28 | −0.07 | 0.23 | −0.02 | 0.22 | 0.44 |
| CFAP53 | −0.57 | −0.14 | −0.14 | 0.02 | −0.25 | −0.12 | 0.01 | −0.17 | 0.06 | −0.02 | 0.08 | −0.06 | 0.23 | 0.66 | 0.02 | 0.37 |
| PXDNL | −0.45 | −0.21 | −0.19 | −0.16 | −0.32 | 0.07 | 0.14 | 0.04 | −0.11 | −0.04 | 0.02 | −0.02 | 0.41 | 0.58 | −0.22 | 0.46 |
| CPVL | −0.17 | −0.32 | −0.52 | −0.27 | −0.34 | 0.24 | 0.24 | −0.11 | −0.08 | 0.13 | 0.16 | 0.03 | −0.03 | 0.43 | 0.07 | 0.55 |
| GLIPR1 | −0.25 | −0.27 | −0.48 | −0.09 | −0.23 | 0.13 | 0.14 | −0.12 | −0.04 | −0.17 | −0.07 | 0.20 | 0.25 | 0.56 | −0.05 | 0.47 |
| COL25A1 | −0.34 | −0.13 | −0.77 | −0.36 | 0.00 | 0.19 | 0.30 | −0.09 | 0.10 | −0.07 | 0.16 | −0.04 | 0.15 | 0.25 | 0.22 | 0.43 |
| MTHFD2L | −0.24 | −0.24 | −0.65 | −0.42 | −0.05 | 0.30 | 0.06 | 0.10 | −0.03 | −0.06 | 0.12 | 0.17 | −0.02 | 0.36 | −0.03 | 0.63 |
| LSM5 | −0.18 | −0.36 | −0.28 | −0.12 | 0.04 | −0.30 | 0.01 | −0.06 | 0.13 | 0.02 | 0.15 | −0.21 | 0.69 | −0.14 | 0.22 | 0.39 |
| LOC100505715 | −0.22 | −0.38 | −0.35 | −0.57 | 0.04 | 0.19 | −0.03 | 0.00 | 0.23 | −0.07 | 0.21 | 0.03 | 0.04 | 0.51 | 0.20 | 0.17 |
| NR3C2 | −0.27 | −0.20 | −0.61 | −0.44 | −0.14 | 0.08 | 0.18 | 0.05 | 0.08 | −0.17 | −0.04 | 0.40 | 0.14 | 0.20 | 0.17 | 0.56 |
| TOM1L1 | −0.28 | 0.03 | −0.62 | −0.42 | −0.07 | 0.01 | −0.06 | 0.10 | −0.05 | −0.14 | −0.10 | 0.12 | 0.32 | 0.35 | 0.21 | 0.62 |
| ANKRD42 | −0.07 | −0.11 | −0.61 | −0.33 | −0.10 | −0.35 | 0.24 | −0.21 | 0.07 | −0.06 | −0.10 | 0.28 | 0.52 | 0.09 | 0.15 | 0.58 |
| SLC8A1-AS1 | −0.30 | −0.38 | −0.18 | −0.26 | −0.19 | 0.14 | 0.05 | −0.14 | −0.14 | 0.32 | −0.24 | −0.19 | 0.70 | 0.62 | −0.11 | 0.32 |
| ATAD2 | 0.02 | −0.52 | −0.41 | −0.36 | −0.50 | 0.03 | 0.11 | 0.03 | 0.14 | −0.09 | 0.09 | 0.19 | 0.64 | 0.16 | 0.14 | 0.32 |
| GAB1 | −0.61 | 0.04 | −0.36 | −0.39 | 0.18 | −0.05 | −0.30 | −0.09 | −0.08 | −0.01 | 0.06 | 0.09 | 0.58 | 0.42 | −0.01 | 0.53 |
| CCDC146 | −0.28 | −0.16 | −0.43 | −0.24 | −0.20 | 0.04 | −0.03 | 0.01 | 0.09 | −0.21 | −0.18 | −0.02 | 0.34 | 0.59 | −0.03 | 0.72 |

TABLE 44-continued

Log2 fold change of expression for genes in granule cells

| | Log2 fold change of expression Subject | | | | | | | | | | | | | | | |
|---|---|---|---|---|---|---|---|---|---|---|---|---|---|---|---|---|
| Gene | xk | tm | wo | wc | wi | pk | vm | wl | sg | or | lt | zh | ko | kq | ke | ai |
| ELMOD1 | −0.14 | −0.43 | −0.42 | −0.47 | 0.12 | 0.02 | 0.20 | −0.35 | 0.05 | −0.23 | 0.10 | 0.14 | 0.50 | 0.12 | 0.22 | 0.55 |
| CFAP74 | −0.28 | −0.14 | −0.04 | −0.79 | −0.01 | 0.00 | −0.50 | −0.28 | 0.41 | 0.10 | 0.32 | −0.07 | 0.25 | 0.50 | 0.15 | 0.36 |
| C1orf146 | −0.05 | −0.29 | −0.41 | −0.37 | −0.18 | 0.14 | −0.01 | 0.01 | 0.21 | −0.20 | −0.18 | −0.02 | 0.22 | 0.64 | 0.04 | 0.45 |
| P4HA2 | −0.40 | −0.35 | 0.07 | −0.56 | 0.05 | −0.47 | −0.04 | −0.11 | 0.29 | 0.31 | −0.08 | −0.04 | 0.58 | 0.44 | 0.15 | 0.16 |
| RANBP3L | −0.14 | −0.17 | −0.64 | −0.38 | −0.20 | 0.34 | −0.06 | −0.18 | 0.08 | −0.14 | 0.05 | 0.14 | 0.14 | 0.68 | 0.09 | 0.39 |
| OTUD6B-AS1 | −0.31 | −0.46 | −0.50 | −0.28 | −0.12 | −0.13 | 0.03 | 0.40 | 0.07 | −0.16 | 0.03 | 0.20 | 0.50 | −0.11 | 0.40 | 0.44 |
| EYS | −0.39 | −0.47 | −0.38 | −0.12 | −0.30 | 0.26 | 0.11 | 0.02 | 0.07 | −0.18 | 0.00 | −0.12 | 0.26 | 0.58 | −0.01 | 0.66 |
| ALS2CR11 | −0.13 | −0.40 | −0.61 | −0.18 | −0.44 | 0.16 | 0.29 | −0.25 | 0.00 | −0.17 | 0.25 | −0.05 | 0.17 | 0.49 | 0.28 | 0.59 |
| LECT1 | −0.24 | −0.19 | −0.59 | −0.17 | −0.19 | 0.07 | −0.02 | 0.04 | 0.03 | −0.27 | 0.15 | −0.03 | 0.66 | 0.44 | −0.25 | 0.53 |
| BHLHE40-AS1 | −0.56 | −0.21 | −0.15 | −0.33 | 0.05 | −0.33 | −0.11 | −0.02 | −0.06 | 0.14 | −0.03 | 0.23 | 0.27 | 0.25 | 0.37 | 0.49 |
| STAB2 | −0.22 | −0.62 | −0.03 | −0.14 | −0.27 | 0.18 | −0.22 | −0.09 | −0.03 | −0.07 | 0.02 | 0.09 | 0.18 | 0.26 | 0.65 | 0.32 |
| PXYLP1 | −0.68 | −0.34 | 0.12 | −0.62 | 0.15 | −0.22 | −0.35 | −0.14 | 0.29 | 0.49 | −0.17 | 0.35 | 0.42 | 0.38 | 0.03 | 0.28 |
| LOC101929710 | −0.44 | 0.00 | −0.56 | −0.46 | −0.16 | −0.02 | 0.13 | −0.26 | 0.12 | −0.09 | 0.20 | 0.04 | −0.02 | 0.78 | 0.07 | 0.69 |
| LINC00499 | 0.02 | −0.18 | −0.68 | −0.62 | −0.42 | 0.02 | 0.24 | −0.01 | 0.07 | 0.10 | −0.15 | 0.07 | 0.53 | 0.50 | 0.12 | 0.41 |
| RHOBTB3 | −0.19 | 0.05 | −0.60 | −0.77 | −0.26 | 0.05 | 0.03 | 0.21 | −0.11 | −0.15 | −0.19 | −0.10 | 0.65 | 0.30 | 0.11 | 0.96 |
| CRYBG3 | −0.12 | −0.28 | −0.68 | −0.51 | −0.26 | 0.05 | 0.37 | 0.03 | 0.25 | −0.30 | −0.27 | 0.01 | 0.49 | 0.47 | 0.09 | 0.67 |
| NPY6R | −0.27 | −0.11 | −0.88 | −0.26 | −0.32 | −0.01 | 0.07 | −0.07 | 0.16 | −0.03 | 0.16 | 0.12 | 0.69 | 0.17 | 0.05 | 0.54 |
| RGS20 | −0.36 | −0.32 | −0.27 | −0.42 | 0.04 | 0.15 | −0.29 | −0.45 | 0.21 | 0.03 | 0.11 | 0.08 | 0.76 | 0.65 | −0.16 | 0.23 |
| C2orf73 | −0.17 | 0.03 | −0.81 | −0.76 | −0.26 | 0.30 | 0.04 | 0.00 | 0.05 | 0.14 | −0.03 | −0.03 | 0.11 | 0.61 | 0.40 | 0.39 |
| YIPF7 | −0.27 | −0.09 | −0.73 | −0.39 | −0.23 | 0.12 | −0.02 | 0.12 | 0.06 | −0.10 | −0.16 | −0.24 | 0.87 | 0.66 | −0.10 | 0.50 |
| BUB1B | −0.24 | −0.36 | −0.57 | −0.56 | 0.08 | 0.09 | −0.24 | 0.18 | 0.08 | −0.08 | 0.13 | 0.00 | −0.05 | 0.75 | 0.32 | 0.47 |
| CFAP43 | −0.25 | 0.07 | −0.74 | −0.55 | −0.22 | 0.17 | −0.07 | −0.16 | 0.06 | −0.09 | 0.11 | −0.28 | 0.47 | 0.76 | −0.03 | 0.77 |
| LOC102724623 | −0.27 | −0.29 | −0.34 | −0.37 | 0.01 | 0.32 | −0.33 | −0.39 | 0.29 | −0.40 | 0.40 | −0.39 | 0.11 | 0.18 | 0.48 | 1.00 |
| LRRC69 | −0.38 | −0.01 | −0.46 | −0.49 | −0.34 | 0.14 | 0.01 | −0.19 | 0.04 | −0.17 | −0.05 | 0.28 | 1.02 | 0.35 | −0.09 | 0.33 |
| STK3 | −0.28 | −0.22 | 0.00 | −0.23 | −0.16 | −0.14 | −0.01 | −0.57 | −0.23 | −0.23 | −0.27 | 0.03 | −0.15 | 0.51 | 0.91 | 1.03 |
| CLIC5 | −0.17 | 0.17 | −0.54 | −0.29 | −0.47 | −0.17 | −0.26 | −0.17 | 0.10 | −0.02 | −0.06 | 0.26 | 0.76 | 0.51 | −0.19 | 0.54 |
| CACNA2D3 | −0.12 | −0.55 | −0.88 | −0.35 | −0.47 | 0.44 | −0.17 | −0.23 | 0.79 | 0.08 | −0.13 | 0.15 | 0.25 | 0.65 | −0.17 | 0.72 |
| C2orf27A | −0.09 | −0.99 | −0.35 | −0.42 | −0.26 | 0.19 | 0.18 | −0.03 | 0.11 | −0.13 | 0.27 | −0.03 | 0.56 | 0.01 | 0.09 | 0.89 |
| LOC105378385 | −0.27 | −0.45 | −0.85 | −0.39 | −0.40 | 0.46 | 0.37 | −0.27 | 0.37 | −0.09 | −0.04 | −0.13 | 0.33 | 1.15 | 0.17 | 0.06 |
| BEST3 | −0.02 | −0.63 | −0.62 | −0.54 | −0.04 | −0.12 | −0.33 | −0.09 | 0.22 | 0.11 | 0.46 | −0.03 | −0.05 | 0.86 | 0.20 | 0.62 |
| EPHA6 | −0.02 | −0.23 | −0.93 | −0.91 | −0.75 | 0.08 | 0.10 | 0.18 | 0.49 | −0.04 | −0.03 | 0.18 | −0.04 | 0.70 | 0.39 | 0.84 |
| LOC100506393 | −0.23 | −0.56 | −0.35 | −0.29 | −0.42 | 0.27 | −0.04 | 0.03 | −0.41 | −0.26 | −0.08 | 0.23 | 0.58 | 0.65 | 0.26 | 0.62 |
| MEF2C | −0.46 | −0.49 | −1.00 | −0.82 | 0.37 | 0.05 | 0.46 | 0.01 | 0.01 | −0.37 | −0.04 | 0.48 | 0.21 | 0.49 | 0.27 | 0.83 |
| GTSCR1 | −0.21 | −0.15 | −1.11 | −0.17 | −0.32 | −0.23 | −0.18 | −0.64 | 0.26 | 0.52 | 0.26 | 0.56 | 0.16 | 0.65 | 0.25 | 0.35 |
| ELOVL2 | 0.10 | −0.37 | −0.75 | −0.70 | −0.51 | 0.09 | 0.17 | −0.11 | 0.22 | −0.23 | 0.08 | −0.28 | 0.91 | 0.80 | 0.18 | 0.41 |
| SPATA9 | −0.19 | −0.35 | −0.66 | −0.41 | −0.59 | 0.24 | 0.21 | −0.26 | 0.17 | −0.14 | −0.03 | −0.10 | 0.78 | 0.46 | 0.18 | 0.69 |
| PLSCR4 | −0.62 | −0.54 | −0.42 | −0.71 | 0.51 | −0.16 | −0.74 | 0.44 | −0.46 | 0.32 | 0.09 | 0.69 | −0.14 | 0.84 | 0.38 | 0.50 |
| GCK | −0.51 | −0.10 | −0.60 | −0.41 | −0.01 | 0.05 | −0.14 | −0.09 | 0.16 | 0.38 | 0.15 | −0.58 | 0.21 | 0.96 | 0.43 | 0.10 |
| LINC01032 | −0.02 | −0.16 | −0.95 | −0.51 | −0.96 | 0.24 | 0.18 | −0.08 | 0.06 | −0.13 | −0.30 | 0.07 | 0.46 | 1.27 | 0.10 | 0.75 |
| MEF2C-AS1 | −0.47 | −0.34 | −0.72 | −0.60 | −0.07 | 0.05 | 0.00 | 0.02 | 0.04 | −0.29 | −0.01 | 0.17 | 0.78 | 0.26 | 0.27 | 0.90 |
| BMS1P21 | −0.14 | −0.84 | −0.74 | −0.32 | 0.25 | −0.35 | −0.31 | −0.06 | 0.29 | −0.23 | −0.26 | 1.08 | 0.17 | 0.50 | 0.49 | 0.46 |
| CASP12 | −0.31 | −0.88 | −1.20 | −0.22 | 0.15 | −0.34 | 0.56 | −0.12 | −0.07 | −0.04 | 0.37 | 0.62 | 0.32 | 0.19 | 0.08 | 0.87 |
| CLMP | −0.09 | −0.21 | −0.79 | −0.47 | −0.11 | 0.21 | −0.11 | −0.53 | −0.02 | 0.06 | −0.34 | −0.06 | 0.58 | 1.50 | 0.30 | 0.09 |
| ERBIN | −0.50 | −0.62 | −0.20 | −0.49 | 0.47 | −0.39 | −0.22 | −0.43 | 0.22 | 0.13 | 0.13 | 0.23 | 0.11 | 0.38 | 0.54 | 0.64 |
| TMC3-AS1 | −0.32 | −0.20 | −0.86 | −0.64 | −0.40 | −0.45 | 0.17 | 0.14 | −0.04 | −0.01 | 0.02 | 0.13 | 0.58 | 0.86 | 0.01 | 1.02 |
| CXXC4 | −0.14 | −0.80 | −0.27 | −1.37 | 0.18 | 0.01 | −0.24 | −0.02 | −0.20 | 0.16 | 0.27 | 0.06 | 0.88 | 0.35 | 0.46 | 0.66 |
| DCBLD1 | 0.09 | −0.56 | −0.61 | −0.81 | −0.36 | −0.57 | 0.30 | 0.11 | 0.29 | −0.32 | −0.39 | −0.11 | 0.64 | 0.76 | 0.54 | 0.99 |
| GSTO2 | −0.10 | −0.66 | −0.83 | 0.03 | −0.31 | 0.00 | −0.40 | −0.65 | 0.34 | 0.10 | 0.81 | 0.20 | 0.65 | 0.14 | −0.30 | 0.98 |
| PLOD2 | −0.46 | −0.44 | −0.76 | −0.98 | 0.07 | −0.26 | −0.31 | 0.14 | 0.20 | 0.45 | 0.22 | 0.60 | 0.12 | 0.67 | 0.17 | 0.56 |
| P4HA2-AS1 | −0.61 | −0.66 | −0.45 | −0.84 | 0.10 | −0.13 | 0.04 | −0.03 | 0.42 | 0.04 | 0.48 | 0.14 | 0.74 | 0.43 | 0.08 | 0.25 |
| TTC23L | −0.30 | −0.33 | −0.84 | −0.64 | −0.42 | 0.19 | 0.13 | −0.26 | 0.10 | 0.05 | −0.32 | 0.00 | 0.74 | 1.20 | 0.16 | 0.54 |
| CPLX3 | −0.69 | −0.20 | −0.07 | −0.48 | −0.41 | −0.93 | −0.18 | 0.47 | −0.42 | 0.03 | 0.26 | 0.31 | 0.03 | 0.82 | −0.07 | 1.55 |
| SOX13 | −0.72 | −0.31 | −0.18 | −0.24 | −0.04 | −0.49 | −0.59 | −0.29 | 0.16 | 0.16 | 0.44 | −0.08 | 1.08 | 0.65 | 0.05 | 0.39 |
| PRDM1 | −0.78 | −1.04 | −0.22 | −0.71 | 0.57 | −0.57 | −0.28 | 0.56 | 0.50 | 0.03 | −0.19 | −0.40 | 0.56 | 0.29 | 0.73 | 0.95 |
| RSPO2 | −0.40 | −0.48 | −0.18 | −0.19 | −0.29 | −0.51 | −0.26 | −0.51 | 0.08 | 0.28 | 0.07 | 0.17 | −0.21 | 0.94 | 0.78 | 0.72 |
| TSG1 | −0.29 | −0.49 | −0.96 | −0.62 | −0.91 | 0.38 | 0.45 | −0.18 | 0.24 | −0.11 | −0.30 | −0.14 | 0.55 | 1.28 | 0.18 | 0.90 |
| MIR31HG | −0.23 | −0.97 | −0.89 | −1.13 | 0.79 | −0.45 | −0.08 | −0.80 | 0.07 | 0.78 | −0.15 | 0.24 | 0.29 | 0.91 | 0.81 | 0.82 |
| CTB-12O2.1 | −0.52 | −0.50 | −0.46 | −0.26 | −0.46 | −0.42 | −0.19 | −0.51 | 0.58 | −0.28 | −0.54 | −0.05 | 1.14 | 0.70 | 0.93 | 0.84 |
| PLCH1 | −0.18 | −0.64 | −0.51 | −0.29 | −0.35 | −0.52 | −0.14 | −0.26 | −0.28 | −0.34 | −0.10 | 0.77 | 1.00 | 0.25 | −0.06 | 1.66 |
| JAML | −0.04 | −0.59 | −0.81 | −0.34 | −0.71 | −0.59 | −0.31 | −0.06 | −0.05 | 0.13 | −0.21 | 0.03 | 1.45 | 0.59 | 0.84 | 0.67 |
| SEMA3G | −1.33 | −0.20 | −0.18 | −0.61 | −0.18 | −0.58 | −0.78 | 0.00 | 0.12 | 0.40 | 0.29 | −0.58 | 1.18 | 1.41 | 0.04 | 1.02 |
| LOC101928203 | −0.69 | −0.54 | −0.59 | −0.87 | −0.49 | 0.16 | 0.09 | −0.16 | 0.24 | −0.28 | 0.45 | −0.09 | 1.43 | 0.70 | 0.18 | 0.44 |
| GLRA1 | −0.76 | −0.46 | −0.53 | −0.74 | −0.21 | −0.44 | −0.43 | −0.54 | 0.55 | −0.20 | −0.40 | 0.13 | 1.32 | 0.77 | 1.05 | 0.92 |
| SYT16 | −1.18 | −1.10 | −0.98 | −0.13 | −0.33 | −0.63 | −0.11 | 0.16 | 0.48 | −0.08 | 0.05 | 0.91 | 1.03 | 0.88 | 0.47 | 0.55 |
| SYN3 | −0.56 | −1.54 | −0.61 | −0.89 | 0.11 | −0.67 | −0.08 | −0.27 | 1.06 | −0.82 | 0.68 | 1.24 | −0.21 | 1.21 | 0.77 | 0.57 |
| ARHGAP32 | −1.79 | −0.75 | −0.55 | −1.21 | 0.05 | −0.41 | 0.14 | −0.83 | 0.99 | 1.09 | 0.53 | −0.33 | 1.04 | 0.61 | 0.58 | 0.85 |
| MIR646HG | −0.70 | −0.77 | −0.75 | −0.67 | −0.56 | −0.62 | 0.25 | 0.25 | −0.50 | 1.54 | −0.62 | 0.33 | 0.41 | 1.84 | −0.17 | 0.73 |
| ALCAM | −1.52 | −0.55 | −1.28 | −1.18 | 0.91 | −0.07 | −1.13 | −0.01 | −0.74 | 1.98 | −0.12 | 0.48 | −0.17 | 1.56 | 0.64 | 1.22 |
| SCGN | −1.04 | −0.64 | −0.61 | −0.93 | −0.59 | −0.72 | 0.04 | 0.06 | −0.59 | 0.11 | 0.20 | −0.43 | 2.24 | 1.81 | −0.54 | 1.62 |
| LINC01515 | −0.43 | −0.30 | −0.08 | 0.17 | −0.47 | −0.22 | −0.22 | −0.31 | −0.27 | −0.58 | −0.35 | −0.21 | −0.23 | −0.58 | −0.47 | 4.54 |
| LOC101929415 | −1.11 | −1.00 | −1.02 | −0.88 | −0.95 | −1.07 | −1.03 | −0.31 | 1.71 | 0.87 | 0.89 | −0.17 | 1.50 | 1.48 | 1.33 | −0.23 |

RNAseq results for the differentially expressed (adjusted p<0.01, baseMean>50) genes in granule cells across all samples is shown in Table 45.

TABLE 45

Differentially expressed genes in granule cells across all samples

| Gene | baseMean | Log2 Change | p-value | padj |
|---|---|---|---|---|
| RBFOX3 | 50345.918 | −0.011 | 1.05E−05 | 1.36E−03 |
| GRM4 | 34287.674 | −0.018 | 1.39E−05 | 1.67E−03 |
| KCND3 | 21782.620 | −0.014 | 2.56E−08 | 1.47E−05 |
| EPHA6 | 19340.255 | 0.023 | 3.39E−05 | 3.08E−03 |
| MICAL2 | 17163.764 | −0.010 | 1.50E−04 | 7.94E−03 |
| ATP2B2 | 16799.649 | −0.010 | 8.11E−05 | 5.36E−03 |
| NHSL2 | 13970.170 | −0.011 | 1.55E−06 | 4.00E−04 |
| TMEM163 | 13633.070 | −0.010 | 1.19E−04 | 6.72E−03 |
| NAV2 | 13031.701 | −0.014 | 8.29E−08 | 3.79E−05 |
| TMEM266 | 12010.373 | −0.010 | 4.59E−05 | 3.68E−03 |
| GABBR2 | 11930.254 | −0.009 | 4.67E−06 | 8.52E−04 |
| PDE3A | 10097.415 | −0.020 | 1.86E−04 | 9.12E−03 |
| KCNK1 | 8298.470 | −0.009 | 1.63E−05 | 1.86E−03 |
| ELMO1 | 7802.455 | −0.017 | 1.09E−05 | 1.39E−03 |
| GNAO1 | 7579.076 | −0.009 | 4.24E−06 | 8.14E−04 |
| NRXN2 | 7570.331 | −0.012 | 3.97E−05 | 3.37E−03 |
| KIF26B | 7517.804 | −0.012 | 3.53E−05 | 3.14E−03 |
| RPS6KA5 | 7326.044 | 0.011 | 4.54E−05 | 3.66E−03 |
| FAM135B | 7266.658 | −0.010 | 4.86E−06 | 8.54E−04 |
| PTK2B | 6597.329 | −0.014 | 2.75E−08 | 1.47E−05 |
| NR3C2 | 6543.803 | 0.015 | 8.86E−06 | 1.26E−03 |
| SUSD6 | 6401.317 | −0.006 | 6.73E−05 | 4.75E−03 |
| PRKAG2 | 6026.090 | −0.009 | 3.19E−05 | 2.98E−03 |
| CPLX2 | 5765.403 | −0.017 | 2.01E−06 | 4.65E−04 |
| GABBR1 | 5382.344 | −0.015 | 1.50E−06 | 4.00E−04 |
| DGCR5 | 5322.686 | −0.013 | 1.12E−05 | 1.40E−03 |
| CHGB | 5041.537 | −0.022 | 1.36E−04 | 7.51E−03 |
| MAPK4 | 4866.091 | −0.013 | 5.42E−07 | 1.83E−04 |
| APBA2 | 4762.326 | −0.006 | 1.59E−04 | 8.25E−03 |
| RAB37 | 4690.790 | −0.013 | 7.45E−07 | 2.27E−04 |
| SRCIN1 | 4017.605 | −0.017 | 1.05E−06 | 3.01E−04 |
| PPP2R2C | 4002.023 | −0.011 | 2.02E−04 | 9.51E−03 |
| RNF152 | 3798.987 | −0.014 | 5.37E−06 | 9.17E−04 |
| C14orf132 | 3786.072 | −0.012 | 6.94E−05 | 4.86E−03 |
| TPM4 | 3655.275 | −0.015 | 2.87E−09 | 3.19E−06 |
| PCGF5 | 3061.297 | 0.011 | 4.21E−05 | 3.46E−03 |
| KIAA1549L | 2987.063 | −0.017 | 3.81E−05 | 3.29E−03 |
| CLSTN3 | 2943.629 | −0.011 | 7.03E−05 | 4.88E−03 |
| CBLN3 | 2714.596 | −0.017 | 4.95E−05 | 3.86E−03 |
| EFR3B | 2684.868 | −0.012 | 2.81E−05 | 2.71E−03 |
| ERGIC1 | 2501.561 | −0.014 | 7.49E−05 | 5.13E−03 |
| SLC17A7 | 2381.760 | −0.019 | 3.13E−05 | 2.97E−03 |
| CABIN1 | 2325.960 | −0.011 | 1.52E−04 | 7.99E−03 |
| HIP1 | 2298.351 | −0.015 | 1.02E−04 | 6.14E−03 |
| SYT7 | 2297.082 | −0.025 | 1.04E−08 | 8.07E−06 |
| DHDDS | 2267.496 | −0.014 | 6.86E−06 | 1.07E−03 |
| EPB41L1 | 2266.476 | −0.014 | 1.81E−06 | 4.38E−04 |
| EYS | 2247.457 | 0.017 | 8.38E−06 | 1.23E−03 |
| KCNK10 | 2220.881 | −0.014 | 1.73E−04 | 8.66E−03 |
| CDH23 | 2139.153 | −0.026 | 2.33E−08 | 1.39E−05 |
| FLNB | 2129.312 | −0.012 | 1.64E−05 | 1.86E−03 |
| KIAA0895L | 1941.088 | −0.020 | 3.43E−08 | 1.72E−05 |
| XKR7 | 1857.510 | −0.014 | 6.50E−06 | 1.05E−03 |
| UNC5B | 1829.248 | −0.010 | 5.12E−05 | 3.92E−03 |
| KCNA2 | 1738.999 | −0.010 | 1.97E−04 | 9.36E−03 |
| DCLK1 | 1729.006 | −0.045 | 1.33E−04 | 7.36E−03 |
| PLXNA4 | 1698.038 | −0.021 | 7.97E−05 | 5.29E−03 |
| PTPRE | 1697.110 | −0.019 | 6.95E−13 | 3.78E−09 |
| PILRA | 1657.001 | −0.011 | 1.92E−04 | 9.28E−03 |
| ELAVL3 | 1635.882 | −0.019 | 5.97E−06 | 9.97E−04 |
| TEX2 | 1535.488 | −0.009 | 1.69E−04 | 8.55E−03 |
| CACNA2D3 | 1429.407 | 0.022 | 8.87E−05 | 5.65E−03 |
| MIR31HG | 1405.114 | 0.034 | 2.59E−06 | 5.76E−04 |
| CPVL | 1345.623 | 0.014 | 8.67E−05 | 5.54E−03 |
| PC | 1333.761 | −0.013 | 1.40E−04 | 7.59E−03 |
| HDHD2 | 1305.106 | 0.008 | 7.66E−05 | 5.17E−03 |
| PTPRJ | 1260.812 | −0.027 | 1.47E−07 | 6.33E−05 |
| GRK5 | 1235.398 | −0.025 | 6.59E−09 | 5.81E−06 |
| TRIM67 | 1160.185 | −0.014 | 8.80E−06 | 1.26E−03 |
| PIP5K1C | 1157.473 | −0.017 | 1.01E−04 | 6.13E−03 |

TABLE 45-continued

Differentially expressed genes in granule cells across all samples

| Gene | baseMean | Log2 Change | p-value | padj |
|---|---|---|---|---|
| GRIN2C | 1149.100 | −0.019 | 1.89E−05 | 2.10E−03 |
| ADAM19 | 1129.783 | −0.015 | 2.33E−05 | 2.40E−03 |
| C1orf61 | 1128.395 | −0.022 | 2.16E−08 | 1.34E−05 |
| ZNRF1 | 1032.971 | −0.012 | 3.93E−05 | 3.36E−03 |
| TOM1L1 | 1029.393 | 0.016 | 5.37E−06 | 9.17E−04 |
| MEF2C | 1008.824 | 0.024 | 2.82E−05 | 2.71E−03 |
| GDPD5 | 1000.940 | −0.021 | 2.38E−07 | 9.73E−05 |
| RAB6B | 998.297 | −0.013 | 2.00E−06 | 4.65E−04 |
| RHOBTB3 | 971.326 | 0.019 | 1.26E−04 | 7.09E−03 |
| REEP1 | 946.662 | −0.012 | 2.11E−05 | 2.24E−03 |
| GAB1 | 945.797 | 0.017 | 1.10E−05 | 1.39E−03 |
| MTHFD2L | 880.484 | 0.015 | 1.69E−04 | 8.55E−03 |
| NUMBL | 858.624 | −0.014 | 6.30E−05 | 4.50E−03 |
| TPM3 | 847.801 | −0.010 | 5.02E−05 | 3.90E−03 |
| FAT1 | 845.279 | −0.041 | 2.55E−05 | 2.60E−03 |
| CRIPT | 839.761 | 0.011 | 9.82E−05 | 6.04E−03 |
| MEG8 | 817.575 | −0.013 | 4.34E−05 | 3.53E−03 |
| ST3GAL2 | 815.630 | −0.016 | 1.64E−05 | 1.86E−03 |
| TMC3-AS1 | 774.822 | 0.028 | 1.35E−08 | 9.56E−06 |
| KLHDC4 | 731.377 | −0.011 | 1.03E−04 | 6.14E−03 |
| ZNF736 | 718.113 | 0.013 | 9.54E−05 | 5.92E−03 |
| SLC8A1-AS1 | 701.507 | 0.016 | 1.01E−04 | 6.11E−03 |
| LOC101929710 | 701.122 | 0.019 | 3.54E−06 | 7.27E−04 |
| KIF3B | 693.982 | −0.014 | 6.69E−06 | 1.07E−03 |
| CDK16 | 692.677 | −0.017 | 9.52E−06 | 1.32E−03 |
| PIP4K2A | 692.212 | −0.035 | 1.57E−10 | 2.72E−07 |
| CCDC146 | 686.609 | 0.017 | 3.86E−06 | 7.69E−04 |
| SDK1 | 675.822 | −0.029 | 6.84E−06 | 1.07E−03 |
| TMEM130 | 662.918 | −0.018 | 7.33E−07 | 2.27E−04 |
| RIMS3 | 661.640 | −0.017 | 2.72E−05 | 2.71E−03 |
| MRAP2 | 651.226 | −0.027 | 4.10E−07 | 1.57E−04 |
| LPCAT4 | 643.659 | −0.017 | 1.44E−04 | 7.70E−03 |
| KCNK3 | 611.309 | −0.015 | 5.76E−05 | 4.29E−03 |
| USP4 | 606.876 | −0.009 | 7.33E−06 | 1.10E−03 |
| RAI2 | 599.661 | −0.014 | 1.94E−05 | 2.13E−03 |
| ABCA17P | 597.623 | 0.012 | 1.95E−06 | 4.65E−04 |
| SYN3 | 571.141 | 0.045 | 9.43E−06 | 1.32E−03 |
| DAO | 564.826 | −0.015 | 1.26E−06 | 3.42E−04 |
| WWC2 | 562.806 | −0.032 | 3.14E−08 | 1.62E−05 |
| FMNL3 | 542.089 | −0.013 | 9.36E−05 | 5.84E−03 |
| APH1B | 539.205 | 0.012 | 1.95E−06 | 9.32E−03 |
| ACOT7 | 526.573 | −0.016 | 1.32E−04 | 7.34E−03 |
| MGAT3 | 523.255 | −0.022 | 1.77E−06 | 4.38E−04 |
| LOC105378385 | 510.612 | 0.022 | 2.07E−04 | 9.68E−03 |
| GYS1 | 499.337 | −0.016 | 6.00E−06 | 4.35E−03 |
| BEST3 | 490.054 | 0.023 | 1.70E−07 | 7.15E−05 |
| SYT12 | 489.549 | −0.015 | 7.02E−05 | 4.88E−03 |
| UGGT2 | 480.980 | −0.057 | 2.64E−06 | 5.77E−04 |
| CATSPERG | 464.091 | −0.033 | 1.50E−08 | 9.72E−06 |
| ZYX | 460.598 | −0.024 | 2.12E−05 | 2.24E−03 |
| MAP6D1 | 456.730 | −0.018 | 3.62E−05 | 3.18E−03 |
| DGKA | 453.066 | −0.010 | 3.68E−05 | 3.21E−03 |
| UBE4A | 446.905 | 0.014 | 1.13E−06 | 3.20E−04 |
| MEF2C-AS1 | 436.410 | 0.026 | 1.22E−10 | 2.36E−07 |
| PHF10 | 429.336 | 0.011 | 2.04E−05 | 2.19E−03 |
| LRPAP1 | 421.084 | −0.018 | 1.07E−04 | 6.33E−03 |
| CFAP53 | 416.274 | 0.014 | 5.43E−05 | 4.08E−03 |
| ACAP3 | 404.604 | −0.013 | 3.60E−06 | 7.27E−04 |
| SYT3 | 399.161 | −0.015 | 1.10E−05 | 1.39E−03 |
| ELMOD1 | 397.720 | 0.017 | 4.84E−06 | 8.54E−04 |
| PXDNL | 390.913 | 0.014 | 1.83E−04 | 9.05E−03 |
| NAA20 | 379.461 | 0.009 | 1.12E−05 | 1.40E−03 |
| ALS2CR11 | 367.106 | 0.017 | 1.96E−05 | 2.13E−03 |
| ARHGAP32 | 366.765 | 0.051 | 3.52E−07 | 1.40E−04 |
| AP1S3 | 365.601 | −0.020 | 8.69E−06 | 1.26E−03 |
| KCNIP2 | 360.911 | −0.013 | 5.06E−05 | 3.91E−03 |
| RHBG | 359.397 | −0.023 | 8.18E−05 | 5.39E−03 |
| DYSF | 356.876 | −0.020 | 1.67E−04 | 8.53E−03 |
| NKD1 | 352.577 | −0.016 | 2.09E−04 | 9.74E−03 |
| TTYH3 | 348.038 | −0.019 | 1.85E−04 | 9.08E−03 |
| PTPN3 | 344.790 | −0.041 | 4.05E−12 | 1.58E−08 |
| TP73 | 341.504 | −0.020 | 3.97E−06 | 7.81E−04 |
| CBWD6 | 336.598 | 0.012 | 1.96E−04 | 9.32E−03 |
| LRRC1 | 324.253 | −0.014 | 1.07E−04 | 6.33E−03 |
| TCEAL2 | 303.853 | −0.013 | 1.18E−04 | 6.72E−03 |

TABLE 45-continued

Differentially expressed genes in granule cells across all samples

| Gene | baseMean | Log2 Change | p-value | padj |
|---|---|---|---|---|
| KCNQ3 | 303.479 | −0.064 | 1.73E−06 | 4.35E−04 |
| PDZD7 | 303.201 | −0.016 | 1.11E−04 | 6.46E−03 |
| FARP1 | 300.108 | −0.037 | 1.03E−07 | 4.55E−05 |
| GLIPR1 | 295.278 | 0.014 | 5.84E−05 | 4.30E−03 |
| GACAT2 | 293.355 | −0.018 | 3.45E−06 | 7.25E−04 |
| TTC32 | 292.733 | 0.014 | 6.31E−05 | 4.50E−03 |
| PTMS | 286.939 | −0.026 | 1.50E−04 | 7.94E−03 |
| COL25A1 | 284.956 | 0.014 | 1.59E−04 | 8.26E−03 |
| LYRM1 | 280.842 | −0.011 | 1.99E−04 | 9.41E−03 |
| CFAP74 | 279.177 | 0.017 | 8.30E−05 | 5.43E−03 |
| STEAP3 | 277.625 | −0.018 | 1.31E−05 | 1.57E−03 |
| PXN | 276.469 | −0.019 | 4.62E−06 | 8.52E−04 |
| AQP7 | 272.393 | −0.042 | 7.30E−13 | 3.78E−09 |
| OTUD6B-AS1 | 271.278 | 0.017 | 9.85E−06 | 1.33E−03 |
| CALY | 269.823 | −0.017 | 1.02E−04 | 6.14E−03 |
| CTB-12O2.1 | 267.774 | 0.035 | 4.91E−10 | 6.27E−07 |
| SLC38A10 | 262.838 | −0.010 | 9.57E−05 | 5.92E−03 |
| DPY19L4 | 259.504 | 0.012 | 9.07E−05 | 5.73E−03 |
| GTPBP2 | 257.879 | −0.012 | 1.52E−04 | 7.99E−03 |
| ZNF546 | 247.108 | 0.012 | 2.62E−05 | 2.64E−03 |
| YIPF7 | 244.173 | 0.020 | 4.95E−05 | 3.86E−03 |
| ANKRD42 | 242.006 | 0.016 | 6.32E−05 | 4.50E−03 |
| ATAD2 | 239.267 | 0.016 | 2.83E−05 | 2.71E−03 |
| CHRD | 237.780 | −0.018 | 1.78E−05 | 2.00E−03 |
| CFAP70 | 234.603 | 0.013 | 7.67E−05 | 5.17E−03 |
| ZNF219 | 231.429 | −0.016 | 5.87E−05 | 4.30E−03 |
| CREB3L2 | 231.412 | −0.021 | 1.17E−04 | 6.72E−03 |
| ALCAM | 229.200 | 0.057 | 1.77E−04 | 8.81E−03 |
| RGS20 | 223.121 | 0.020 | 7.17E−06 | 1.09E−03 |
| CHST12 | 220.202 | −0.014 | 9.19E−05 | 5.78E−03 |
| LINC01032 | 218.152 | 0.026 | 1.63E−04 | 8.35E−03 |
| CFAP43 | 211.635 | 0.021 | 2.61E−05 | 2.64E−03 |
| CDK5R2 | 209.638 | −0.021 | 5.82E−06 | 9.82E−04 |
| GLRA1 | 209.467 | 0.044 | 4.84E−16 | 7.52E−12 |
| PLOD2 | 209.111 | 0.029 | 3.55E−09 | 3.44E−06 |
| CXXC4 | 207.138 | 0.028 | 3.60E−06 | 7.27E−04 |
| CDH26 | 206.569 | 0.012 | 1.87E−04 | 9.14E−03 |
| SCHLAP1 | 198.829 | −0.060 | 7.72E−07 | 2.31E−04 |
| PLCH2 | 196.686 | −0.027 | 6.04E−06 | 9.98E−04 |
| VWA5B2 | 195.922 | −0.016 | 8.40E−05 | 5.43E−03 |
| PLSCR4 | 195.390 | 0.025 | 2.07E−04 | 9.68E−03 |
| DCBLD1 | 192.305 | 0.028 | 4.71E−06 | 8.52E−04 |
| ABCC10 | 180.066 | −0.014 | 2.15E−04 | 9.90E−03 |
| LINC01544 | 179.445 | −0.023 | 4.04E−06 | 7.85E−04 |
| LOC100505715 | 175.345 | 0.015 | 1.99E−05 | 2.14E−03 |
| FHDC1 | 174.815 | −0.021 | 1.69E−04 | 8.55E−03 |
| P4HA2 | 174.500 | 0.017 | 5.12E−05 | 3.92E−03 |
| NPY6R | 171.099 | 0.020 | 3.06E−06 | 6.52E−04 |
| LINC01515 | 170.511 | 0.091 | 1.23E−04 | 6.92E−03 |
| FAM212B | 169.731 | −0.016 | 4.76E−05 | 3.77E−03 |
| SYT16 | 167.452 | 0.045 | 5.39E−11 | 1.40E−07 |
| TTC23L | 166.748 | 0.030 | 7.76E−08 | 3.65E−05 |
| KNTC1 | 166.001 | 0.011 | 3.23E−05 | 2.98E−03 |
| ELOVL2 | 165.967 | 0.024 | 3.17E−05 | 2.98E−03 |
| FAM131A | 165.672 | −0.022 | 3.05E−05 | 2.91E−03 |
| CLMP | 164.996 | 0.027 | 6.91E−05 | 4.86E−03 |
| ATP6V0B | 163.595 | −0.016 | 1.38E−04 | 7.52E−03 |
| LOC102724623 | 161.233 | 0.021 | 1.16E−04 | 6.71E−03 |
| STK3 | 156.730 | 0.022 | 2.13E−04 | 9.87E−03 |
| CASP12 | 153.275 | 0.027 | 1.10E−04 | 6.43E−03 |
| PLXDC2 | 152.928 | −0.054 | 2.97E−06 | 6.41E−04 |
| GTSCR1 | 151.570 | 0.024 | 2.79E−05 | 2.71E−03 |
| PLCH1 | 150.075 | 0.036 | 7.00E−07 | 2.22E−04 |
| SDC3 | 146.412 | −0.017 | 9.34E−05 | 5.84E−03 |
| SLC25A6 | 145.952 | −0.017 | 6.49E−05 | 4.61E−03 |
| PXYLP1 | 144.017 | 0.019 | 2.09E−04 | 9.74E−03 |
| TSG1 | 142.981 | 0.034 | 4.72E−06 | 8.52E−04 |
| CPLX3 | 142.821 | 0.031 | 7.62E−05 | 5.17E−03 |
| ITGB5 | 142.534 | −0.050 | 8.33E−11 | 1.85E−07 |
| PLXNA1 | 141.224 | −0.025 | 9.56E−06 | 1.32E−03 |
| PRDM1 | 139.036 | 0.031 | 3.52E−05 | 3.14E−03 |
| CRYBG3 | 137.285 | 0.020 | 8.36E−05 | 5.43E−03 |
| C2orf27A | 137.080 | 0.022 | 3.56E−05 | 3.14E−03 |
| BMS1P21 | 135.301 | 0.027 | 5.39E−05 | 4.06E−03 |
| LSM5 | 134.670 | 0.015 | 1.43E−04 | 7.67E−03 |
| PTK7 | 134.378 | −0.016 | 4.11E−05 | 3.43E−03 |
| NEDD4 | 134.199 | −0.034 | 1.00E−05 | 1.33E−03 |
| BHLHE40-AS1 | 131.914 | 0.018 | 3.28E−09 | 3.39E−06 |
| LECT1 | 130.818 | 0.017 | 1.03E−04 | 6.14E−03 |
| BAD | 128.868 | −0.014 | 1.89E−04 | 9.18E−03 |
| SEMA3G | 127.065 | 0.042 | 5.98E−07 | 1.98E−04 |
| DYRK1B | 126.604 | −0.021 | 1.89E−05 | 2.10E−03 |
| ZDHHC23 | 125.799 | −0.018 | 1.38E−04 | 7.51E−03 |
| BUB1B | 123.089 | 0.021 | 1.53E−06 | 4.00E−04 |
| RANBP3L | 122.662 | 0.017 | 7.41E−05 | 5.12E−03 |
| FGF3 | 121.486 | −0.024 | 5.08E−07 | 1.76E−04 |
| NTNG2 | 118.478 | −0.028 | 1.70E−04 | 8.55E−03 |
| SPRED3 | 117.627 | −0.025 | 9.79E−06 | 1.33E−03 |
| CMTM8 | 115.497 | −0.039 | 8.39E−06 | 1.23E−03 |
| LOC101927078 | 115.074 | −0.021 | 1.17E−05 | 1.45E−03 |
| SPATA9 | 113.520 | 0.025 | 1.21E−06 | 3.36E−04 |
| TP53INP2 | 107.962 | −0.015 | 1.50E−04 | 7.94E−03 |
| JAML | 105.142 | 0.038 | 1.35E−08 | 9.56E−06 |
| LRRC69 | 103.255 | 0.021 | 5.85E−05 | 4.30E−03 |
| PCYT1B | 100.865 | −0.023 | 1.49E−08 | 9.72E−06 |
| GRAMD4 | 93.623 | −0.017 | 1.04E−05 | 1.36E−03 |
| NAB2 | 92.518 | −0.028 | 4.15E−07 | 1.57E−04 |
| LINC00499 | 92.305 | 0.019 | 6.23E−05 | 4.50E−03 |
| P4HA2-AS1 | 92.247 | 0.030 | 6.73E−09 | 5.81E−06 |
| LOC101929415 | 87.551 | 0.094 | 1.86E−11 | 5.79E−08 |
| ATXN7L2 | 86.354 | −0.016 | 1.71E−04 | 8.58E−03 |
| SLC38A7 | 83.233 | −0.017 | 1.60E−04 | 8.28E−03 |
| SBNO2 | 82.451 | −0.018 | 7.46E−05 | 5.13E−03 |
| C2orf73 | 82.230 | 0.020 | 1.95E−04 | 9.32E−03 |
| LOC101926941 | 81.438 | −0.032 | 2.11E−04 | 9.78E−03 |
| MIR646HG | 79.857 | 0.054 | 9.90E−06 | 1.33E−03 |
| ACHE | 78.961 | −0.021 | 6.49E−06 | 1.05E−03 |
| LOC100506393 | 75.008 | 0.024 | 4.89E−06 | 8.54E−04 |
| GSTO2 | 74.993 | 0.029 | 1.09E−06 | 6.43E−03 |
| ZNF703 | 73.641 | −0.021 | 1.52E−05 | 1.79E−03 |
| SCGN | 72.334 | 0.075 | 7.18E−09 | 5.87E−06 |
| C1orf146 | 71.399 | 0.017 | 1.14E−04 | 6.65E−03 |
| FAM53A | 71.116 | −0.018 | 4.23E−05 | 3.46E−03 |
| HPN | 69.661 | −0.019 | 1.53E−04 | 8.02E−03 |
| LOC101928203 | 69.012 | 0.043 | 4.88E−10 | 6.27E−07 |
| SOX13 | 67.867 | 0.031 | 4.91E−07 | 1.73E−04 |
| AHRR | 67.783 | −0.022 | 2.66E−08 | 1.47E−05 |
| RASIP1 | 66.766 | −0.016 | 4.03E−05 | 3.40E−03 |
| SURF2 | 65.825 | −0.022 | 1.27E−05 | 1.55E−03 |
| HCN2 | 65.312 | −0.023 | 3.49E−05 | 3.13E−03 |
| LINC00963 | 62.888 | −0.019 | 1.47E−05 | 1.74E−03 |
| LMNTD2 | 62.775 | −0.027 | 2.54E−06 | 5.73E−04 |
| MAMSTR | 60.729 | −0.020 | 3.74E−05 | 3.24E−03 |
| GCK | 59.850 | 0.025 | 2.15E−05 | 2.25E−03 |
| MPP6 | 55.651 | −0.031 | 2.74E−05 | 2.71E−03 |
| STAB2 | 53.476 | 0.018 | 4.23E−05 | 3.46E−03 |
| RSPO2 | 52.630 | 0.032 | 6.17E−08 | 3.00E−05 |
| ERBIN | 51.559 | 0.028 | 1.57E−06 | 4.01E−04 |
| CLIC5 | 50.025 | 0.022 | 2.00E−04 | 9.44E−03 |

The RNAseq results for the 139 genes in basket cells having significantly altered expression with age are shown in Table 46. The log 2 fold changes for the sorted nuclei from basket cells from each human sample compared to the normalized expression for sorted nuclei from granule cells across all samples are shown in Table 46. Negative values indicate reduced expression in the nuclei of the subject compared to the normalized value across nuclei from all samples, and a positive value indicates increased expression compared to the normalized value across nuclei from all cell types analyzed.

TABLE 46

Log2 fold change of expression of genes in basket cells

| | Log2 fold change of expression Subject | | | | | | | | | | | | | | | |
|---|---|---|---|---|---|---|---|---|---|---|---|---|---|---|---|---|
| Gene | xk | tm | wo | wc | wi | pk | vm | wl | sg | or | lt | zh | ko | kq | ke | ai |
| ACER3 | −0.43 | −0.46 | −0.43 | −0.01 | −0.35 | 0.08 | −0.27 | −0.12 | 0.22 | 0.30 | −0.12 | 0.05 | 0.00 | 0.33 | 0.75 | 0.46 |
| ACSS3 | −0.24 | 0.12 | −0.47 | −0.34 | −0.80 | −0.31 | −0.33 | −0.53 | −0.93 | 0.03 | −0.47 | −0.10 | 0.35 | 1.28 | 0.87 | 1.90 |
| ADAMTS2 | 0.55 | 0.00 | 0.36 | 0.67 | 0.22 | 0.20 | 0.00 | 0.12 | 0.00 | 0.30 | −0.43 | −0.04 | −0.59 | −0.28 | −0.33 | −0.76 |
| ADAMTS9 | 0.78 | 0.64 | 0.17 | 0.64 | −0.11 | 0.60 | 0.22 | 0.16 | 0.12 | 0.07 | −0.03 | −0.12 | −1.01 | −1.42 | 0.09 | −0.80 |
| ADAMTSL3 | −0.57 | 0.05 | −0.51 | −0.54 | −0.19 | −0.21 | 0.06 | −0.12 | −0.04 | 0.40 | −0.18 | −0.08 | 0.76 | 0.27 | 0.37 | 0.53 |
| ADD2 | 0.20 | 0.09 | 0.34 | 0.10 | 0.23 | 0.00 | −0.10 | 0.00 | 0.01 | −0.05 | −0.02 | 0.10 | −0.25 | −0.11 | −0.23 | −0.30 |
| ADGRL3 | 0.27 | 0.08 | 0.31 | −0.05 | 0.20 | 0.28 | 0.29 | 0.08 | −0.07 | −0.08 | −0.08 | −0.25 | −0.31 | −0.38 | −0.11 | −0.20 |
| AKAP13 | −0.41 | −0.06 | −0.31 | −0.12 | −0.70 | −0.14 | −0.31 | −0.12 | −0.27 | 0.00 | 0.01 | 0.12 | 0.21 | 0.69 | 0.64 | 0.76 |
| ALOX5 | −0.35 | −0.28 | −0.95 | −0.19 | −0.23 | −0.04 | 0.14 | −0.12 | −0.14 | −0.18 | −0.16 | 0.35 | 0.62 | 0.33 | 1.04 | 0.17 |
| ALS2CR11 | −0.40 | −0.49 | −0.26 | −0.29 | −0.49 | 0.06 | 0.36 | −0.36 | 0.11 | −0.08 | 0.61 | −0.22 | 0.21 | 0.06 | 0.48 | 0.70 |
| ARHGEF10L | 0.18 | 0.06 | 0.31 | 0.23 | 0.17 | 0.06 | −0.09 | 0.02 | 0.01 | 0.03 | −0.10 | 0.12 | −0.21 | −0.29 | −0.04 | −0.45 |
| ARHGEF6 | −0.28 | −0.11 | −0.66 | −0.30 | −0.51 | −0.09 | −0.08 | −0.28 | −0.69 | −0.05 | −0.08 | 0.44 | 0.19 | 0.74 | 0.81 | 0.97 |
| ASIC1 | 0.39 | 0.29 | 0.60 | 0.24 | 0.48 | 0.19 | −0.03 | 0.16 | 0.02 | −0.06 | −0.15 | −0.05 | −0.70 | −0.18 | −0.37 | −0.83 |
| ASIC2 | 0.39 | 0.56 | 0.32 | 0.21 | 0.19 | 0.59 | 0.13 | 0.01 | −0.02 | 0.12 | −0.12 | 0.03 | −0.89 | −0.39 | −0.29 | −0.84 |
| ATP6V0B | 0.34 | −0.08 | 0.70 | 0.09 | 0.41 | 0.00 | −0.06 | 0.55 | 0.23 | 0.06 | 0.06 | −0.22 | −0.15 | −0.79 | −0.45 | −0.68 |
| BMP3 | −0.38 | −0.69 | −0.78 | −0.34 | −0.16 | −0.29 | −0.13 | 0.33 | 0.77 | 0.06 | −0.23 | 0.36 | 0.12 | 0.22 | 0.25 | 0.89 |
| BTBD11 | 0.11 | 0.17 | 0.36 | 0.21 | 0.03 | 0.17 | −0.01 | −0.07 | −0.12 | 0.02 | −0.02 | 0.04 | −0.31 | −0.22 | −0.27 | −0.09 |
| C11orf87 | 0.75 | 0.85 | 0.97 | 0.16 | 0.26 | 0.56 | −0.31 | −0.31 | −0.13 | 0.00 | 0.20 | −0.15 | −0.45 | −0.44 | −0.95 | −1.00 |
| C14orf1 | 0.26 | 0.20 | 0.36 | 0.09 | −0.01 | 0.20 | −0.05 | 0.02 | 0.24 | 0.09 | −0.08 | −0.17 | −0.13 | −0.28 | −0.33 | −0.41 |
| C4orf22 | −0.79 | −0.66 | −0.96 | −0.62 | 0.24 | −0.30 | 0.02 | 0.39 | 0.44 | 0.24 | 0.02 | 0.20 | 0.20 | 0.13 | 0.15 | 1.29 |
| C9orf135 | −0.30 | −0.39 | −0.60 | −0.50 | 0.03 | 0.25 | −0.42 | 0.12 | 0.12 | 0.41 | −0.63 | −0.05 | 0.88 | 0.47 | −0.36 | 0.96 |
| CA7 | 0.62 | 0.30 | 0.54 | 0.23 | 0.06 | −0.11 | −0.16 | 0.39 | −0.09 | −0.21 | −0.51 | −0.01 | 0.02 | 0.01 | −0.51 | −0.57 |
| CACNA1D | 0.16 | 0.00 | 0.17 | 0.16 | 0.04 | 0.03 | 0.10 | 0.06 | 0.07 | −0.07 | −0.04 | −0.05 | −0.05 | −0.23 | −0.19 | −0.18 |
| CACNA2D3 | −1.43 | −0.73 | −0.79 | −1.41 | −0.15 | −1.36 | 0.04 | −0.11 | 0.52 | 0.12 | 0.10 | 0.18 | 1.41 | 1.61 | 0.24 | 1.74 |
| CACNB4 | 0.26 | 0.17 | 0.47 | 0.16 | 0.14 | 0.06 | −0.06 | 0.03 | −0.06 | −0.14 | −0.16 | 0.08 | −0.21 | −0.29 | −0.21 | −0.25 |
| CADM3 | 0.44 | 0.22 | 0.15 | 0.03 | 0.21 | 0.10 | 0.00 | 0.11 | 0.25 | −0.03 | −0.04 | −0.04 | −0.59 | −0.08 | −0.19 | −0.56 |
| CADPS | 0.28 | 0.12 | 0.13 | 0.10 | 0.08 | 0.28 | 0.18 | 0.06 | −0.09 | 0.09 | −0.01 | −0.07 | −0.45 | −0.24 | −0.15 | −0.33 |
| CALR | 0.29 | 0.24 | 0.70 | 0.23 | 0.66 | 0.02 | −0.06 | 0.28 | −0.04 | −0.30 | 0.42 | −0.05 | −0.46 | −0.89 | −0.13 | −0.90 |
| CDK15 | −0.62 | 0.13 | −0.61 | −0.77 | −0.61 | −0.19 | 0.21 | −0.18 | −0.61 | 0.09 | −0.69 | 0.54 | 0.03 | 1.76 | 0.31 | 1.21 |
| CFAP46 | −0.57 | −0.57 | −0.39 | −0.07 | −0.21 | 0.25 | −0.09 | −0.25 | 0.51 | 0.22 | −0.28 | 0.36 | 0.04 | 0.50 | −0.08 | 0.64 |
| CLSTN3 | 0.09 | 0.01 | 0.72 | 0.30 | 0.51 | −0.09 | −0.11 | 0.11 | 0.04 | −0.25 | −0.07 | 0.09 | −0.26 | −0.32 | −0.35 | −0.43 |
| CNTN3 | −0.42 | −0.40 | −0.17 | −0.32 | −0.67 | −0.28 | −0.43 | −0.08 | 0.52 | 0.28 | 0.31 | −0.13 | 0.37 | 0.61 | 0.02 | 0.80 |
| CPNE8 | −0.26 | −0.38 | −0.05 | −0.03 | −0.68 | −0.14 | −0.31 | −0.45 | −0.37 | 0.05 | −0.07 | 0.01 | 0.25 | 0.63 | 0.98 | 0.82 |
| CYYR1 | −0.44 | −0.20 | −0.64 | −0.33 | −0.31 | 0.30 | −0.02 | −0.16 | 0.35 | −0.02 | −0.08 | 0.05 | 0.45 | 0.71 | −0.28 | 0.61 |
| DBH | 0.09 | 0.49 | 0.22 | 0.37 | 0.23 | 0.17 | −0.35 | 0.31 | 0.08 | −0.06 | −0.21 | 0.20 | −0.42 | −0.16 | −0.25 | −0.72 |
| DCC | −0.55 | 0.29 | −0.46 | −0.76 | −1.12 | −0.48 | −0.64 | −0.28 | 0.69 | 0.11 | −0.73 | 0.28 | 0.44 | 0.87 | 1.11 | 1.22 |
| DDO | −0.09 | −0.46 | −0.78 | −0.84 | −0.23 | 0.20 | −0.08 | −0.17 | 0.39 | 0.04 | 0.32 | 0.20 | 0.19 | 0.67 | 0.46 | 0.21 |
| DGKH | 0.31 | 0.08 | 0.34 | 0.12 | 0.06 | 0.37 | 0.11 | 0.12 | −0.12 | −0.12 | −0.12 | 0.01 | −0.18 | −0.47 | −0.27 | −0.25 |
| DISP3 | 0.25 | 0.15 | 0.41 | 0.28 | 0.10 | 0.17 | 0.00 | 0.16 | 0.14 | −0.06 | −0.17 | −0.18 | −0.55 | −0.03 | −0.47 | −0.23 |
| DLG1 | −0.46 | 0.04 | −0.59 | −0.34 | −0.13 | −0.01 | −0.16 | −0.09 | 0.00 | 0.15 | −0.04 | 0.08 | 0.19 | −0.25 | 1.02 | 0.60 |
| DLG4 | −0.06 | 0.28 | 0.73 | 0.60 | 0.17 | 0.05 | −0.06 | −0.15 | −0.02 | −0.06 | −0.22 | 0.00 | −0.14 | −0.25 | 0.00 | −0.86 |
| DMGDH | −0.36 | −0.01 | −0.90 | −0.69 | −0.44 | 0.06 | 0.27 | 0.11 | −0.67 | −0.07 | −0.27 | 0.10 | 0.92 | 0.78 | 0.22 | 0.93 |
| DNAH6 | −0.51 | −0.38 | −0.16 | −0.32 | 0.05 | 0.09 | −0.04 | −0.33 | 0.22 | −0.11 | 0.19 | 0.25 | 0.18 | 0.19 | −0.21 | 0.87 |
| DNER | 0.22 | −0.01 | 0.44 | 0.03 | 0.22 | 0.14 | 0.05 | 0.08 | −0.05 | −0.04 | −0.05 | 0.11 | −0.29 | −0.38 | −0.31 | −0.16 |
| E2F3 | 0.32 | 0.12 | 0.23 | 0.10 | 0.22 | 0.03 | 0.05 | 0.17 | 0.03 | −0.20 | −0.19 | 0.20 | −0.13 | −0.48 | −0.22 | −0.25 |
| ECHDC2 | −0.16 | −0.03 | −0.50 | −0.15 | −0.14 | −0.47 | −0.11 | −0.20 | −0.06 | 0.14 | −0.01 | 0.16 | 0.54 | 0.43 | 0.35 | 0.22 |
| ELOVL2 | −0.20 | 0.11 | −1.06 | −0.54 | −0.26 | 0.11 | −0.06 | −0.18 | −0.06 | 0.22 | −0.27 | −0.03 | 0.55 | 0.64 | 0.57 | 0.47 |
| ENPP1 | −0.71 | −0.23 | −0.30 | −0.81 | −0.10 | −0.82 | 0.20 | 0.23 | 0.17 | −0.09 | 0.39 | −0.05 | 0.86 | 0.31 | −0.03 | 0.98 |
| EPHB1 | 0.17 | 0.28 | 0.40 | 0.17 | 0.58 | −0.26 | 0.10 | 0.39 | 0.24 | 0.08 | 0.23 | 0.07 | −0.62 | −0.50 | −0.32 | −1.04 |
| ERC2 | 0.19 | 0.02 | 0.29 | 0.17 | 0.09 | 0.10 | 0.04 | 0.02 | −0.17 | −0.11 | −0.07 | 0.10 | −0.22 | −0.12 | −0.19 | −0.13 |
| FAM135B | 0.22 | 0.01 | 0.18 | 0.18 | 0.27 | 0.04 | −0.01 | 0.02 | −0.04 | −0.09 | −0.11 | 0.08 | −0.15 | −0.17 | −0.22 | −0.22 |
| FAM46C | −0.77 | −0.50 | −0.39 | −0.49 | 0.06 | −0.44 | 0.15 | −0.22 | 0.69 | −0.03 | 0.02 | 0.27 | 0.99 | 0.37 | −0.73 | 1.02 |
| FBXL21 | 1.32 | 0.31 | 0.00 | 0.44 | −0.31 | 0.69 | −0.13 | −0.20 | 0.60 | −0.04 | −0.21 | −0.33 | −0.54 | −0.80 | −0.30 | −0.50 |
| FGF5 | −0.86 | −0.35 | −1.15 | −0.64 | 0.40 | −0.44 | −0.16 | 0.02 | 0.31 | 0.32 | 0.29 | 0.21 | 0.62 | 0.37 | 0.03 | 1.01 |
| FHOD3 | 0.15 | 0.61 | 0.29 | 0.23 | 0.09 | 0.19 | −0.13 | −0.08 | 0.10 | 0.47 | −0.23 | 0.24 | −0.56 | −0.59 | −0.30 | −0.50 |
| FKBP5 | −1.16 | 0.08 | −0.21 | −1.12 | −1.00 | −1.09 | −0.16 | −0.85 | −0.11 | −0.04 | −0.18 | −0.09 | 2.01 | 1.39 | 0.19 | 2.35 |
| FRMPD4 | 0.25 | 0.19 | 0.14 | −0.01 | 0.21 | 0.21 | 0.15 | 0.09 | −0.04 | −0.12 | −0.05 | −0.13 | −0.44 | −0.07 | −0.19 | −0.19 |
| GABBR2 | 0.14 | 0.17 | 0.18 | 0.04 | 0.18 | 0.07 | 0.01 | 0.07 | 0.05 | −0.12 | −0.10 | 0.07 | −0.32 | −0.02 | −0.17 | −0.25 |
| GALNT18 | 0.23 | 0.15 | 0.18 | 0.17 | 0.07 | 0.20 | −0.05 | 0.01 | −0.05 | −0.03 | −0.16 | 0.02 | −0.34 | 0.02 | −0.16 | −0.25 |
| GAP43 | 0.28 | 0.40 | 0.40 | −0.05 | 0.40 | 0.17 | 0.21 | 0.06 | −0.04 | −0.02 | 0.02 | 0.10 | −0.46 | −0.56 | −0.30 | −0.61 |
| GBAP1 | −0.03 | 0.73 | 0.81 | 0.59 | −0.02 | −0.17 | −0.25 | 0.21 | −0.32 | 0.27 | −0.33 | 0.05 | −0.76 | −0.34 | −0.07 | −0.37 |
| GDF11 | 0.32 | 0.27 | 0.33 | 0.16 | 0.17 | 0.16 | 0.03 | −0.06 | 0.31 | 0.06 | −0.08 | −0.05 | −0.47 | −0.16 | −0.56 | −0.43 |
| GPR161 | 0.33 | 0.11 | 0.39 | 0.35 | −0.25 | 0.06 | 0.02 | 0.13 | −0.22 | 0.01 | −0.01 | 0.18 | −0.17 | −0.40 | −0.22 | −0.33 |
| GPR63 | 0.76 | 0.30 | 0.27 | 0.62 | −0.02 | −0.21 | 0.39 | 0.47 | −0.89 | −0.08 | −0.05 | 0.19 | −0.33 | −0.89 | −0.43 | −0.11 |
| GREB1 | −0.14 | −0.21 | −0.55 | −0.23 | −0.32 | 0.11 | −0.34 | −0.21 | 0.15 | 0.18 | 0.08 | −0.10 | 0.49 | 0.57 | 0.28 | 0.24 |
| HCN4 | 0.38 | 0.66 | 0.15 | 0.37 | 0.12 | 0.17 | −0.17 | −0.15 | 0.06 | 0.09 | 0.01 | 0.07 | −0.29 | 0.05 | −0.63 | −0.88 |
| HECTD2-AS1 | −0.44 | −0.17 | 0.04 | −0.30 | −0.15 | −0.20 | −0.06 | −0.40 | −0.03 | −0.22 | 0.19 | −0.12 | −0.11 | 0.75 | 0.61 | 0.61 |
| IQSEC3 | 0.20 | 0.23 | 0.50 | 0.16 | 0.36 | 0.00 | −0.13 | 0.03 | −0.02 | 0.00 | −0.18 | 0.35 | −0.41 | −0.22 | −0.17 | −0.69 |
| KCNA4 | −0.17 | −0.44 | 0.15 | −0.51 | −0.36 | −0.24 | −0.38 | −0.52 | 0.07 | −0.13 | 0.52 | −0.28 | 0.38 | 0.27 | 0.88 | 0.75 |
| KIF26B | 0.11 | 0.42 | 0.51 | 0.12 | 0.25 | −0.01 | 0.06 | 0.09 | −0.28 | 0.01 | 0.16 | 0.23 | −0.73 | −0.37 | −0.10 | −0.47 |
| KRT222 | 0.41 | 0.12 | 0.21 | −0.05 | 0.13 | 0.58 | 0.26 | 0.23 | −0.18 | 0.03 | 0.06 | −0.11 | −0.50 | −0.59 | −0.35 | −0.25 |
| LACTB2-AS1 | −0.40 | −0.14 | −0.37 | −0.32 | −0.18 | 0.17 | −0.16 | −0.48 | −0.21 | 0.50 | 0.22 | 0.06 | −0.01 | 0.28 | 0.30 | 0.75 |
| LHFPL3 | 0.46 | 0.30 | 0.61 | 0.14 | 0.29 | 0.17 | −0.09 | −0.10 | 0.05 | −0.14 | −0.33 | −0.07 | −0.71 | −0.12 | −0.36 | −0.10 |

TABLE 46-continued

Log2 fold change of expression of genes in basket cells

| | Log2 fold change of expression Subject | | | | | | | | | | | | | | | |
|---|---|---|---|---|---|---|---|---|---|---|---|---|---|---|---|---|
| Gene | xk | tm | wo | wc | wi | pk | vm | wl | sg | or | lt | zh | ko | kq | ke | ai |
| LINC00457 | −0.43 | −0.31 | −0.87 | −0.44 | −0.40 | −0.29 | 0.21 | −0.34 | 0.74 | 0.18 | −0.36 | 0.04 | 0.37 | 0.81 | −0.03 | 1.10 |
| LINC00499 | −0.37 | −0.34 | −0.51 | −0.39 | −0.73 | −0.01 | −0.11 | −0.20 | −0.01 | −0.13 | −0.20 | −0.17 | 0.94 | 0.21 | 0.13 | 1.90 |
| LINC01158 | −0.55 | −0.06 | −0.88 | −0.37 | 0.19 | −0.65 | 0.15 | −0.24 | 0.33 | 0.38 | −0.63 | 0.40 | 0.58 | 0.37 | 0.53 | 0.45 |
| LOC105377448 | −0.64 | 0.11 | −0.52 | −0.36 | −0.24 | 0.07 | −0.29 | 0.06 | −0.29 | 0.33 | −0.18 | 0.12 | 0.93 | 0.12 | 0.40 | 0.38 |
| LOC285692 | −0.51 | −0.44 | −1.15 | −0.57 | 0.01 | −0.10 | −0.28 | 0.04 | −0.14 | 0.48 | −0.75 | 0.07 | 1.63 | 0.51 | −0.14 | 1.33 |
| LOC653602 | 0.81 | 0.36 | −0.09 | 0.03 | −0.18 | 0.58 | 0.24 | 0.21 | 0.14 | 0.24 | 0.06 | −0.09 | −0.81 | −0.47 | −0.36 | −0.70 |
| LPCAT4 | 0.28 | −0.10 | 0.51 | 0.48 | 0.53 | −0.04 | −0.04 | 0.22 | −0.03 | −0.14 | −0.30 | 0.02 | −0.43 | −0.33 | −0.08 | −0.57 |
| MARC2 | −0.27 | −0.18 | −0.34 | −0.49 | −0.33 | 0.26 | −0.25 | −0.09 | 0.15 | 0.28 | 0.01 | 0.06 | 0.25 | 0.24 | 0.28 | 0.43 |
| MARCH11 | 0.41 | 0.12 | 0.15 | 0.05 | 0.23 | 0.21 | 0.17 | 0.12 | −0.09 | −0.26 | −0.11 | −0.03 | −0.29 | −0.26 | −0.18 | −0.24 |
| MASP1 | 0.50 | −0.08 | 0.47 | 0.38 | 0.37 | 0.39 | 0.33 | −0.17 | −0.25 | 0.06 | 0.49 | −0.22 | −0.68 | −0.45 | −0.27 | −0.87 |
| MEGF10 | 0.27 | 0.13 | 0.15 | −0.06 | 0.08 | 0.27 | 0.13 | 0.05 | −0.05 | −0.16 | 0.00 | −0.06 | −0.11 | −0.27 | −0.20 | −0.15 |
| MTHFSD | 0.38 | 0.22 | 0.64 | 0.15 | 0.24 | −0.34 | −0.08 | 0.12 | −0.16 | −0.25 | −0.07 | 0.16 | −0.32 | −0.19 | −0.23 | −0.28 |
| MYRIP | −0.62 | −0.10 | −0.48 | −0.57 | 0.03 | 0.02 | 0.06 | −0.04 | 0.24 | 0.36 | −0.10 | 0.31 | −0.15 | 0.03 | 0.13 | 0.89 |
| NHS | 0.29 | 0.24 | 0.39 | 0.16 | 0.17 | −0.03 | −0.03 | 0.10 | −0.03 | 0.00 | −0.17 | 0.05 | −0.39 | −0.35 | −0.31 | −0.10 |
| NOS1 | 0.17 | 0.17 | 0.27 | 0.13 | 0.24 | 0.13 | 0.03 | −0.05 | −0.02 | −0.08 | 0.06 | −0.07 | −0.12 | −0.13 | −0.09 | −0.63 |
| NPL | −0.36 | −0.12 | −0.17 | −0.54 | −0.31 | −0.56 | 0.09 | −0.15 | −0.17 | 0.10 | 0.11 | 0.10 | 0.57 | 0.53 | 0.28 | 0.59 |
| NPY6R | −0.15 | −0.19 | −0.45 | −0.20 | −0.09 | −0.02 | −0.12 | −0.12 | −0.05 | −0.03 | 0.37 | −0.02 | 0.35 | 0.31 | 0.08 | 0.33 |
| NTNG1 | 0.77 | 0.46 | 0.12 | 0.30 | 0.19 | 0.26 | −0.03 | 0.10 | 0.06 | −0.28 | −0.54 | −0.19 | −0.54 | −0.31 | −0.09 | −0.29 |
| NXNL2 | 1.10 | −0.41 | 1.75 | 1.11 | −0.19 | −0.35 | −0.04 | −0.39 | −0.54 | −0.49 | −0.01 | −0.25 | −0.08 | −0.25 | −0.71 | −0.25 |
| PAQR6 | −0.12 | −0.33 | −0.51 | −0.18 | −0.28 | −0.40 | −0.23 | −0.16 | 0.07 | 0.15 | −0.40 | −0.16 | −0.04 | 0.92 | 1.22 | 0.46 |
| PARM1 | 0.38 | 0.26 | 1.16 | 0.42 | 0.87 | −0.34 | −0.18 | 0.29 | 0.09 | 0.39 | −0.47 | 0.00 | −1.49 | −0.49 | −0.35 | −0.55 |
| PCP4 | 0.95 | 0.96 | 0.28 | 0.85 | −0.46 | 0.49 | −0.32 | −0.33 | −0.39 | −0.05 | −0.70 | 0.60 | −0.13 | −0.67 | −0.89 | −0.18 |
| PEBP4 | −0.08 | −0.45 | −0.58 | −0.59 | −0.82 | −0.56 | −0.19 | −0.52 | 0.23 | 0.21 | 0.02 | −0.19 | 0.46 | 1.30 | 0.67 | 1.11 |
| PHACTR2-AS1 | 0.20 | 0.34 | 0.24 | −0.06 | 0.38 | 0.05 | 0.22 | 0.04 | −0.10 | −0.17 | −0.10 | 0.14 | −0.28 | −0.19 | −0.06 | −0.64 |
| PHKA1 | −0.59 | −0.22 | −0.41 | −0.46 | 0.13 | 0.13 | −0.18 | −0.20 | 0.09 | 0.36 | 0.02 | 0.11 | −0.23 | −0.18 | 0.29 | 1.34 |
| PLPPR4 | 0.40 | 0.27 | 0.31 | 0.61 | 0.31 | 0.85 | 0.62 | −0.21 | 0.21 | −0.12 | 0.18 | −0.48 | −1.41 | −0.78 | −0.70 | −0.05 |
| PLXNA4 | 0.48 | 0.46 | 0.32 | 0.35 | 0.05 | 0.25 | −0.19 | −0.11 | −0.20 | 0.01 | −0.21 | 0.10 | −0.28 | −0.25 | −0.44 | −0.35 |
| PRKCG | 0.22 | −0.02 | 0.97 | 0.25 | 0.26 | 0.11 | −0.21 | −0.05 | −0.16 | 0.23 | −0.22 | 0.01 | −0.24 | −0.30 | −0.29 | −0.57 |
| RGMB | 0.46 | 0.22 | 0.58 | 0.09 | 0.27 | 0.36 | −0.09 | 0.07 | 0.16 | 0.06 | 0.32 | −0.07 | −0.50 | −0.46 | −0.71 | −0.76 |
| RNF212 | −0.32 | −0.13 | −0.35 | −0.44 | −0.07 | −0.16 | −0.03 | −0.40 | 0.19 | 0.58 | −0.02 | 0.21 | −0.12 | 0.26 | 0.42 | 0.38 |
| RNF215 | 0.29 | 0.41 | 0.78 | 0.13 | 0.62 | −0.26 | −0.08 | 0.07 | 0.15 | −0.36 | 0.00 | −0.46 | −0.17 | −0.08 | −0.62 | −0.42 |
| RORA | 0.19 | 0.28 | 0.09 | 0.09 | 0.25 | 0.32 | 0.23 | 0.08 | 0.10 | −0.08 | −0.01 | −0.07 | −0.59 | −0.24 | −0.18 | −0.46 |
| RPH3A | 0.37 | 0.51 | 0.49 | 0.13 | 0.37 | 0.65 | −0.47 | 0.05 | 0.02 | 0.17 | −0.51 | 0.07 | −0.68 | −0.27 | −0.45 | −0.43 |
| RPS6KA5 | −0.49 | −0.17 | −0.53 | −0.35 | −0.38 | 0.27 | 0.37 | −0.37 | −0.13 | 0.27 | 0.10 | −0.09 | 0.47 | 0.03 | 0.32 | 0.67 |
| SCN2B | 0.05 | 0.49 | 0.56 | 0.08 | 0.53 | −0.13 | −0.07 | 0.22 | −0.10 | −0.05 | 0.10 | 0.01 | 0.11 | −0.41 | −0.74 | −0.65 |
| SEPSECS | −0.07 | −0.39 | −0.12 | −0.32 | 0.06 | −0.36 | −0.08 | −0.29 | 0.30 | −0.06 | 0.08 | −0.06 | 0.33 | 0.19 | 0.08 | 0.71 |
| SEPSECS-AS1 | 0.16 | −0.97 | −0.79 | −1.06 | 0.11 | 0.10 | −0.19 | 0.14 | 0.22 | 0.12 | 0.30 | 0.23 | −0.01 | 0.28 | 0.61 | 0.78 |
| SHANK1 | 0.23 | 0.01 | 0.92 | 0.43 | 0.38 | −0.04 | −0.28 | 0.05 | −0.16 | −0.11 | −0.21 | 0.22 | −0.38 | −0.15 | −0.15 | −0.76 |
| SHANK2 | 0.08 | 0.12 | 0.42 | 0.18 | 0.33 | 0.11 | −0.03 | −0.08 | −0.07 | −0.02 | −0.06 | 0.08 | −0.29 | −0.06 | −0.20 | −0.52 |
| SLC12A5 | 0.19 | 0.07 | 0.37 | 0.15 | 0.10 | −0.04 | 0.07 | 0.15 | 0.10 | 0.16 | 0.17 | −0.07 | −0.19 | −0.38 | −0.40 | −0.44 |
| SLC17A4 | −0.41 | −0.08 | −0.28 | −0.93 | 0.08 | −0.57 | −0.09 | −0.02 | 0.23 | −0.15 | 0.00 | −0.26 | 0.52 | 0.81 | −0.28 | 1.42 |
| SLC25A29 | 0.27 | 0.50 | 0.28 | 0.43 | 0.05 | −0.18 | −0.19 | 0.15 | 0.01 | −0.15 | −0.10 | 0.20 | −0.23 | −0.20 | −0.11 | −0.74 |
| SLC26A8 | −0.06 | −0.49 | −0.14 | −0.60 | −0.33 | 0.04 | −0.36 | 0.05 | −0.12 | 0.26 | 0.33 | −0.19 | 0.14 | 0.73 | 0.36 | 0.38 |
| SLC35F4 | 0.55 | 0.29 | 0.42 | 0.58 | −0.11 | 0.14 | −0.07 | 0.11 | −0.37 | 0.00 | −0.41 | 0.29 | −0.49 | −0.58 | −0.30 | −0.07 |
| SLC8A3 | 0.65 | 0.18 | 0.19 | 0.13 | 0.37 | 0.31 | −0.01 | 0.07 | −0.09 | −0.02 | −0.15 | −0.01 | −0.64 | −0.08 | −0.24 | −0.67 |
| SPARCL1 | −0.77 | −0.10 | −0.57 | −0.72 | −0.59 | −0.52 | −0.18 | −0.20 | −0.21 | 0.30 | 0.14 | −0.02 | 0.74 | 1.26 | 0.32 | 1.12 |
| SPHK2 | 0.15 | −0.02 | 0.80 | 0.68 | 0.33 | −0.27 | −0.20 | 0.06 | −0.25 | −0.09 | 0.10 | −0.07 | −0.13 | −0.23 | −0.38 | −0.49 |
| SPON2 | −0.29 | −0.33 | −0.11 | −0.56 | 0.05 | −0.21 | 0.13 | −0.26 | 0.21 | −0.34 | −0.09 | −0.31 | 0.12 | 0.45 | 0.88 | 0.67 |
| ST6GAL2 | 0.51 | 0.31 | 0.32 | 0.13 | 0.33 | 0.25 | 0.02 | 0.10 | −0.13 | −0.20 | −0.02 | −0.16 | −0.37 | −0.38 | −0.22 | −0.47 |
| ST6GALNAC5 | −0.58 | −0.85 | −1.38 | −0.75 | −0.70 | −0.75 | −0.29 | 0.23 | 0.75 | 0.25 | 0.09 | 0.54 | 0.58 | 0.52 | 0.53 | 1.79 |
| STAT5A | −0.65 | −0.39 | −0.73 | −0.24 | −0.65 | −0.32 | −0.09 | 0.21 | −0.45 | −0.06 | −0.19 | −0.66 | 1.51 | 1.76 | 0.04 | 0.91 |
| STK33 | −0.29 | 0.17 | −0.69 | −0.59 | −0.48 | −0.13 | −0.06 | −0.28 | 0.24 | 0.16 | 0.10 | 0.20 | −0.17 | 0.30 | 0.51 | 1.02 |
| SV2C | 0.22 | −0.68 | −0.22 | −0.51 | 0.04 | −0.49 | −0.65 | −0.44 | 0.20 | 0.03 | −0.10 | −0.19 | 0.73 | 0.88 | −0.05 | 1.22 |
| SYT17 | −0.91 | 0.01 | −0.50 | −0.62 | 0.37 | −0.48 | −0.53 | −0.63 | 0.39 | 0.16 | 0.31 | 0.68 | −0.26 | 0.55 | 0.76 | 0.69 |
| TEX9 | −0.39 | −0.56 | −1.01 | −0.33 | −0.63 | 0.29 | 0.20 | −0.16 | −0.08 | 0.37 | 0.17 | −0.08 | 0.30 | 0.37 | −0.10 | 1.63 |
| TFAP2B | 0.62 | 0.07 | 0.30 | 0.19 | 0.28 | 0.47 | −0.08 | 0.03 | −0.04 | −0.12 | −0.15 | 0.09 | −0.68 | −0.09 | −0.24 | −0.64 |
| THSD7B | 0.71 | 1.09 | 1.30 | 0.78 | −0.43 | 0.78 | 0.39 | 0.17 | 0.19 | −0.23 | −0.76 | 0.52 | −0.76 | −1.36 | −0.45 | −1.95 |
| TMEM178B | 0.15 | 0.14 | 0.21 | 0.02 | 0.13 | 0.03 | 0.10 | 0.10 | 0.00 | −0.13 | −0.06 | 0.05 | −0.32 | −0.07 | −0.16 | −0.20 |
| TRAF5 | 0.40 | 0.02 | 0.66 | 0.13 | −0.09 | 0.22 | 0.05 | 0.04 | −0.19 | −0.06 | −0.23 | −0.10 | −0.18 | −0.09 | −0.21 | −0.38 |
| TRIM67 | 0.54 | 0.00 | 0.33 | 0.46 | 0.17 | 0.22 | −0.17 | 0.04 | −0.09 | −0.24 | −0.25 | 0.23 | −0.61 | −0.06 | −0.29 | −0.30 |
| TTC23L | −0.28 | −0.06 | −0.54 | −0.42 | 0.00 | 0.09 | −0.20 | −0.42 | 0.03 | 0.22 | −0.14 | 0.04 | 0.37 | 0.43 | 0.31 | 0.56 |
| TUNAR | 0.73 | 0.28 | 0.47 | 0.49 | 0.29 | 0.07 | −0.65 | −0.05 | −0.21 | −0.07 | −0.44 | 0.01 | −0.24 | −0.20 | −0.20 | −0.27 |
| UBASH3B | 0.23 | 0.41 | 0.58 | 0.00 | 0.37 | −0.11 | 0.12 | 0.06 | 0.03 | −0.17 | −0.02 | 0.08 | −0.38 | −0.30 | −0.03 | −0.88 |
| UNC5D | 0.23 | 0.20 | 0.36 | −0.02 | 0.20 | 0.01 | 0.24 | −0.05 | −0.14 | −0.18 | −0.08 | 0.06 | −0.30 | −0.32 | −0.14 | −0.07 |
| ZNF124 | −0.59 | −0.10 | −0.02 | −0.16 | −0.31 | 0.00 | −0.18 | −0.14 | −0.11 | −0.31 | −0.23 | 0.29 | 0.54 | 0.33 | 0.34 | 0.64 |
| ZYG11A | −0.68 | −0.08 | −0.28 | −0.47 | −0.11 | −0.33 | −0.28 | 0.04 | 0.51 | 0.36 | 0.03 | 0.05 | 0.23 | 0.71 | −0.04 | 0.35 |

The RNAseq results for the differentially expressed genes (adjusted p<0.01, baseMean>50) in basket cells across all samples is shown in Table 47.

TABLE 47

Differentially expressed genes in basket cells across all samples

| Gene | Base Mean | Log2 Change | p-value | p-adj |
|---|---|---|---|---|
| RORA | 329335.261 | −0.013 | 4.09E−06 | 1.41E−03 |
| FRMPD4 | 61047.625 | −0.010 | 2.01E−05 | 4.10E−03 |
| UNC5D | 46606.506 | −0.010 | 7.14E−05 | 8.17E−03 |
| ADGRL3 | 36661.187 | −0.011 | 2.59E−05 | 4.56E−03 |
| CADPS | 34807.226 | −0.011 | 3.51E−06 | 1.29E−03 |
| BTBD11 | 33267.028 | −0.009 | 1.09E−05 | 2.65E−03 |
| CACNA1D | 33174.962 | −0.007 | 5.34E−05 | 6.73E−03 |
| SHANK2 | 27271.658 | −0.011 | 5.02E−05 | 6.47E−03 |
| MARCH11 | 25430.282 | −0.012 | 3.05E−07 | 1.98E−04 |
| ASIC2 | 24222.474 | −0.023 | 4.63E−09 | 7.83E−06 |
| DNER | 21146.088 | −0.011 | 2.15E−05 | 4.19E−03 |
| ERC2 | 21084.069 | −0.008 | 2.76E−05 | 4.68E−03 |
| GALNT18 | 18181.019 | −0.009 | 3.47E−05 | 5.52E−03 |
| LHFPL3 | 17505.419 | −0.016 | 4.33E−06 | 1.46E−03 |
| CACNB4 | 17319.515 | −0.012 | 8.89E−09 | 1.37E−05 |
| PLXNA4 | 16464.759 | −0.017 | 6.77E−10 | 1.43E−06 |
| MEGF10 | 15961.668 | −0.008 | 1.01E−04 | 9.92E−03 |
| CACNA2D3 | 15563.645 | 0.056 | 2.62E−17 | 4.43E−13 |
| FAM135B | 13722.346 | −0.008 | 1.45E−05 | 3.30E−03 |
| GABBR2 | 12619.017 | −0.008 | 7.93E−05 | 8.65E−03 |
| UBASH3B | 11127.363 | −0.016 | 9.47E−06 | 2.40E−03 |
| NOS1 | 9457.029 | −0.010 | 8.23E−05 | 8.85E−03 |
| FHOD3 | 9184.114 | −0.016 | 9.66E−05 | 9.83E−03 |
| EPHB1 | 9178.939 | −0.019 | 5.50E−05 | 6.74E−03 |
| DGKH | 8792.452 | −0.013 | 2.15E−07 | 1.58E−04 |
| SLC8A3 | 8748.612 | −0.017 | 4.19E−07 | 2.53E−04 |
| TMEM178B | 8437.776 | −0.008 | 3.51E−05 | 5.52E−03 |
| NHS | 6608.789 | −0.012 | 6.00E−08 | 6.34E−05 |
| ST6GAL2 | 5752.944 | −0.017 | 2.90E−14 | 1.63E−10 |
| ARHGEF10L | 5712.202 | −0.010 | 5.11E−05 | 6.55E−03 |
| SLC12A5 | 5584.536 | −0.012 | 3.85E−05 | 5.73E−03 |
| RPH3A | 5375.584 | −0.020 | 6.48E−06 | 1.82E−03 |
| SLC35F4 | 5210.716 | −0.018 | 6.43E−06 | 1.82E−03 |
| THSD7B | 5096.653 | −0.046 | 2.52E−10 | 6.08E−07 |
| TFAP2B | 4968.006 | −0.017 | 2.71E−06 | 1.02E−03 |
| PRKCG | 4856.433 | −0.017 | 2.93E−05 | 4.90E−03 |
| IQSEC3 | 4704.333 | −0.014 | 6.89E−05 | 8.03E−03 |
| TRIM67 | 4700.260 | −0.015 | 2.21E−05 | 4.20E−03 |
| SHANK1 | 4236.325 | −0.018 | 3.74E−05 | 5.64E−03 |
| NTNG1 | 4180.841 | −0.018 | 2.64E−07 | 1.86E−04 |
| ADD2 | 3972.399 | −0.009 | 2.77E−05 | 4.68E−03 |
| C4orf22 | 3964.435 | 0.029 | 5.07E−08 | 5.71E−05 |
| CADM3 | 3945.047 | −0.013 | 6.41E−05 | 7.68E−03 |
| KIF26B | 3802.618 | −0.015 | 2.98E−05 | 4.94E−03 |
| ADAMTS2 | 3668.272 | −0.021 | 7.10E−08 | 7.06E−05 |
| DISP3 | 2826.472 | −0.014 | 1.94E−06 | 7.94E−04 |
| ASIC1 | 2581.734 | −0.022 | 1.45E−10 | 4.08E−07 |
| CLSTN3 | 2169.950 | −0.016 | 1.74E−05 | 3.77E−03 |
| DLG4 | 2165.740 | −0.016 | 8.27E−05 | 8.85E−03 |
| DLG1 | 1987.619 | 0.018 | 4.83E−05 | 6.47E−03 |
| GAP43 | 1873.289 | −0.018 | 1.00E−08 | 1.41E−05 |
| GPR161 | 1857.336 | −0.012 | 2.18E−05 | 4.19E−03 |
| ECHDC2 | 1823.789 | 0.014 | 9.51E−06 | 2.40E−03 |
| PHACTR2-AS1 | 1789.213 | −0.012 | 7.64E−05 | 8.49E−03 |
| E2F3 | 1603.013 | −0.011 | 2.54E−05 | 4.55E−03 |
| MYRIP | 1564.146 | 0.018 | 6.76E−05 | 7.94E−03 |
| RPS6KA5 | 1280.007 | 0.017 | 4.92E−05 | 6.47E−03 |
| ADAMTS9 | 1075.470 | −0.028 | 1.96E−06 | 7.94E−04 |
| RGMB | 1072.126 | −0.021 | 1.53E−07 | 1.23E−04 |
| TUNAR | 929.869 | −0.017 | 4.71E−05 | 6.47E−03 |
| PLPPR4 | 910.096 | −0.026 | 7.63E−05 | 8.49E−03 |
| LOC653602 | 876.620 | −0.021 | 1.34E−05 | 3.14E−03 |
| KRT222 | 871.255 | −0.016 | 1.72E−05 | 3.77E−03 |
| LPCAT4 | 754.741 | −0.017 | 5.12E−06 | 1.57E−03 |
| MASP1 | 722.999 | −0.021 | 9.89E−06 | 2.46E−03 |
| TRAF5 | 666.436 | −0.014 | 1.51E−05 | 3.35E−03 |
| ADAMTSL3 | 659.193 | 0.020 | 6.24E−07 | 3.29E−04 |
| NPL | 636.916 | 0.019 | 1.27E−07 | 1.08E−04 |
| ENPP1 | 631.265 | 0.026 | 2.45E−06 | 9.62E−04 |
| ALS2CR11 | 608.480 | 0.019 | 3.87E−05 | 5.73E−03 |

TABLE 47-continued

Differentially expressed genes in basket cells across all samples

| Gene | Base Mean | Log2 Change | p-value | p-adj |
|---|---|---|---|---|
| LOC285692 | 593.698 | 0.038 | 1.16E−07 | 1.03E−04 |
| ACER3 | 516.515 | 0.019 | 6.18E−07 | 3.29E−04 |
| TEX9 | 507.648 | 0.031 | 1.42E−06 | 6.29E−04 |
| SPARCL1 | 482.042 | 0.035 | 1.28E−11 | 5.42E−08 |
| DNAH6 | 452.114 | 0.017 | 5.40E−05 | 6.74E−03 |
| CALR | 447.022 | −0.023 | 7.00E−06 | 1.92E−03 |
| LINC00457 | 433.253 | 0.029 | 2.14E−07 | 1.58E−04 |
| LINC01158 | 428.457 | 0.022 | 3.53E−05 | 5.52E−03 |
| GREB1 | 412.201 | 0.017 | 6.99E−07 | 3.58E−04 |
| CYYR1 | 391.236 | 0.020 | 1.89E−05 | 3.90E−03 |
| ST6GALNAC5 | 391.080 | 0.049 | 6.41E−15 | 5.41E−11 |
| DCC | 380.998 | 0.032 | 2.18E−05 | 4.19E−03 |
| STK33 | 380.653 | 0.021 | 2.63E−05 | 4.59E−03 |
| HCN4 | 341.112 | −0.018 | 2.45E−05 | 4.50E−03 |
| TTC23L | 341.095 | 0.018 | 3.21E−07 | 2.01E−04 |
| SCN2B | 327.526 | −0.018 | 9.11E−05 | 9.39E−03 |
| FGF5 | 318.878 | 0.031 | 1.39E−08 | 1.81E−05 |
| SLC25A29 | 309.817 | −0.016 | 2.56E−05 | 4.55E−03 |
| SLC26A8 | 298.198 | 0.018 | 1.89E−05 | 3.90E−03 |
| PCP4 | 295.208 | −0.027 | 1.02E−04 | 9.92E−03 |
| ZNF124 | 293.931 | 0.017 | 7.07E−05 | 8.17E−03 |
| C14orf1 | 284.530 | −0.012 | 3.47E−05 | 5.52E−03 |
| ATP6V0B | 278.929 | −0.021 | 3.70E−05 | 5.64E−03 |
| AKAP13 | 271.132 | 0.021 | 2.73E−06 | 1.02E−03 |
| LOC105377448 | 269.320 | 0.020 | 8.34E−05 | 8.86E−03 |
| ELOVL2 | 269.171 | 0.021 | 3.72E−05 | 5.64E−03 |
| GDF11 | 259.292 | −0.016 | 4.81E−06 | 1.53E−03 |
| FKBP5 | 245.242 | 0.054 | 1.41E−05 | 3.26E−03 |
| SLC17A4 | 240.415 | 0.028 | 2.11E−05 | 4.19E−03 |
| CFAP46 | 234.408 | 0.019 | 7.15E−05 | 8.17E−03 |
| SEPSECS-AS1 | 233.299 | 0.024 | 7.38E−05 | 8.37E−03 |
| SPHK2 | 199.137 | −0.019 | 4.66E−05 | 6.47E−03 |
| SEPSECS | 195.301 | 0.016 | 8.10E−05 | 8.77E−03 |
| CA7 | 193.559 | −0.018 | 4.89E−05 | 6.47E−03 |
| MTHFSD | 171.780 | −0.016 | 4.28E−05 | 6.13E−03 |
| C11orf87 | 161.139 | −0.037 | 7.92E−11 | 2.68E−07 |
| PAQR6 | 159.437 | 0.026 | 1.33E−05 | 3.14E−03 |
| SV2C | 156.283 | 0.027 | 8.76E−05 | 9.16E−03 |
| PEBP4 | 155.122 | 0.037 | 3.22E−09 | 6.05E−06 |
| NPY6R | 138.962 | 0.015 | 1.10E−05 | 2.65E−03 |
| DBH | 136.969 | −0.018 | 4.02E−05 | 5.86E−03 |
| GBAP1 | 130.842 | −0.023 | 4.59E−05 | 6.47E−03 |
| PARM1 | 123.887 | −0.034 | 3.47E−05 | 5.52E−03 |
| NXNL2 | 117.958 | −0.036 | 4.78E−05 | 6.47E−03 |
| ALOX5 | 112.642 | 0.026 | 7.49E−06 | 1.99E−03 |
| RNF215 | 111.104 | −0.022 | 4.52E−05 | 6.41E−03 |
| SPON2 | 109.953 | 0.023 | 3.03E−05 | 4.98E−03 |
| FBXL21 | 109.841 | −0.031 | 3.59E−05 | 5.57E−03 |
| LACTB2-AS1 | 100.333 | 0.021 | 2.75E−05 | 4.68E−03 |
| DDO | 100.015 | 0.026 | 1.97E−06 | 7.94E−04 |
| CPNE8 | 95.089 | 0.026 | 3.96E−05 | 5.82E−03 |
| GPR63 | 93.412 | −0.026 | 1.01E−04 | 9.92E−03 |
| HECTD2-AS1 | 90.251 | 0.021 | 8.61E−05 | 9.10E−03 |
| DMGDH | 86.861 | 0.031 | 5.27E−05 | 6.70E−03 |
| ACSS3 | 82.085 | 0.040 | 7.61E−05 | 8.49E−03 |
| PHKA1 | 80.159 | 0.028 | 5.79E−05 | 7.04E−03 |
| ARHGEF6 | 77.670 | 0.031 | 3.69E−06 | 1.32E−03 |
| CNTN3 | 73.987 | 0.029 | 5.68E−07 | 3.20E−04 |
| BMP3 | 64.437 | 0.033 | 3.75E−06 | 1.32E−03 |
| LINC00499 | 64.160 | 0.044 | 2.86E−07 | 1.93E−04 |
| CDK15 | 63.210 | 0.043 | 4.68E−05 | 6.47E−03 |
| FAM46C | 61.914 | 0.038 | 4.67E−06 | 1.52E−03 |
| MARC2 | 60.031 | 0.021 | 4.40E−06 | 1.46E−03 |
| ZYG11A | 58.807 | 0.026 | 1.49E−05 | 3.35E−03 |
| STAT5A | 58.388 | 0.053 | 4.61E−07 | 2.68E−04 |

755

TABLE 47-continued

Differentially expressed genes in basket cells across all samples

| Gene | Base Mean | Log2 Change | p-value | p-adj |
|---|---|---|---|---|
| KCNA4 | 56.857 | 0.028 | 6.05E−05 | 7.30E−03 |
| C9orf135 | 53.429 | 0.032 | 9.81E−05 | 9.90E−03 |
| RNF212 | 51.986 | 0.022 | 6.47E−05 | 7.71E−03 |
| SYT17 | 51.828 | 0.037 | 5.49E−05 | 6.74E−03 |

The RNAseq results for the 31 genes in glia having significantly altered expression with age are shown in Table 48. The log 2 fold change for the sorted nuclei from glia (astrocytes and oligodendrocytes) from each human sample compared to the normalized expression data from sorted glia from all samples are shown in Table 48. Negative values indicate reduced expression in the nuclei of the subject compared to the normalized value across nuclei from all samples, and a positive value indicates increased expression compared to the normalized value across nuclei from all cell types analyzed.

756

RNAseq results for the differentially expressed genes (adjusted p<0.01, baseMean>50) in glia cells across all samples is shown in Table 49.

TABLE 49

Differentially expressed genes in glia across all samples

| Gene | baseMean | Log2 Fold Change | p-value | p-adj |
|---|---|---|---|---|
| LINC00499 | 1007.858 | 0.081 | 2.49E−06 | 2.89E−03 |
| TRDN | 681.94 | 0.063 | 8.98E−06 | 6.03E−03 |
| ANKRD33B | 60.594 | 0.043 | 1.03E−06 | 1.79E−03 |
| EGF | 58.431 | 0.04 | 4.16E−07 | 1.03E−03 |
| LINC01208 | 2713.563 | 0.038 | 1.63E−07 | 5.65E−04 |
| TXNIP | 514.271 | 0.036 | 1.73E−05 | 9.40E−03 |
| SLIT2 | 1055.584 | 0.033 | 1.56E−05 | 8.74E−03 |
| VWA5A | 192.057 | 0.029 | 1.87E−05 | 9.40E−03 |
| LINC00844 | 119.148 | 0.028 | 4.41E−06 | 4.51E−03 |
| AOX1 | 321.131 | 0.027 | 1.80E−05 | 9.40E−03 |
| CAPN9 | 196.571 | 0.025 | 9.02E−06 | 6.03E−03 |
| CRTAC1 | 533.293 | −0.021 | 1.49E−05 | 8.62E−03 |

TABLE 48

Log2 fold change of expression of genes in glia

| Gene | xk | tm | wi | pk | vm | wl | sg | or | lt | zh | ko | kq | ke | ai |
|---|---|---|---|---|---|---|---|---|---|---|---|---|---|---|
| ADAMTS7 | 1.20 | −0.13 | 0.48 | 0.44 | 0.02 | −0.19 | 0.28 | 0.17 | −0.07 | 0.00 | −0.32 | −0.89 | −0.52 | −0.48 |
| ANKRD33B | −0.95 | −0.39 | −0.16 | −0.07 | −0.32 | −0.16 | −0.57 | −0.15 | −0.25 | 0.24 | 1.25 | 0.52 | 0.32 | 0.69 |
| AOX1 | −0.65 | −0.62 | −0.45 | −0.12 | −0.01 | −0.20 | −0.14 | 0.69 | 0.21 | −0.12 | 0.65 | 0.79 | 0.03 | −0.06 |
| C1orf95 | 0.16 | 0.83 | 0.67 | 0.96 | 0.01 | −0.23 | 0.51 | 0.02 | −0.08 | −0.13 | −0.56 | −0.99 | −0.14 | −1.02 |
| CACNG4 | 0.52 | 0.27 | 0.28 | 0.66 | −0.11 | 0.12 | 0.32 | 0.12 | −0.08 | 0.02 | −0.67 | −0.29 | −0.27 | −0.89 |
| CACNG8 | 0.96 | 0.78 | 0.27 | 0.94 | 0.71 | −0.19 | 0.35 | 0.09 | −0.78 | −0.46 | −0.74 | −0.78 | −0.73 | −0.43 |
| CAPN9 | −0.52 | −0.18 | −0.24 | −0.38 | −0.36 | −0.12 | −0.23 | 0.08 | −0.03 | 0.14 | 0.21 | 0.96 | 0.03 | 0.64 |
| CRTAC1 | 0.46 | 0.47 | 0.33 | 0.36 | −0.32 | 0.27 | 0.09 | 0.15 | −0.14 | −0.09 | −0.51 | −0.65 | −0.01 | −0.41 |
| DACH1 | 0.45 | 0.90 | 0.96 | 0.93 | 0.55 | 0.36 | −0.13 | −1.16 | −0.29 | −0.55 | −1.04 | −0.28 | −0.57 | −0.14 |
| EFHD2 | 0.88 | 0.44 | 0.35 | 0.13 | −0.09 | −0.09 | 0.39 | −0.04 | −0.10 | 0.05 | −0.23 | −0.73 | −0.13 | −0.81 |
| EGF | −0.98 | −0.28 | −0.42 | 0.13 | −0.30 | −0.24 | −0.36 | −0.01 | 0.11 | −0.12 | 0.72 | 0.59 | 0.18 | 0.98 |
| ETS1 | 0.60 | 0.45 | 0.12 | 0.37 | 0.08 | 0.17 | 0.11 | −0.23 | −0.12 | 0.24 | −0.31 | −0.92 | −0.19 | −0.36 |
| FRAS1 | 1.29 | 1.66 | 0.31 | 0.05 | 0.03 | 0.37 | −0.47 | −0.54 | −0.79 | −0.47 | −0.70 | −0.64 | −0.17 | 0.07 |
| IMPA2 | 0.63 | 0.54 | 0.17 | 0.01 | 0.44 | 0.32 | −0.60 | −0.07 | −0.17 | 0.13 | −0.56 | −0.23 | −0.45 | −0.15 |
| LINC00499 | −0.96 | −1.27 | −0.35 | −0.56 | −0.55 | −1.12 | 1.50 | −0.17 | −0.98 | −0.63 | 2.26 | −0.20 | −0.14 | 3.16 |
| LINC00844 | −0.41 | −0.35 | −0.36 | −0.22 | −0.14 | −0.14 | −0.20 | 0.11 | 0.01 | −0.42 | 0.62 | 0.77 | −0.03 | 0.76 |
| LINC01208 | −1.15 | −0.50 | −0.23 | −0.82 | 0.32 | −0.43 | −0.44 | −0.19 | 0.19 | 0.28 | 0.53 | 1.15 | 0.15 | 1.12 |
| LOC101927078 | 0.88 | 0.61 | 0.28 | 0.41 | 0.45 | 0.85 | 0.04 | −0.04 | −0.35 | 0.34 | −1.73 | −0.80 | −0.67 | −0.28 |
| LOC102724360 | 0.98 | 0.93 | 0.31 | 0.88 | 0.01 | −0.22 | 0.60 | −0.69 | −0.59 | −0.13 | −0.57 | −0.67 | −0.06 | −0.78 |
| PKDCC | 0.85 | 0.69 | 0.91 | 0.11 | −0.46 | 0.43 | −0.14 | −0.02 | −0.43 | 0.68 | −0.69 | −0.71 | −0.55 | −0.67 |
| PLXNA4 | 0.37 | 0.52 | 0.51 | 0.55 | −0.31 | −0.08 | 0.31 | −0.12 | −0.01 | 0.07 | −0.40 | −0.69 | −0.20 | −0.52 |
| PRR5 | 0.83 | 0.82 | 0.56 | 0.03 | −0.20 | 0.28 | 0.18 | −0.31 | −0.40 | 0.09 | −0.86 | −0.37 | −0.12 | −0.55 |
| RHCG | 0.57 | 0.44 | 0.14 | 0.68 | −0.39 | 0.40 | 0.05 | 0.24 | 0.33 | −0.43 | −0.40 | −0.45 | −0.55 | −0.62 |
| ROBO2 | 2.13 | 2.13 | 0.86 | 1.11 | 0.55 | 1.02 | −0.56 | −1.59 | −0.08 | −0.89 | −0.62 | −1.77 | −1.38 | −0.89 |
| SEMA5B | 0.62 | 0.56 | 0.63 | 0.74 | −0.56 | 0.28 | 0.58 | −0.07 | −0.11 | −0.10 | −0.72 | −0.95 | −0.18 | −0.72 |
| SHROOM2 | 0.57 | 0.65 | 0.22 | 0.38 | −0.36 | 0.05 | 0.15 | −0.03 | −0.06 | 0.13 | −0.85 | −0.43 | −0.22 | −0.22 |
| SLIT2 | −0.89 | −0.81 | −0.86 | −0.25 | 0.17 | 0.00 | 0.03 | 0.28 | 0.79 | 0.27 | −0.31 | 0.48 | 1.07 | 0.04 |
| TRDN | −1.52 | −0.76 | −0.92 | 0.09 | 0.19 | −0.51 | −0.22 | −0.20 | −0.42 | 0.46 | −0.05 | 2.22 | −0.55 | 2.19 |
| TXNIP | −0.91 | −0.21 | −0.26 | −0.13 | −0.29 | −0.30 | −0.25 | −0.30 | −0.08 | −0.19 | −0.33 | 1.56 | 0.44 | 1.24 |
| VWA5A | −0.46 | −0.57 | −0.19 | −0.03 | −0.11 | −0.21 | −0.15 | −0.08 | 0.04 | −0.28 | 1.15 | 0.13 | −0.12 | 0.90 |
| WNT7B | 0.36 | 0.73 | 0.51 | 0.65 | 0.21 | −0.25 | 0.21 | −0.08 | −0.14 | 0.03 | −0.92 | −0.70 | −0.10 | −0.50 |

TABLE 49-continued

Differentially expressed genes in glia across all samples

| Gene | baseMean | Log2 Fold Change | p-value | p-adj |
|---|---|---|---|---|
| PLXNA4 | 1899.075 | −0.022 | 1.95E−05 | 9.40E−03 |
| ETS1 | 688.087 | −0.022 | 1.55E−06 | 2.15E−03 |
| SHROOM2 | 294.202 | −0.023 | 1.91E−05 | 9.40E−03 |
| CACNG4 | 2522.614 | −0.024 | 7.83E−06 | 6.03E−03 |
| RHCG | 305.832 | −0.027 | 8.29E−06 | 6.03E−03 |
| IMPA2 | 61.909 | −0.028 | 4.84E−06 | 4.68E−03 |
| WNT7B | 266.308 | −0.029 | 1.61E−06 | 2.15E−03 |
| ADAMTS7 | 304.863 | −0.03 | 5.79E−06 | 5.04E−03 |
| EFHD2 | 64.367 | −0.031 | 8.49E−06 | 6.03E−03 |
| SEMA5B | 561.896 | −0.032 | 9.46E−06 | 6.09E−03 |
| PRR5 | 144.719 | −0.032 | 9.78E−08 | 4.25E−04 |
| C1orf95 | 477.416 | −0.034 | 1.01E−05 | 6.29E−03 |
| DACH1 | 751.135 | −0.036 | 1.12E−05 | 6.72E−03 |
| LOC101927078 | 692.246 | −0.039 | 2.03E−06 | 2.52E−03 |
| FRAS1 | 335.281 | −0.039 | 5.39E−06 | 4.93E−03 |
| CACNG8 | 504.043 | −0.041 | 3.68E−06 | 3.20E−03 |
| LOC102724360 | 92.952 | −0.041 | 3.44E−06 | 3.74E−03 |
| PKDCC | 81.676 | −0.042 | 8.67E−07 | 1.67E−03 |
| ROBO2 | 1689.394 | −0.079 | 5.11E−17 | 8.88E−13 |

Results showed less variation in expression due to age compared to genes having differential expression due to the other clinical attributes analyzed herein. Previous studies of aging in the cerebellum had found fewer genes to have differential expression suggesting that profiling gene expression in the nuclei of specific cell types provides much more sensitivity compared to using bulk tissue.

Example 21

Overlapping Changes in Differential Expression Due to Age

The differentially expressed genes (adjusted p<0.01, baseMean>50) were about equally split between those that increase in expression and those that decrease in expression with age as shown in Table 50. Table 50 shows the number of genes that are in common between eight groups of differentially expressed aging genes.

TABLE 50

Number of genes with overlapping changes in expression

| | All up | Granule up | Basket up | Glia up | All down | Granule down | Basket down | Glia down |
|---|---|---|---|---|---|---|---|---|
| All up | 12 | 2 | 2 | 2 | 0 | 0 | 0 | 0 |
| Granule up | 2 | 103 | 7 | 1 | 0 | 0 | 0 | 0 |
| Basket up | 2 | 7 | 60 | 1 | 0 | 0 | 0 | 0 |
| Glia up | 2 | 1 | 1 | 1 | 0 | 0 | 0 | 0 |
| All down | 0 | 0 | 0 | 0 | 30 | 7 | 3 | 0 |
| Granule down | 0 | 0 | 0 | 0 | 7 | 171 | 8 | 2 |
| Basket down | 0 | 0 | 0 | 0 | 3 | 8 | 79 | 1 |
| Glia down | 0 | 0 | 0 | 0 | 0 | 2 | 1 | 20 |

No overlaps were found between age up-regulated genes from any cell type and down-regulated genes from any other cell type.

Expression of only a few genes significantly change with age in more than one cell type. For example, the 42 genes that are identified as differentially expressed with age across all cell types appear heterogeneous across conditions, and most of these do not reach significance when tested in each cell type individually (Table 51).

TABLE 51

Genes with differential expression across all samples

| Gene | baseMean | log2 Fold Change | p-value | p-adj |
|---|---|---|---|---|
| LINC00499 | 340.71 | 0.07 | 3.61E−11 | 6.82E−07 |
| TRDN | 216.05 | 0.06 | 6.35E−07 | 1.20E−03 |
| CACNA2D3 | 7555.87 | 0.04 | 3.19E−06 | 3.37E−03 |
| PRSS55 | 115.56 | 0.03 | 6.23E−06 | 4.90E−03 |
| LOC101927592 | 70.01 | 0.02 | 1.63E−05 | 6.98E−03 |
| ZNF404 | 138.97 | 0.02 | 1.61E−05 | 6.98E−03 |
| LOC100506990 | 1233.04 | 0.01 | 1.76E−06 | 2.37E−03 |
| MTRF1 | 184.51 | 0.01 | 2.65E−05 | 9.46E−03 |
| ZNF585A | 648.16 | 0.01 | 9.81E−07 | 1.62E−03 |
| ZNF607 | 335.61 | 0.01 | 1.98E−06 | 2.49E−03 |
| ZNF84 | 1094.03 | 0.01 | 7.63E−06 | 5.39E−03 |
| ZSCAN29 | 197.53 | 0.01 | 1.33E−06 | 1.94E−03 |
| ATF6B | 389.47 | −0.01 | 7.71E−06 | 5.39E−03 |
| CUL7 | 224.23 | −0.01 | 2.21E−05 | 8.53E−03 |
| GPR107 | 1554.09 | −0.01 | 2.30E−05 | 8.70E−03 |
| KLHL22 | 1099.58 | −0.01 | 2.07E−05 | 8.17E−03 |
| PPP6R2 | 1793.04 | −0.01 | 1.31E−05 | 6.17E−03 |
| SPHK2 | 205.56 | −0.01 | 1.19E−05 | 6.15E−03 |
| ST3GAL2 | 646.6 | −0.01 | 1.94E−05 | 8.14E−03 |
| TAOK2 | 509.4 | −0.01 | 3.50E−06 | 3.48E−03 |
| ZNF496 | 628.69 | −0.01 | 1.20E−05 | 6.15E−03 |
| ZNF580 | 79.81 | −0.01 | 2.52E−05 | 9.32E−03 |
| ABCC10 | 189.96 | −0.02 | 9.81E−06 | 5.65E−03 |
| ACAP3 | 331.85 | −0.02 | 3.03E−07 | 8.19E−04 |
| ACHE | 78.69 | −0.02 | 1.31E−05 | 6.17E−03 |
| ATP6V0B | 219.38 | −0.02 | 5.91E−06 | 4.90E−03 |
| DNAJB5 | 393.29 | −0.02 | 1.03E−06 | 1.62E−03 |
| FZR1 | 202.22 | −0.02 | 2.57E−05 | 9.32E−03 |
| GBAP1 | 129.18 | −0.02 | 8.64E−06 | 5.65E−03 |
| GRK5 | 940.31 | −0.02 | 1.48E−05 | 6.66E−03 |
| KCTD21-AS1 | 57.46 | −0.02 | 1.23E−05 | 6.15E−03 |
| LOC100132077 | 54.79 | −0.02 | 9.56E−06 | 5.65E−03 |
| MIR9-3HG | 1566.54 | −0.02 | 5.20E−06 | 4.90E−03 |
| MPND | 61.58 | −0.02 | 6.20E−06 | 4.90E−03 |
| POLR2J3 | 137.56 | −0.02 | 2.08E−05 | 8.17E−03 |
| SNAI3-AS1 | 97.33 | −0.02 | 8.86E−06 | 5.65E−03 |
| ZFPM1 | 386.55 | −0.02 | 1.39E−05 | 6.38E−03 |
| PTMS | 230.79 | −0.03 | 9.87E−06 | 5.65E−03 |
| WASH7P | 52.51 | −0.03 | 2.02E−07 | 6.37E−04 |
| RNF17 | 117.06 | −0.05 | 9.14E−08 | 3.45E−04 |
| LINGO2 | 7101.71 | −0.07 | 1.14E−05 | 6.15E−03 |
| EGR1 | 470.89 | −0.08 | 9.80E−06 | 5.65E−03 |

The RNAseq results in granule cells for the 42 genes having differential expression with age across the three cell types are shown in Table 52. The log 2 fold change of expression for the sorted nuclei from glia from each human sample compared to normalized expression from sorted nuclei from granule cells in all samples are shown in Table 52. Negative values indicate reduced expression in the nuclei of the subject compared to the normalized value across nuclei from all samples, and a positive value indicates increased expression compared to the normalized value across nuclei from all cell types analyzed.

TABLE 52

Log2 fold change of expression in granule cells

| Gene | | | | | | Log2 fold change of expression Subject | | | | | | | | | | |
|---|---|---|---|---|---|---|---|---|---|---|---|---|---|---|---|---|
| | xk | tm | wo | wc | wi | pk | vm | wl | sg | or | lt | zh | ko | kq | ke | ai |
| ABCC10 | 0.28 | 0.42 | 0.56 | 0.42 | 0.08 | −0.42 | 0.09 | 0.16 | −0.08 | 0.33 | −0.54 | −0.10 | −0.13 | −0.11 | −0.27 | −0.55 |
| ACAP3 | 0.34 | 0.76 | 1.34 | 1.05 | 0.61 | 0.06 | −0.04 | 0.06 | 0.10 | 0.52 | −0.46 | −0.08 | −0.12 | −0.14 | −0.10 | −0.27 |
| ACHE | 0.20 | 0.69 | 1.15 | 0.59 | 0.28 | −0.07 | 0.03 | −0.21 | 0.11 | 0.29 | −0.22 | 0.10 | −0.04 | −0.67 | −0.27 | −0.54 |
| ATF6B | −0.06 | 0.18 | 0.90 | 0.54 | −0.03 | −0.43 | −0.25 | −0.28 | −0.18 | 0.10 | −0.41 | −0.43 | −0.08 | −0.15 | −0.22 | −0.79 |
| ATP6V0B | 0.32 | −0.51 | 0.28 | 0.20 | 0.10 | −0.33 | −0.31 | −0.23 | −0.30 | −0.10 | −0.16 | −0.29 | −0.38 | −1.07 | −0.44 | −0.85 |
| CACNA2D3 | −1.28 | −1.71 | −2.06 | −1.52 | −1.65 | −0.66 | −1.31 | −1.39 | −0.33 | −1.09 | −1.27 | −0.99 | −0.90 | −0.46 | −1.33 | −0.38 |
| CUL7 | 0.35 | 0.56 | 0.71 | 0.45 | 0.20 | 0.09 | 0.08 | 0.27 | 0.24 | 0.30 | −0.27 | −0.36 | 0.06 | 0.06 | 0.06 | −0.44 |
| DNAJB5 | 0.28 | 0.87 | 0.54 | 0.14 | 0.43 | −0.24 | 1.05 | 0.08 | 0.08 | −0.16 | −0.31 | 0.63 | −0.28 | 0.07 | −0.14 | −0.33 |
| EGR1 | 0.47 | 0.56 | 1.28 | −0.02 | 5.30 | −0.36 | 6.92 | 0.85 | 1.00 | 0.72 | 0.85 | 4.75 | −0.85 | 0.31 | 0.33 | −0.65 |
| FZR1 | −0.02 | 0.83 | 0.93 | 0.62 | 0.52 | −0.42 | −0.02 | −0.20 | 0.00 | 0.33 | −0.10 | 0.18 | 0.04 | −0.11 | −0.07 | −0.66 |
| GBAP1 | −0.01 | 0.71 | −0.04 | −0.18 | −0.07 | −0.59 | −0.86 | −0.10 | −0.30 | −0.10 | −0.50 | −0.19 | −1.06 | −0.46 | 0.20 | −0.40 |
| GPR107 | 0.01 | 0.32 | 0.29 | 0.05 | −0.04 | 0.15 | 0.03 | 0.06 | 0.03 | 0.10 | 0.02 | 0.03 | 0.04 | −0.10 | −0.02 | −0.45 |
| GRK5 | 1.10 | 0.66 | 1.19 | 1.13 | 0.41 | 0.72 | 0.61 | 0.24 | 0.08 | 0.16 | 0.50 | 0.64 | −0.28 | −0.38 | 0.35 | −0.66 |
| KCTD21-AS1 | 0.02 | 0.69 | 0.08 | 0.14 | −0.61 | −0.04 | −0.40 | −0.02 | −0.01 | −0.58 | −0.33 | −1.31 | −0.11 | −1.44 | −0.27 | −0.66 |
| KLHL22 | 0.25 | 0.46 | 0.62 | 0.55 | 0.06 | 0.06 | −0.31 | 0.04 | 0.05 | 0.17 | 0.04 | −0.17 | −0.30 | 0.12 | 0.05 | −0.21 |
| LINC00499 | −0.17 | −0.40 | −1.13 | −1.05 | −0.76 | −0.14 | 0.13 | −0.20 | −0.10 | −0.09 | −0.38 | −0.09 | 0.44 | 0.45 | −0.03 | 0.33 |
| LINGO2 | 0.51 | 4.67 | 3.73 | −0.63 | 0.51 | 1.24 | 4.72 | 5.21 | 4.23 | 3.85 | 0.91 | 0.87 | −1.68 | −0.69 | −0.85 | 0.15 |
| LOC100132077 | 0.20 | 0.10 | 0.89 | 0.97 | −0.39 | −0.50 | −0.27 | −0.58 | −0.60 | 0.70 | −0.24 | 0.09 | −0.21 | −0.31 | −0.53 | −0.54 |
| LOC100506990 | 0.03 | −0.21 | −0.52 | −0.10 | −0.24 | 0.16 | 0.24 | 0.01 | −0.01 | −0.02 | 0.24 | 0.29 | 0.30 | 0.69 | 0.25 | 0.11 |
| LOC101927592 | −0.07 | −0.77 | −0.58 | −0.68 | −0.70 | −0.21 | 0.40 | −0.32 | −0.63 | −0.69 | −0.24 | −0.50 | 0.53 | 0.43 | −0.50 | 0.49 |
| MIR9-3HG | 0.03 | 0.14 | 0.64 | 0.53 | −0.34 | −0.14 | −0.27 | −0.10 | −0.08 | −0.05 | −0.07 | −0.36 | −0.10 | −0.30 | −0.24 | −0.91 |
| MPND | 0.26 | 1.16 | 0.94 | 0.49 | 0.32 | −0.51 | 0.02 | 0.34 | −0.06 | 0.37 | 0.10 | −0.02 | 0.34 | −0.05 | −0.03 | −0.16 |
| MTRF1 | −0.27 | −0.46 | −0.56 | −0.31 | −0.31 | −0.03 | −0.03 | −0.15 | −0.16 | −0.21 | 0.09 | −0.06 | −0.16 | 0.13 | −0.09 | 0.33 |
| POLR2J3 | −0.13 | 0.72 | 0.13 | −0.23 | 0.38 | −0.58 | −0.31 | 0.16 | 0.10 | 0.57 | −0.60 | −0.39 | −0.60 | −1.02 | −0.04 | −1.08 |
| PPP6R2 | 0.07 | 0.13 | 0.55 | 0.39 | −0.06 | −0.14 | −0.21 | −0.19 | −0.11 | 0.05 | −0.03 | −0.09 | −0.02 | −0.23 | −0.09 | −0.54 |
| PRSS55 | −0.55 | −1.22 | −0.96 | −0.45 | −0.63 | −0.61 | 0.24 | 1.63 | −0.41 | 0.26 | 1.57 | −0.24 | 0.09 | 1.64 | −0.84 | 1.64 |
| PTMS | 0.60 | 1.02 | 1.96 | 1.13 | 0.63 | 0.22 | 0.04 | −0.13 | 0.06 | 0.37 | −0.30 | −0.08 | 0.65 | 0.34 | −0.39 | −0.74 |
| RNF17 | 2.14 | 0.47 | 3.32 | −0.44 | −0.73 | −0.43 | −0.15 | 0.49 | −0.52 | −0.60 | 1.91 | −0.09 | −0.94 | −0.05 | −0.61 | 0.09 |
| SNAI3-AS1 | 0.17 | 0.54 | 0.66 | 0.71 | 0.66 | 0.34 | −0.07 | 0.47 | 0.40 | 0.49 | 0.39 | 0.02 | −0.09 | −0.09 | 0.26 | −0.65 |
| SPHK2 | −0.04 | −0.14 | 0.75 | 0.61 | −0.02 | −0.29 | −0.35 | −0.22 | −0.15 | 0.04 | −0.09 | −0.29 | 0.00 | 0.15 | −0.21 | −0.42 |
| ST3GAL2 | 0.57 | 0.72 | 1.00 | 0.73 | 0.46 | 0.28 | −0.10 | 0.25 | 0.29 | 0.52 | 0.13 | 0.02 | 0.20 | −0.09 | 0.13 | −0.44 |
| TAOK2 | 0.14 | 0.29 | 0.55 | 0.33 | −0.02 | −0.20 | −0.32 | −0.05 | −0.01 | 0.08 | −0.21 | −0.29 | −0.07 | −0.33 | 0.03 | −0.88 |
| TRDN | −1.43 | −1.20 | −0.98 | −0.66 | −1.08 | −1.25 | −0.98 | −1.39 | −1.29 | −1.17 | −0.95 | −0.66 | −0.88 | −0.92 | −1.29 | −0.35 |
| WASH7P | −0.21 | 0.86 | 1.05 | 0.63 | −0.01 | 0.16 | −0.05 | −1.02 | 0.22 | −0.09 | −1.17 | −0.68 | −0.07 | −0.42 | −0.41 | −1.51 |
| ZFPM1 | 0.02 | 0.33 | 1.32 | 0.48 | 0.32 | 0.64 | 0.09 | −0.09 | 0.20 | 0.07 | 0.09 | −0.03 | 0.42 | −0.03 | 0.22 | −0.19 |
| ZNF404 | −0.57 | −0.08 | −0.86 | −0.82 | −0.37 | 0.27 | 0.29 | 0.25 | 0.02 | −0.46 | −0.20 | −0.07 | −0.03 | 1.02 | 0.10 | 0.71 |
| ZNF496 | 0.17 | 0.24 | 0.04 | 0.17 | 0.09 | 0.09 | 0.00 | 0.01 | 0.09 | 0.27 | −0.12 | 0.15 | −0.24 | 0.11 | −0.08 | −0.50 |
| ZNF580 | 0.07 | 0.30 | 0.89 | 0.70 | 0.18 | −0.03 | −0.64 | −0.31 | 0.02 | −0.18 | −0.47 | −0.29 | −0.05 | −0.42 | −0.27 | −0.12 |
| ZNF585A | −0.17 | −0.34 | −0.07 | −0.27 | −0.17 | 0.37 | 0.17 | 0.00 | 0.21 | −0.13 | 0.08 | 0.05 | 0.20 | 0.07 | 0.08 | 0.70 |
| ZNF607 | −0.16 | −0.18 | −0.07 | −0.18 | −0.18 | 0.15 | 0.16 | −0.12 | 0.12 | 0.05 | 0.21 | 0.02 | 0.28 | −0.07 | 0.11 | 0.24 |
| ZNF84 | −0.18 | −0.31 | −0.34 | −0.28 | −0.14 | 0.23 | −0.02 | 0.07 | 0.05 | −0.14 | 0.19 | 0.09 | 0.06 | 0.18 | 0.01 | 0.21 |
| ZSCAN29 | −0.04 | −0.19 | −0.42 | −0.52 | −0.14 | −0.06 | −0.10 | 0.15 | 0.15 | 0.00 | 0.07 | −0.39 | −0.11 | 0.27 | −0.04 | 0.54 |

The RNAseq results in basket cells for the 42 most differentially expressed genes due to age are shown in Table 53. The log 2 fold change between the RNAseq results for the sorted nuclei from basket cells from each human sample compared to normalized expression from unsorted nuclei from all samples are shown in Table 53. Negative values indicate reduced expression in the nuclei of the subject compared to the normalized value across nuclei from all samples, and a positive value indicates increased expression compared to the normalized value across nuclei from all cell types analyzed.

TABLE 53

Log2 fold change of expression in basket cells

| Gene | | | | | | Log2 fold change of expression Subject | | | | | | | | | | |
|---|---|---|---|---|---|---|---|---|---|---|---|---|---|---|---|---|
| | xk | tm | wo | wc | wi | pk | vm | wl | sg | or | lt | zh | ko | kq | ke | ai |
| ACER3 | −0.43 | −0.46 | −0.43 | −0.01 | −0.35 | 0.08 | −0.27 | −0.12 | 0.22 | 0.30 | −0.12 | 0.05 | 0.00 | 0.33 | 0.75 | 0.46 |
| ACSS3 | −0.24 | 0.12 | −0.47 | −0.34 | −0.80 | −0.31 | −0.33 | −0.53 | −0.93 | 0.03 | −0.47 | −0.10 | 0.35 | 1.28 | 0.87 | 1.90 |
| ADAMTS2 | 0.55 | 0.00 | 0.36 | 0.67 | 0.22 | 0.20 | 0.00 | 0.12 | 0.00 | 0.30 | −0.43 | −0.04 | −0.59 | −0.28 | −0.33 | −0.76 |
| ADAMTS9 | 0.78 | 0.64 | 0.17 | 0.64 | −0.11 | 0.60 | 0.22 | 0.16 | 0.12 | 0.07 | −0.03 | −0.12 | −1.01 | −1.42 | 0.09 | −0.80 |
| ADAMTSL3 | −0.57 | 0.05 | −0.51 | −0.54 | −0.19 | −0.21 | 0.06 | −0.12 | −0.04 | 0.40 | −0.18 | −0.08 | 0.76 | 0.27 | 0.37 | 0.53 |
| ADD2 | 0.20 | 0.09 | 0.34 | 0.10 | 0.23 | 0.00 | −0.10 | 0.00 | 0.01 | −0.05 | −0.02 | 0.10 | −0.25 | −0.11 | −0.23 | −0.30 |
| ADGRL3 | 0.27 | 0.08 | 0.31 | −0.05 | 0.20 | 0.28 | 0.29 | 0.08 | −0.07 | −0.08 | −0.08 | −0.25 | −0.31 | −0.38 | −0.11 | −0.20 |
| AKAP13 | −0.41 | −0.06 | −0.31 | −0.12 | −0.70 | −0.14 | −0.31 | −0.12 | −0.27 | 0.00 | 0.01 | 0.12 | 0.21 | 0.69 | 0.64 | 0.76 |
| ALOX5 | −0.35 | −0.28 | −0.95 | −0.19 | −0.23 | −0.04 | 0.14 | −0.12 | −0.14 | −0.18 | −0.16 | 0.35 | 0.62 | 0.33 | 1.04 | 0.17 |
| ALS2CR11 | −0.40 | −0.49 | −0.26 | −0.29 | −0.49 | 0.06 | 0.36 | −0.36 | 0.11 | −0.08 | 0.61 | −0.22 | 0.21 | 0.06 | 0.48 | 0.70 |

TABLE 53-continued

Log2 fold change of expression in basket cells

| | Log2 fold change of expression Subject | | | | | | | | | | | | | | | |
|---|---|---|---|---|---|---|---|---|---|---|---|---|---|---|---|---|
| Gene | xk | tm | wo | wc | wi | pk | vm | wl | sg | or | lt | zh | ko | kq | ke | ai |
| ARHGEF10L | 0.18 | 0.06 | 0.31 | 0.23 | 0.17 | 0.06 | −0.09 | 0.02 | 0.01 | 0.03 | −0.10 | 0.12 | −0.21 | −0.29 | −0.04 | −0.45 |
| ARHGEF6 | −0.28 | −0.11 | −0.66 | −0.30 | −0.51 | −0.09 | −0.08 | −0.28 | −0.69 | −0.05 | −0.08 | 0.44 | 0.19 | 0.74 | 0.81 | 0.97 |
| ASIC1 | 0.39 | 0.29 | 0.60 | 0.24 | 0.48 | 0.19 | −0.03 | 0.16 | 0.02 | −0.06 | −0.15 | −0.05 | −0.70 | −0.18 | −0.37 | −0.83 |
| ASIC2 | 0.39 | 0.56 | 0.32 | 0.21 | 0.19 | 0.59 | 0.13 | 0.01 | −0.02 | 0.12 | −0.12 | 0.03 | −0.89 | −0.39 | −0.29 | −0.84 |
| ATP6V0B | 0.34 | −0.08 | 0.70 | 0.09 | 0.41 | 0.00 | −0.06 | 0.55 | 0.23 | 0.06 | 0.06 | −0.22 | −0.15 | −0.79 | −0.45 | −0.68 |
| BMP3 | −0.38 | −0.69 | −0.78 | −0.34 | −0.16 | −0.29 | −0.13 | 0.33 | 0.77 | 0.06 | −0.23 | 0.36 | 0.12 | 0.22 | 0.25 | 0.89 |
| BTBD11 | 0.11 | 0.17 | 0.36 | 0.21 | 0.03 | 0.17 | −0.01 | −0.07 | −0.12 | 0.02 | −0.02 | 0.04 | −0.31 | −0.22 | −0.27 | −0.09 |
| C11orf87 | 0.75 | 0.85 | 0.97 | 0.16 | 0.26 | 0.56 | −0.31 | −0.31 | −0.13 | 0.00 | 0.20 | −0.15 | −0.45 | −0.44 | −0.95 | −1.00 |
| C14orf1 | 0.26 | 0.20 | 0.36 | 0.09 | −0.01 | 0.20 | −0.05 | 0.02 | 0.24 | 0.09 | −0.08 | −0.17 | −0.13 | −0.28 | −0.33 | −0.41 |
| C4orf22 | −0.79 | −0.66 | −0.96 | −0.62 | 0.24 | −0.30 | 0.02 | 0.39 | 0.44 | 0.24 | 0.02 | 0.20 | 0.20 | 0.13 | 0.15 | 1.29 |
| C9orf135 | −0.30 | −0.39 | −0.60 | −0.50 | 0.03 | 0.25 | −0.42 | 0.12 | 0.12 | 0.41 | −0.63 | −0.05 | 0.88 | 0.47 | −0.36 | 0.96 |
| CA7 | 0.62 | 0.30 | 0.54 | 0.23 | 0.06 | −0.11 | −0.16 | 0.39 | −0.09 | −0.21 | −0.51 | −0.01 | 0.02 | 0.01 | −0.51 | −0.57 |
| CACNA1D | 0.16 | 0.00 | 0.17 | 0.16 | 0.04 | 0.03 | 0.10 | 0.06 | 0.07 | −0.07 | −0.04 | −0.05 | −0.05 | −0.23 | −0.19 | −0.18 |
| CACNA2D3 | −1.43 | −0.73 | −0.79 | −1.41 | −0.15 | −1.36 | 0.04 | −0.11 | 0.52 | 0.12 | 0.10 | 0.18 | 1.41 | 1.61 | 0.24 | 1.74 |
| CACNB4 | 0.26 | 0.17 | 0.47 | 0.16 | 0.14 | 0.06 | −0.06 | 0.03 | −0.06 | −0.14 | −0.16 | 0.08 | −0.21 | −0.29 | −0.21 | −0.25 |
| CADM3 | 0.44 | 0.22 | 0.15 | 0.03 | 0.21 | 0.10 | 0.00 | 0.11 | 0.25 | −0.03 | −0.04 | −0.04 | −0.59 | −0.08 | −0.19 | −0.56 |
| CADPS | 0.28 | 0.12 | 0.13 | 0.10 | 0.08 | 0.28 | 0.18 | 0.06 | −0.09 | 0.09 | −0.01 | −0.07 | −0.45 | −0.24 | −0.15 | −0.33 |
| CALR | 0.29 | 0.24 | 0.70 | 0.23 | 0.66 | 0.02 | −0.06 | 0.28 | −0.04 | −0.30 | 0.42 | −0.05 | −0.46 | −0.89 | −0.13 | −0.90 |
| CDK15 | −0.62 | 0.13 | −0.61 | −0.77 | −0.61 | −0.19 | 0.21 | −0.18 | −0.61 | 0.09 | −0.69 | 0.54 | 0.03 | 1.76 | 0.31 | 1.21 |
| CFAP46 | −0.57 | −0.57 | −0.39 | −0.07 | −0.21 | 0.25 | −0.09 | −0.25 | 0.51 | 0.22 | −0.28 | 0.36 | 0.04 | 0.50 | −0.08 | 0.64 |
| CLSTN3 | 0.09 | 0.01 | 0.72 | 0.30 | 0.51 | −0.09 | −0.11 | 0.11 | 0.04 | −0.25 | −0.07 | 0.09 | −0.26 | −0.32 | −0.35 | −0.43 |
| CNTN3 | −0.42 | −0.40 | −0.17 | −0.32 | −0.67 | −0.28 | −0.43 | −0.08 | 0.52 | 0.28 | 0.31 | −0.13 | 0.37 | 0.61 | 0.02 | 0.80 |
| CPNE8 | −0.26 | −0.38 | −0.05 | −0.03 | −0.68 | −0.14 | −0.31 | −0.45 | −0.37 | 0.05 | −0.07 | 0.01 | 0.25 | 0.63 | 0.98 | 0.82 |
| CYYR1 | −0.44 | −0.20 | −0.64 | −0.33 | −0.31 | 0.30 | −0.02 | −0.16 | 0.35 | −0.02 | −0.08 | 0.05 | 0.45 | 0.71 | −0.28 | 0.61 |
| DBH | 0.09 | 0.49 | 0.22 | 0.37 | 0.23 | 0.17 | −0.35 | 0.31 | 0.08 | −0.06 | −0.21 | 0.20 | −0.42 | −0.16 | −0.25 | −0.72 |
| DCC | −0.55 | 0.29 | −0.46 | −0.76 | −1.12 | −0.48 | −0.64 | −0.28 | 0.69 | 0.11 | −0.73 | 0.28 | 0.44 | 0.87 | 1.11 | 1.22 |
| DDO | −0.09 | −0.46 | −0.78 | −0.84 | −0.23 | 0.20 | −0.08 | −0.17 | 0.39 | 0.04 | 0.32 | 0.20 | 0.19 | 0.67 | 0.46 | 0.21 |
| DGKH | 0.31 | 0.08 | 0.34 | 0.12 | 0.06 | 0.37 | 0.11 | 0.12 | −0.12 | −0.12 | −0.12 | 0.01 | −0.18 | −0.47 | −0.27 | −0.25 |
| DISP3 | 0.25 | 0.15 | 0.41 | 0.28 | 0.10 | 0.17 | 0.00 | 0.16 | 0.14 | −0.06 | −0.17 | −0.18 | −0.55 | −0.03 | −0.47 | −0.23 |
| DLG1 | −0.46 | 0.04 | −0.59 | −0.34 | −0.13 | −0.01 | −0.16 | −0.09 | 0.00 | 0.15 | −0.04 | 0.08 | 0.19 | −0.25 | 1.02 | 0.60 |
| DLG4 | −0.06 | 0.28 | 0.73 | 0.60 | 0.17 | 0.05 | −0.06 | −0.15 | −0.02 | −0.06 | −0.22 | 0.00 | −0.14 | −0.25 | 0.00 | −0.86 |
| DMGDH | −0.36 | −0.01 | −0.90 | −0.69 | −0.44 | 0.06 | 0.27 | 0.11 | −0.67 | −0.07 | −0.27 | 0.10 | 0.92 | 0.78 | 0.22 | 0.93 |
| DNAH6 | −0.51 | −0.38 | −0.16 | −0.32 | 0.05 | 0.09 | −0.04 | −0.33 | 0.22 | −0.11 | 0.19 | 0.25 | 0.18 | 0.19 | −0.21 | 0.87 |
| DNER | 0.22 | −0.01 | 0.44 | 0.03 | 0.22 | 0.14 | 0.05 | 0.08 | −0.05 | −0.04 | −0.05 | 0.11 | −0.29 | −0.38 | −0.31 | −0.16 |
| E2F3 | 0.32 | 0.12 | 0.23 | 0.10 | 0.22 | 0.03 | 0.05 | 0.17 | 0.03 | −0.20 | −0.19 | 0.20 | −0.13 | −0.48 | −0.22 | −0.25 |
| ECHDC2 | −0.16 | −0.03 | −0.50 | −0.15 | −0.14 | −0.47 | −0.11 | −0.20 | −0.06 | 0.14 | −0.01 | 0.16 | 0.54 | 0.43 | 0.35 | 0.22 |
| ELOVL2 | −0.20 | 0.11 | −1.06 | −0.54 | −0.26 | 0.11 | −0.06 | −0.18 | −0.06 | 0.22 | −0.27 | −0.03 | 0.55 | 0.64 | 0.57 | 0.47 |
| ENPP1 | −0.71 | −0.23 | −0.30 | −0.81 | −0.10 | −0.82 | 0.20 | 0.23 | 0.17 | −0.09 | 0.39 | −0.05 | 0.86 | 0.31 | −0.03 | 0.98 |
| EPHB1 | 0.17 | 0.28 | 0.40 | 0.17 | 0.58 | −0.26 | 0.10 | 0.39 | 0.24 | 0.08 | 0.23 | 0.07 | −0.62 | −0.50 | −0.32 | −1.04 |
| ERC2 | 0.19 | 0.02 | 0.29 | 0.17 | 0.09 | 0.10 | 0.04 | 0.02 | −0.17 | −0.11 | −0.07 | 0.10 | −0.22 | −0.12 | −0.19 | −0.13 |
| FAM135B | 0.22 | 0.01 | 0.18 | 0.18 | 0.27 | 0.04 | −0.01 | 0.02 | −0.04 | −0.09 | −0.11 | 0.08 | −0.15 | −0.17 | −0.22 | −0.22 |
| FAM46C | −0.77 | −0.50 | −0.39 | −0.49 | 0.06 | −0.44 | 0.15 | −0.22 | 0.69 | −0.03 | 0.02 | 0.27 | 0.99 | 0.37 | −0.73 | 1.02 |
| FBXL21 | 1.32 | 0.31 | 0.00 | 0.44 | −0.31 | 0.69 | −0.13 | −0.20 | 0.60 | −0.04 | −0.21 | −0.33 | −0.54 | −0.80 | −0.30 | −0.50 |
| FGF5 | −0.86 | −0.35 | −1.15 | −0.64 | 0.40 | −0.44 | −0.16 | 0.02 | 0.31 | 0.32 | 0.29 | 0.21 | 0.62 | 0.37 | 0.03 | 1.01 |
| FHOD3 | 0.15 | 0.61 | 0.29 | 0.23 | 0.09 | 0.19 | −0.13 | −0.08 | 0.10 | 0.47 | −0.23 | 0.24 | −0.56 | −0.59 | −0.30 | −0.50 |
| FKBP5 | −1.16 | 0.08 | −0.21 | −1.12 | −1.00 | −1.09 | −0.16 | −0.85 | −0.11 | −0.04 | −0.18 | −0.09 | 2.01 | 1.39 | 0.19 | 2.35 |
| FRMPD4 | 0.25 | 0.19 | 0.14 | −0.01 | 0.21 | 0.21 | 0.15 | 0.09 | −0.04 | −0.12 | −0.05 | −0.13 | −0.44 | −0.07 | −0.19 | −0.19 |
| GABBR2 | 0.14 | 0.17 | 0.18 | 0.04 | 0.18 | 0.07 | 0.01 | 0.07 | 0.05 | −0.12 | −0.10 | 0.07 | −0.32 | −0.02 | −0.17 | −0.25 |
| GALNT18 | 0.23 | 0.15 | 0.18 | 0.17 | 0.07 | 0.20 | −0.05 | 0.01 | −0.05 | −0.03 | −0.16 | 0.02 | −0.34 | 0.02 | −0.16 | −0.25 |
| GAP43 | 0.28 | 0.40 | 0.40 | −0.05 | 0.40 | 0.17 | 0.21 | 0.06 | −0.04 | −0.02 | 0.02 | 0.10 | −0.46 | −0.56 | −0.30 | −0.61 |
| GBAP1 | −0.03 | 0.73 | 0.81 | 0.59 | −0.02 | −0.17 | −0.25 | 0.21 | −0.32 | 0.27 | −0.33 | 0.05 | −0.76 | −0.34 | −0.07 | −0.37 |
| GDF11 | 0.32 | 0.27 | 0.33 | 0.16 | 0.17 | 0.16 | 0.03 | −0.06 | 0.31 | 0.06 | −0.08 | −0.05 | −0.47 | −0.16 | −0.56 | −0.43 |
| GPR161 | 0.33 | 0.11 | 0.39 | 0.35 | −0.25 | 0.06 | 0.02 | 0.13 | −0.22 | 0.01 | −0.01 | 0.18 | −0.17 | −0.40 | −0.22 | −0.33 |
| GPR63 | 0.76 | 0.30 | 0.27 | 0.62 | −0.02 | −0.21 | 0.39 | 0.47 | −0.89 | −0.08 | −0.05 | 0.19 | −0.33 | −0.89 | −0.43 | −0.11 |
| GREB1 | −0.14 | −0.21 | −0.55 | −0.23 | −0.32 | 0.11 | −0.34 | −0.21 | 0.15 | 0.18 | 0.08 | −0.10 | 0.49 | 0.57 | 0.28 | 0.24 |
| HCN4 | 0.38 | 0.66 | 0.15 | 0.37 | 0.12 | 0.17 | −0.17 | −0.15 | 0.06 | 0.09 | 0.01 | 0.07 | −0.29 | 0.05 | −0.63 | −0.88 |
| HECTD2-AS1 | −0.44 | −0.17 | 0.04 | −0.30 | −0.15 | −0.20 | −0.06 | −0.40 | −0.03 | −0.22 | 0.19 | −0.12 | −0.11 | 0.75 | 0.61 | 0.61 |
| IQSEC3 | 0.20 | 0.23 | 0.50 | 0.16 | 0.36 | 0.00 | −0.13 | 0.03 | −0.02 | 0.00 | −0.18 | 0.35 | −0.41 | −0.22 | −0.17 | −0.69 |
| KCNA4 | −0.17 | −0.44 | 0.15 | −0.51 | −0.36 | −0.24 | −0.38 | −0.52 | 0.07 | −0.13 | 0.52 | −0.28 | 0.38 | 0.27 | 0.88 | 0.75 |
| KIF26B | 0.11 | 0.42 | 0.51 | 0.12 | 0.25 | −0.01 | 0.06 | 0.09 | −0.28 | 0.01 | 0.16 | 0.23 | −0.73 | −0.37 | −0.10 | −0.47 |
| KRT222 | 0.41 | 0.12 | 0.21 | −0.05 | 0.13 | 0.58 | 0.26 | 0.23 | −0.18 | 0.03 | 0.06 | −0.11 | −0.50 | −0.59 | −0.35 | −0.25 |
| LACTB2-AS1 | −0.40 | −0.14 | −0.37 | −0.32 | −0.18 | 0.17 | −0.16 | −0.48 | −0.21 | 0.50 | 0.22 | 0.06 | −0.01 | 0.28 | 0.30 | 0.75 |
| LHFPL3 | 0.46 | 0.30 | 0.61 | 0.14 | 0.29 | 0.17 | −0.09 | −0.10 | 0.05 | −0.14 | −0.33 | −0.07 | −0.71 | −0.12 | −0.36 | −0.10 |
| LINC00457 | −0.43 | −0.31 | −0.87 | −0.44 | −0.40 | −0.29 | 0.21 | −0.34 | 0.74 | 0.18 | −0.36 | 0.04 | 0.37 | 0.81 | −0.03 | 1.10 |
| LINC00499 | −0.37 | −0.34 | −0.51 | −0.39 | −0.73 | −0.01 | −0.11 | −0.20 | −0.01 | −0.13 | −0.20 | −0.17 | 0.94 | 0.21 | 0.13 | 1.90 |
| LINC01158 | −0.55 | −0.06 | −0.88 | −0.37 | 0.19 | −0.65 | 0.15 | −0.24 | 0.33 | 0.38 | −0.63 | 0.40 | 0.58 | 0.37 | 0.53 | 0.45 |
| LOC105377448 | −0.64 | 0.11 | −0.52 | −0.36 | −0.24 | 0.07 | −0.29 | 0.06 | −0.29 | 0.33 | −0.18 | 0.12 | 0.93 | 0.12 | 0.40 | 0.38 |
| LOC285692 | −0.51 | −0.44 | −1.15 | −0.57 | 0.01 | −0.10 | −0.28 | 0.04 | −0.14 | 0.48 | −0.75 | 0.07 | 1.63 | 0.51 | −0.14 | 1.33 |
| LOC653602 | 0.81 | 0.36 | −0.09 | 0.03 | −0.18 | 0.58 | 0.24 | 0.21 | 0.14 | 0.24 | 0.06 | −0.09 | −0.81 | −0.47 | −0.36 | −0.70 |
| LPCAT4 | 0.28 | −0.10 | 0.51 | 0.48 | 0.53 | −0.04 | −0.04 | 0.22 | −0.03 | −0.14 | −0.30 | 0.02 | −0.43 | −0.33 | −0.08 | −0.57 |
| MARC2 | −0.27 | −0.18 | −0.34 | −0.49 | −0.33 | 0.26 | −0.25 | −0.09 | 0.15 | 0.28 | 0.01 | 0.06 | 0.25 | 0.24 | 0.28 | 0.43 |
| MARCH11 | 0.41 | 0.12 | 0.15 | 0.05 | 0.23 | 0.21 | 0.17 | 0.12 | −0.09 | −0.26 | −0.11 | −0.03 | −0.29 | −0.26 | −0.18 | −0.24 |
| MASP1 | 0.50 | −0.08 | 0.47 | 0.38 | 0.37 | 0.39 | 0.33 | −0.17 | −0.25 | 0.06 | 0.49 | −0.22 | −0.68 | −0.45 | −0.27 | −0.87 |

TABLE 53-continued

| | Log2 fold change of expression in basket cells | | | | | | | | | | | | | | | |
|---|---|---|---|---|---|---|---|---|---|---|---|---|---|---|---|---|

| | Log2 fold change of expression Subject | | | | | | | | | | | | | | | |
|---|---|---|---|---|---|---|---|---|---|---|---|---|---|---|---|---|
| Gene | xk | tm | wo | wc | wi | pk | vm | wl | sg | or | lt | zh | ko | kq | ke | ai |
| MEGF10 | 0.27 | 0.13 | 0.15 | −0.06 | 0.08 | 0.27 | 0.13 | 0.05 | −0.05 | −0.16 | 0.00 | −0.06 | −0.11 | −0.27 | −0.20 | −0.15 |
| MTHFSD | 0.38 | 0.22 | 0.64 | 0.15 | 0.24 | −0.34 | −0.08 | 0.12 | −0.16 | −0.25 | −0.07 | 0.16 | −0.32 | −0.19 | −0.23 | −0.28 |
| MYRIP | −0.62 | −0.10 | −0.48 | −0.57 | 0.03 | 0.02 | 0.06 | −0.04 | 0.24 | 0.36 | −0.10 | 0.31 | −0.15 | 0.03 | 0.13 | 0.89 |
| NHS | 0.29 | 0.24 | 0.39 | 0.16 | 0.17 | −0.03 | −0.03 | 0.10 | −0.03 | 0.00 | −0.17 | 0.05 | −0.39 | −0.35 | −0.31 | −0.10 |
| NOS1 | 0.17 | 0.17 | 0.27 | 0.13 | 0.24 | 0.13 | 0.03 | −0.05 | −0.02 | −0.08 | 0.06 | −0.07 | −0.12 | −0.13 | −0.09 | −0.63 |
| NPL | −0.36 | −0.12 | −0.17 | −0.54 | −0.31 | −0.56 | 0.09 | −0.15 | −0.17 | 0.10 | 0.11 | 0.10 | 0.57 | 0.53 | 0.28 | 0.59 |
| NPY6R | −0.15 | −0.19 | −0.45 | −0.20 | −0.09 | −0.02 | −0.12 | −0.12 | −0.05 | −0.03 | 0.37 | −0.02 | 0.35 | 0.31 | 0.08 | 0.33 |
| NTNG1 | 0.77 | 0.46 | 0.12 | 0.30 | 0.19 | 0.26 | −0.03 | 0.10 | 0.06 | −0.28 | −0.54 | −0.19 | −0.54 | −0.31 | −0.09 | −0.29 |
| NXNL2 | 1.10 | −0.41 | 1.75 | 1.11 | −0.19 | −0.35 | −0.04 | −0.39 | −0.54 | −0.49 | −0.01 | −0.25 | −0.08 | −0.25 | −0.71 | −0.25 |
| PAQR6 | −0.12 | −0.33 | −0.51 | −0.18 | −0.28 | −0.40 | −0.23 | −0.16 | 0.07 | 0.15 | −0.40 | −0.16 | −0.04 | 0.92 | 1.22 | 0.46 |
| PARM1 | 0.38 | 0.26 | 1.16 | 0.42 | 0.87 | −0.34 | −0.18 | 0.29 | 0.09 | 0.39 | −0.47 | 0.00 | −1.49 | −0.49 | −0.35 | −0.55 |
| PCP4 | 0.95 | 0.96 | 0.28 | 0.85 | −0.46 | 0.49 | −0.32 | −0.33 | −0.39 | −0.05 | −0.70 | 0.60 | −0.13 | −0.67 | −0.89 | −0.18 |
| PEBP4 | −0.08 | −0.45 | −0.58 | −0.59 | −0.82 | −0.56 | −0.19 | −0.52 | 0.23 | 0.21 | 0.02 | −0.19 | 0.46 | 1.30 | 0.67 | 1.11 |
| PHACTR2-AS1 | 0.20 | 0.34 | 0.24 | −0.06 | 0.38 | 0.05 | 0.22 | 0.04 | −0.10 | −0.17 | −0.10 | 0.14 | −0.28 | −0.19 | −0.06 | −0.64 |
| PHKA1 | −0.59 | −0.22 | −0.41 | −0.46 | 0.13 | 0.13 | −0.18 | −0.20 | 0.09 | 0.36 | 0.02 | 0.11 | −0.23 | −0.18 | 0.29 | 1.34 |
| PLPPR4 | 0.40 | 0.27 | 0.31 | 0.61 | 0.31 | 0.85 | 0.62 | −0.21 | 0.21 | −0.12 | 0.18 | −0.48 | −1.41 | −0.78 | −0.70 | −0.05 |
| PLXNA4 | 0.48 | 0.46 | 0.32 | 0.35 | 0.05 | 0.25 | −0.19 | −0.11 | −0.20 | 0.01 | −0.21 | 0.10 | −0.28 | −0.25 | −0.44 | −0.35 |
| PRKCG | 0.22 | −0.02 | 0.97 | 0.25 | 0.26 | 0.11 | −0.21 | −0.05 | −0.16 | 0.23 | −0.22 | 0.01 | −0.24 | −0.30 | −0.29 | −0.57 |
| RGMB | 0.46 | 0.22 | 0.58 | 0.09 | 0.27 | 0.36 | −0.09 | 0.07 | 0.16 | 0.06 | 0.32 | −0.07 | −0.50 | −0.46 | −0.71 | −0.76 |
| RNF212 | −0.32 | −0.13 | −0.35 | −0.44 | −0.07 | −0.16 | −0.03 | −0.40 | 0.19 | 0.58 | −0.02 | 0.21 | −0.12 | 0.26 | 0.42 | 0.38 |
| RNF215 | 0.29 | 0.41 | 0.78 | 0.13 | 0.62 | −0.26 | −0.08 | 0.07 | 0.15 | −0.36 | 0.00 | −0.46 | −0.17 | −0.08 | −0.62 | −0.42 |
| RORA | 0.19 | 0.28 | 0.09 | 0.09 | 0.25 | 0.32 | 0.23 | 0.08 | 0.10 | −0.08 | −0.01 | −0.07 | −0.59 | −0.24 | −0.18 | −0.46 |
| RPH3A | 0.37 | 0.51 | 0.49 | 0.13 | 0.37 | 0.65 | −0.47 | 0.05 | 0.02 | 0.17 | −0.51 | 0.07 | −0.68 | −0.27 | −0.45 | −0.43 |
| RPS6KA5 | −0.49 | −0.17 | −0.53 | −0.35 | −0.38 | 0.27 | 0.37 | −0.37 | −0.13 | 0.27 | 0.10 | −0.09 | 0.47 | 0.03 | 0.32 | 0.67 |
| SCN2B | 0.05 | 0.49 | 0.56 | 0.08 | 0.53 | −0.13 | −0.07 | 0.22 | −0.10 | −0.05 | 0.10 | 0.01 | 0.11 | −0.41 | −0.74 | −0.65 |
| SEPSECS | −0.07 | −0.39 | −0.12 | −0.32 | 0.06 | −0.36 | −0.08 | −0.29 | 0.30 | −0.06 | 0.08 | −0.06 | 0.33 | 0.19 | 0.08 | 0.71 |
| SEPSECS-AS1 | 0.16 | −0.97 | −0.79 | −1.06 | 0.11 | 0.10 | −0.19 | 0.14 | 0.22 | 0.12 | 0.30 | 0.23 | −0.01 | 0.28 | 0.61 | 0.78 |
| SHANK1 | 0.23 | 0.01 | 0.92 | 0.43 | 0.38 | −0.04 | −0.28 | 0.05 | −0.16 | −0.11 | −0.21 | 0.22 | −0.38 | −0.15 | −0.15 | −0.76 |
| SHANK2 | 0.08 | 0.12 | 0.42 | 0.18 | 0.33 | 0.11 | −0.03 | −0.08 | −0.07 | −0.02 | −0.06 | 0.08 | −0.29 | −0.06 | −0.20 | −0.52 |
| SLC12A5 | 0.19 | 0.07 | 0.37 | 0.15 | 0.10 | −0.04 | 0.07 | 0.15 | 0.10 | 0.16 | 0.17 | −0.07 | −0.19 | −0.38 | −0.40 | −0.44 |
| SLC17A4 | −0.41 | −0.08 | −0.28 | −0.93 | 0.08 | −0.57 | −0.09 | −0.02 | 0.23 | −0.15 | 0.00 | −0.26 | 0.52 | 0.81 | −0.28 | 1.42 |
| SLC25A29 | 0.27 | 0.50 | 0.28 | 0.43 | 0.05 | −0.18 | −0.19 | 0.15 | 0.01 | −0.15 | −0.10 | 0.20 | −0.23 | −0.20 | −0.11 | −0.74 |
| SLC26A8 | −0.06 | −0.49 | −0.14 | −0.60 | −0.33 | 0.04 | −0.36 | 0.05 | −0.12 | 0.26 | 0.33 | −0.19 | 0.14 | 0.73 | 0.36 | 0.38 |
| SLC35F4 | 0.55 | 0.29 | 0.42 | 0.58 | −0.11 | 0.14 | −0.07 | 0.11 | −0.37 | 0.00 | −0.41 | 0.29 | −0.49 | −0.58 | −0.30 | −0.07 |
| SLC8A3 | 0.65 | 0.18 | 0.19 | 0.13 | 0.37 | 0.31 | −0.01 | 0.07 | −0.09 | −0.02 | −0.15 | −0.01 | −0.64 | −0.08 | −0.24 | −0.67 |
| SPARCL1 | −0.77 | −0.10 | −0.57 | −0.72 | −0.59 | −0.52 | −0.18 | −0.20 | −0.21 | 0.30 | 0.14 | −0.02 | 0.74 | 1.26 | 0.32 | 1.12 |
| SPHK2 | 0.15 | −0.02 | 0.80 | 0.68 | 0.33 | −0.27 | −0.20 | 0.06 | −0.25 | −0.09 | 0.10 | −0.07 | −0.13 | −0.23 | −0.38 | −0.49 |
| SPON2 | −0.29 | −0.33 | −0.11 | −0.56 | 0.05 | −0.21 | 0.13 | −0.26 | 0.21 | −0.34 | −0.09 | −0.31 | 0.12 | 0.45 | 0.88 | 0.67 |
| ST6GAL2 | 0.51 | 0.31 | 0.32 | 0.13 | 0.33 | 0.25 | 0.02 | 0.10 | −0.13 | −0.20 | −0.02 | −0.16 | −0.37 | −0.38 | −0.22 | −0.47 |
| ST6GALNAC5 | −0.58 | −0.85 | −1.38 | −0.75 | −0.70 | −0.75 | −0.29 | 0.23 | 0.75 | 0.25 | 0.09 | 0.54 | 0.58 | 0.52 | 0.53 | 1.79 |
| STAT5A | −0.65 | −0.39 | −0.73 | −0.24 | −0.65 | −0.32 | −0.09 | 0.21 | −0.45 | −0.06 | −0.19 | −0.66 | 1.51 | 1.76 | 0.04 | 0.91 |
| STK33 | −0.29 | 0.17 | −0.69 | −0.59 | −0.48 | −0.13 | −0.06 | −0.28 | 0.24 | 0.16 | 0.10 | 0.20 | −0.17 | 0.30 | 0.51 | 1.02 |
| SV2C | 0.22 | −0.68 | −0.22 | −0.51 | 0.04 | −0.49 | −0.65 | −0.44 | 0.20 | 0.03 | −0.10 | −0.19 | 0.73 | 0.88 | −0.05 | 1.22 |
| SYT17 | −0.91 | 0.01 | −0.50 | −0.62 | 0.37 | −0.48 | −0.53 | −0.63 | 0.39 | 0.16 | 0.31 | 0.68 | −0.26 | 0.55 | 0.76 | 0.69 |
| TEX9 | −0.39 | −0.56 | −1.01 | −0.33 | −0.63 | 0.29 | 0.20 | −0.16 | −0.08 | 0.37 | 0.17 | −0.08 | 0.30 | 0.37 | −0.10 | 1.63 |
| TFAP2B | 0.62 | 0.07 | 0.30 | 0.19 | 0.28 | 0.47 | −0.08 | 0.03 | −0.04 | −0.12 | −0.15 | 0.09 | −0.68 | −0.09 | −0.24 | −0.64 |
| THSD7B | 0.71 | 1.09 | 1.30 | 0.78 | −0.43 | 0.78 | 0.39 | 0.17 | 0.19 | −0.23 | −0.76 | 0.52 | −0.76 | −1.36 | −0.45 | −1.95 |
| TMEM178B | 0.15 | 0.14 | 0.21 | 0.02 | 0.13 | 0.03 | 0.10 | 0.10 | 0.00 | −0.13 | −0.06 | 0.05 | −0.32 | −0.07 | −0.16 | −0.20 |
| TRAF5 | 0.40 | 0.02 | 0.66 | 0.13 | −0.09 | 0.22 | 0.05 | 0.04 | −0.19 | −0.06 | −0.23 | −0.10 | −0.18 | −0.09 | −0.21 | −0.38 |
| TRIM67 | 0.54 | 0.00 | 0.33 | 0.46 | 0.17 | 0.22 | −0.17 | 0.04 | −0.09 | −0.24 | −0.25 | 0.23 | −0.61 | −0.06 | −0.29 | −0.30 |
| TTC23L | −0.28 | −0.06 | −0.54 | −0.42 | 0.00 | 0.09 | −0.20 | −0.42 | 0.03 | 0.22 | −0.14 | 0.04 | 0.37 | 0.43 | 0.31 | 0.56 |
| TUNAR | 0.73 | 0.28 | 0.47 | 0.49 | 0.29 | 0.07 | −0.65 | −0.05 | −0.21 | −0.07 | −0.44 | 0.01 | −0.24 | −0.20 | −0.20 | −0.27 |

TABLE 53-continued

| | Log2 fold change of expression in basket cells | | | | | | | | | | | | | | | |
| --- | --- | --- | --- | --- | --- | --- | --- | --- | --- | --- | --- | --- | --- | --- | --- | --- |
| | Log2 fold change of expression Subject | | | | | | | | | | | | | | | |
| Gene | xk | tm | wo | wc | wi | pk | vm | wl | sg | or | lt | zh | ko | kq | ke | ai |
| UBASH3B | 0.23 | 0.41 | 0.58 | 0.00 | 0.37 | −0.11 | 0.12 | 0.06 | 0.03 | −0.17 | −0.02 | 0.08 | −0.38 | −0.30 | −0.03 | −0.88 |
| UNC5D | 0.23 | 0.20 | 0.36 | −0.02 | 0.20 | 0.01 | 0.24 | −0.05 | −0.14 | −0.18 | −0.08 | 0.06 | −0.30 | −0.32 | −0.14 | −0.07 |
| ZNF124 | −0.59 | −0.10 | −0.02 | −0.16 | −0.31 | 0.00 | −0.18 | −0.14 | −0.11 | −0.31 | −0.23 | 0.29 | 0.54 | 0.33 | 0.34 | 0.64 |
| ZYG11A | −0.68 | −0.08 | −0.28 | −0.47 | −0.11 | −0.33 | −0.28 | 0.04 | 0.51 | 0.36 | 0.03 | 0.05 | 0.23 | 0.71 | −0.04 | 0.35 |

The RNAseq results in glia cells for the 42 genes having significantly altered expression due to age in the three cell types are shown in Table 54. The log 2 fold change between the RNAseq results for the sorted nuclei from glia from each human sample compared to normalized expression from unsorted nuclei from all samples are shown in Table 54. Negative values indicate reduced expression in the nuclei of the subject compared to the normalized value across nuclei from all samples, and a positive value indicates increased expression compared to the normalized value across nuclei from all cell types analyzed.

TABLE 54

| | Log2 fold change of expression in glia | | | | | | | | | | | | | |
| --- | --- | --- | --- | --- | --- | --- | --- | --- | --- | --- | --- | --- | --- | --- |
| | Log2 fold change of expression Subject | | | | | | | | | | | | | |
| Gene | xk | tm | wi | pk | vm | wl | sg | or | lt | zh | ko | kq | ke | ai |
| ABCC10 | 0.53 | −0.23 | 0.38 | −0.26 | −0.97 | 0.42 | 0.31 | 0.19 | −0.02 | −0.15 | −0.51 | −0.45 | 0.11 | −0.96 |
| ACAP3 | 0.17 | −0.41 | 0.49 | 0.17 | −0.68 | 0.34 | 0.03 | 0.50 | −0.03 | −0.52 | −0.41 | −0.57 | 0.04 | −1.00 |
| ACHE | −0.34 | −0.44 | −0.37 | 0.22 | −0.75 | −0.51 | −0.47 | −0.72 | −0.92 | −0.20 | −0.13 | −0.98 | −0.62 | −1.63 |
| ATF6B | 0.49 | 0.00 | 0.48 | 0.08 | −0.44 | 0.27 | 0.17 | 0.10 | 0.10 | −0.34 | −0.03 | −0.10 | 0.22 | −0.92 |
| ATP6V0B | 0.04 | 0.03 | −0.13 | −0.16 | 0.20 | 0.43 | −0.37 | −0.14 | 0.29 | 0.13 | 0.04 | −0.75 | 0.12 | −0.74 |
| CACNA2D3 | 0.00 | −0.05 | 0.09 | 0.44 | −0.03 | 0.02 | −0.07 | −0.19 | 0.05 | 0.22 | −0.24 | 0.13 | −0.02 | 0.65 |
| CUL7 | −0.12 | −0.58 | −0.21 | −0.28 | −0.72 | −0.29 | −0.53 | −0.19 | −0.40 | −0.56 | −0.38 | −0.77 | −0.44 | −1.18 |
| DNAJB5 | −0.40 | 0.29 | 0.06 | −0.22 | 0.02 | −0.18 | −0.26 | −0.12 | −0.50 | 0.04 | −0.53 | −1.11 | −0.51 | −1.06 |
| EGR1 | −0.37 | −1.68 | 3.58 | −0.10 | 3.53 | −1.56 | −0.54 | 0.22 | −0.52 | 2.95 | −0.66 | −1.22 | −0.52 | −2.16 |
| FZR1 | 0.51 | 0.31 | 0.38 | −0.16 | −0.70 | 0.36 | −0.24 | 0.16 | −0.09 | 0.09 | −0.09 | −0.88 | −0.16 | −1.40 |
| GBAP1 | 0.64 | 0.72 | 0.78 | 0.28 | −0.10 | 0.62 | 0.43 | 0.37 | 0.04 | 0.24 | −0.57 | −0.15 | 0.36 | −0.46 |
| GPR107 | 0.09 | 0.15 | 0.06 | 0.01 | 0.00 | −0.09 | 0.00 | 0.18 | 0.05 | 0.04 | 0.12 | −0.17 | −0.05 | −0.40 |
| GRK5 | −0.60 | −0.75 | −0.37 | −0.76 | −1.12 | −0.19 | −0.64 | −0.73 | −0.86 | −0.65 | −0.88 | −1.57 | −0.85 | −1.33 |
| KCTD21-AS1 | 0.21 | 0.70 | −0.31 | 1.03 | −0.22 | 0.40 | 0.49 | 0.13 | 0.50 | −0.70 | −0.38 | −0.62 | −0.26 | −0.13 |
| KLHL22 | −0.09 | 0.15 | 0.05 | −0.09 | −0.54 | −0.17 | −0.21 | −0.14 | −0.31 | −0.04 | −0.21 | −0.17 | −0.24 | −0.41 |
| LINC00499 | 0.00 | −0.49 | 0.87 | 0.63 | 0.59 | −0.22 | 3.04 | 1.06 | −0.03 | 0.49 | 3.88 | 1.05 | 1.12 | 4.88 |
| LINGO2 | −1.09 | 0.54 | 0.44 | −0.81 | −0.24 | 1.43 | −0.23 | −1.10 | −1.03 | −0.72 | −1.45 | −1.10 | −0.43 | −0.07 |
| LOC100132077 | 0.26 | −0.27 | −0.25 | −0.23 | 0.06 | −0.27 | −0.12 | 0.29 | −0.09 | −0.47 | −0.55 | −0.54 | −0.37 | −0.66 |
| LOC100506990 | −0.27 | 0.31 | 0.08 | 0.22 | −0.29 | −0.23 | 0.10 | −0.07 | −0.27 | 0.02 | 0.14 | 0.95 | 0.06 | 0.82 |
| LOC101927592 | −0.67 | −0.18 | −0.29 | 0.19 | 0.42 | −0.31 | −0.33 | 0.01 | −0.37 | −0.46 | 0.50 | 0.35 | −0.32 | 1.12 |
| MIR9-3HG | 0.40 | −0.06 | 0.34 | 0.49 | −0.46 | 0.13 | 0.36 | 0.04 | −0.35 | −0.01 | −0.67 | −0.97 | −0.67 | −1.74 |
| MPND | 0.33 | 0.68 | 0.07 | −0.09 | −0.78 | −0.09 | 0.05 | −0.14 | −0.31 | 0.00 | −0.25 | −0.56 | −0.39 | −1.20 |
| MTRF1 | 0.12 | −0.01 | −0.17 | 0.41 | 0.40 | 0.17 | −0.48 | 0.16 | 0.09 | 0.17 | 0.04 | 0.82 | 0.15 | 0.68 |
| POLR2J3 | 0.31 | 0.74 | 0.35 | 0.01 | 0.10 | 0.33 | 0.49 | 0.66 | −0.27 | 0.05 | −0.29 | −0.88 | 0.19 | −0.99 |
| PPP6R2 | 0.20 | −0.02 | −0.03 | 0.01 | −0.12 | 0.05 | 0.20 | −0.08 | −0.01 | −0.02 | −0.06 | −0.13 | −0.24 | −0.59 |
| PRSS55 | 0.04 | −1.98 | −0.13 | −0.46 | −1.29 | 0.45 | 0.25 | 0.07 | −0.53 | −0.74 | 0.36 | −0.25 | −0.93 | 0.26 |
| PTMS | −0.26 | −0.69 | −0.17 | −0.29 | −1.03 | −0.62 | −0.62 | −0.57 | −1.38 | −0.40 | −0.83 | −1.22 | −1.29 | −2.14 |
| RNF17 | 0.63 | 0.54 | −1.43 | −0.89 | −0.92 | −0.25 | −1.04 | −1.07 | 1.04 | −1.37 | −0.75 | −0.79 | −0.63 | −0.02 |
| SNAI3-AS1 | 0.20 | −0.28 | 0.40 | 0.53 | 0.29 | 0.13 | 0.24 | 0.07 | 0.00 | −0.01 | −0.24 | −0.58 | −0.35 | −0.65 |
| SPHK2 | 0.46 | −0.13 | 0.07 | 0.30 | −0.29 | 0.53 | 0.08 | 0.11 | 0.06 | −0.09 | 0.05 | 0.08 | 0.05 | −0.50 |
| ST3GAL2 | 0.11 | −0.03 | 0.03 | −0.21 | −0.65 | −0.12 | −0.30 | −0.36 | −0.43 | −0.22 | −0.54 | −0.59 | −0.23 | −0.98 |
| TAOK2 | 0.36 | 0.01 | 0.33 | 0.00 | −0.30 | 0.02 | 0.16 | 0.32 | −0.02 | −0.11 | 0.00 | −0.32 | −0.07 | −0.52 |
| TRDN | −0.42 | 0.85 | 0.63 | 2.04 | 2.11 | 1.20 | 1.58 | 1.59 | 1.32 | 2.45 | 1.80 | 4.47 | 1.16 | 4.44 |
| WASH7P | 0.45 | 0.36 | 0.39 | 0.20 | −0.30 | −0.08 | 0.54 | 0.32 | 0.00 | −0.19 | −0.05 | −0.58 | −0.18 | −1.77 |
| ZFPM1 | 0.15 | −0.11 | 0.25 | 0.24 | −0.28 | 0.13 | −0.06 | −0.21 | −0.25 | −0.21 | −0.30 | −1.08 | −0.14 | −0.44 |
| ZNF404 | −0.45 | 0.18 | −0.07 | 0.51 | 0.56 | −0.06 | −0.29 | −0.53 | −0.17 | 0.01 | −0.23 | 0.37 | 0.11 | 1.26 |
| ZNF496 | 0.14 | 0.12 | −0.05 | 0.00 | −0.23 | −0.16 | −0.17 | 0.10 | −0.15 | −0.16 | −0.16 | −0.10 | −0.06 | −0.45 |
| ZNF580 | −0.18 | 0.44 | 0.32 | 0.94 | −0.29 | 0.03 | 0.02 | 0.01 | 0.03 | −0.14 | 0.45 | −0.30 | −0.02 | −0.12 |
| ZNF585A | −0.24 | −0.18 | −0.01 | −0.21 | −0.06 | −0.23 | −0.13 | −0.26 | −0.03 | −0.13 | −0.01 | −0.05 | 0.08 | 0.61 |
| ZNF607 | −0.09 | −0.01 | −0.13 | −0.24 | 0.36 | −0.13 | 0.17 | 0.16 | 0.25 | −0.13 | 0.32 | 0.28 | 0.07 | 0.20 |
| ZNF84 | 0.01 | 0.02 | −0.14 | 0.13 | 0.31 | 0.07 | 0.09 | 0.03 | 0.21 | 0.16 | 0.04 | 0.36 | 0.26 | 0.37 |
| ZSCAN29 | 0.07 | 0.17 | 0.02 | 0.11 | −0.28 | 0.00 | 0.34 | 0.05 | 0.19 | 0.08 | 0.47 | 0.72 | 0.23 | 1.02 |

These data suggest that the specific molecular consequences of aging, at least in the cerebellum, differ according to cell type. Despite differences in the genes impacted by aging in each cell types, it remained possible that the cellular processes altered by these changes are related between cell types.

Figure 11A:
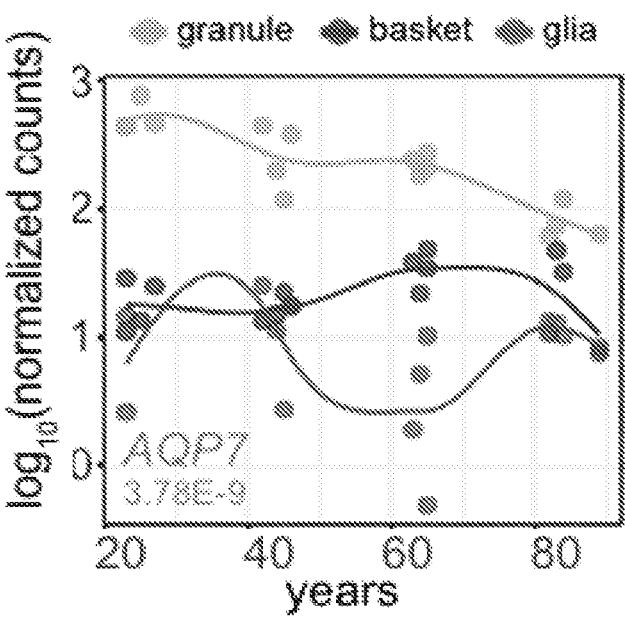
FIG. 11A, FIG. 11B, and FIG. 11C provide scatterplots showing gene expression across age for three cell-type specific aging down-regulated genes.
Figure 11B:
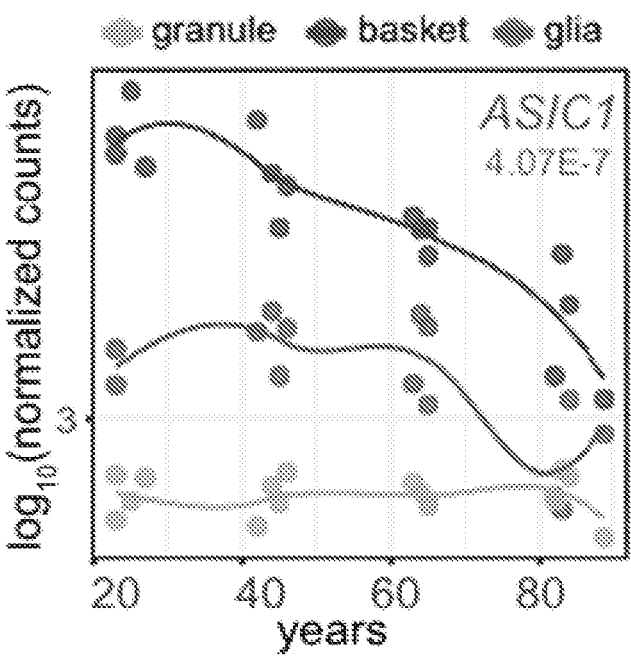
Figure 11C:
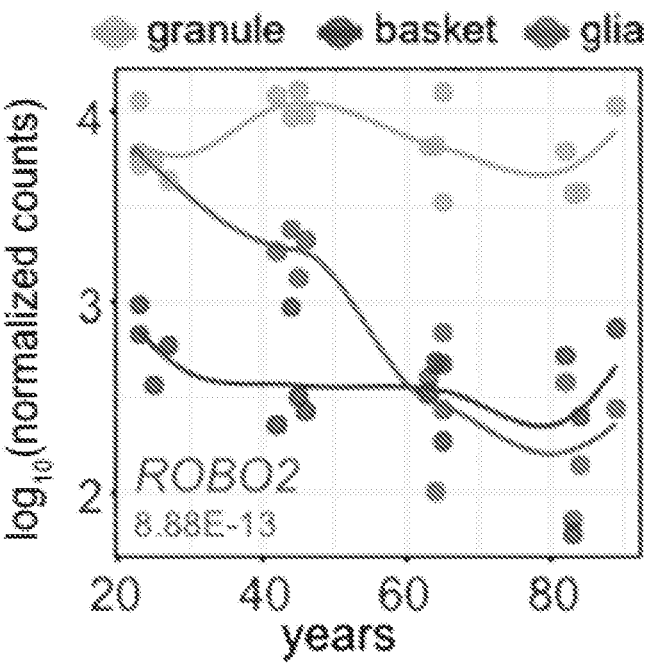

The genes down-regulated with age in all three cell types, despite containing different specific genes, were enriched for synaptic genes. For example, Aquaporin 7 (Aqp7) (p-adj=3.78E-9) and Acid Sensing Ion Channel Subunit 1 (Asic1) (p-adj=4.07E-7) were observed to be down-regulated with age in granule cells as shown in FIG. 11A and FIG. 11B, respectively. FIG. 11C shows that Roundabout Guidance Receptor 2 (Robo2) was downregulated in both glia in basket cells. The finding that genes encoding synaptic components decline in expression with age is consistent with previous findings that axons and dendrites atrophy in the brains of older individuals (Burke, et al. (2006) Nat Rev Neurosci 7, pages 30-40 (2006); Dickstein, et al. (2013) Neuroscience 251, 21-32; Freeman, et al. (2008) J. Neuropathol. Exp. Neurol. 67, 1205-1212; each of which is herby incorporated by reference herein in its entirety). However, the data herein extend these observations to establish that this general process impacts distinct genes in each cell type.

To test this hypothesis, GO analysis was performed on the genes that are up- or down-regulated with age in each cell type. No significant GO categories for any group of aging up-regulated genes were observed, nor were significant GO categories identified for the aging up-downregulated genes from the "all cell types" group.

Example 22

Determining Effects of Stress on Human Cell-Type Specific Gene Expression

Transcriptional induction of immediate early genes such as Fos Proto-Oncogene, AP-1 Transcription Factor Subunit (Fos, also known as c-FOS) and JunB Proto-Oncogene, AP-1 Transcription Factor Subunit (Junb) is associated with neuronal activation, and can indicate normal behavioral responses or pathological influences (Okuno, H. (2011) Neuroscience Research 69, 175-186 and Perez-Cadahia, et al. (2011) Biochem. Cell Biol. 89, 61-73, each of which is hereby incorporated by reference herein in its entirety). Although immediate early response genes associated with these events are often shared, the target genes and pathways induced by these factors reflect the nature of the event experienced by the cell or circuit (Duclot, et al. (2017) Front. Behay. Neurosci. 11, 717, which is hereby incorporated by reference herein in its entirety). A stress response was observed to induce a group of genes in three out of the 16 human samples and that are not explained by race, autolysis time, gender, or age. Table 55 provides the differentially expressed genes (adjusted p<0.01, baseMean>50) across all samples compared to normalized expression for all cell types.

TABLE 55

Differentially expressed genes across all samples

| Gene | Base Mean | Log2 Change | p-value | p-adj |
| --- | --- | --- | --- | --- |
| HSP90AA1 | 6188.357 | −2.067 | 9.64E−21 | 1.08E−17 |
| ARIH1 | 4367.296 | −0.583 | 5.64E−05 | 7.38E−03 |
| ELOVL5 | 3827.847 | −1.824 | 2.83E−17 | 2.07E−14 |

TABLE 55-continued

Differentially expressed genes across all samples

| Gene | Base Mean | Log2 Change | p-value | p-adj |
| --- | --- | --- | --- | --- |
| HSD17B12 | 3577.832 | −0.480 | 1.81E−05 | 2.71E−03 |
| ZNF331 | 3415.054 | −3.451 | 3.53E−19 | 3.12E−16 |
| PDE7A | 2643.373 | −0.494 | 5.37E−05 | 7.11E−03 |
| BTAF1 | 2229.841 | −0.739 | 2.37E−06 | 4.61E−04 |
| HSPA8 | 2191.727 | −1.558 | 1.46E−11 | 6.74E−09 |
| HSPH1 | 2090.803 | −3.685 | 5.34E−16 | 3.23E−13 |
| JMY | 2019.885 | −0.754 | 1.22E−05 | 1.90E−03 |
| RANBP2 | 1752.608 | −0.610 | 7.44E−05 | 9.50E−03 |
| TSC22D2 | 1601.991 | −0.686 | 3.74E−08 | 1.03E−05 |
| MXD1 | 1400.731 | −1.631 | 1.10E−10 | 4.25E−08 |
| P4HA1 | 1393.996 | −1.058 | 7.76E−06 | 1.33E−03 |
| TRA2B | 1262.337 | −0.680 | 1.57E−05 | 2.39E−03 |
| RHEB | 1238.794 | −0.597 | 1.08E−05 | 1.71E−03 |
| DNAJB4 | 1096.419 | −1.263 | 8.49E−11 | 3.33E−08 |
| PNPLA8 | 1054.161 | −1.221 | 8.29E−09 | 2.44E−06 |
| DNAJB6 | 991.014 | −1.231 | 5.14E−09 | 1.56E−06 |
| IFRD1 | 973.938 | −1.187 | 1.64E−11 | 7.38E−09 |
| HSPA1A | 967.333 | −5.435 | 9.97E−29 | 4.23E−25 |
| ZFAND5 | 967.094 | −1.175 | 2.64E−05 | 3.81E−03 |
| ST13 | 920.222 | −0.616 | 3.45E−06 | 6.38E−04 |
| ZNF10 | 919.734 | −1.805 | 6.26E−16 | 3.69E−13 |
| NDEL1 | 900.829 | −1.315 | 1.30E−12 | 6.88E−10 |
| ZNF141 | 863.045 | −1.026 | 2.84E−05 | 3.99E−03 |
| DNAJA4 | 845.930 | −1.533 | 3.23E−12 | 1.63E−09 |
| MORF4L2 | 840.065 | −0.897 | 1.17E−08 | 3.34E−06 |
| CHORDC1 | 824.510 | −1.208 | 8.27E−11 | 3.31E−08 |
| EIF2AK3 | 788.209 | −1.055 | 3.30E−06 | 6.24E−04 |
| ERRFI1 | 782.244 | −0.879 | 9.11E−06 | 1.49E−03 |
| HSPA4 | 772.635 | −0.998 | 1.47E−09 | 5.03E−07 |
| TFRC | 755.081 | −1.881 | 1.51E−10 | 5.52E−08 |
| CCNH | 740.080 | −1.581 | 6.17E−11 | 2.57E−08 |
| USPL1 | 725.467 | −0.902 | 3.17E−09 | 1.00E−06 |
| PTGES3 | 719.883 | −1.665 | 1.33E−12 | 6.88E−10 |
| ZNF131 | 718.183 | −0.432 | 5.61E−07 | 1.21E−04 |
| HSPA9 | 657.744 | −0.554 | 7.13E−07 | 1.53E−04 |
| NAMPT | 651.933 | −1.382 | 1.48E−06 | 2.93E−04 |
| SRSF3 | 646.750 | −1.051 | 1.27E−05 | 1.97E−03 |
| PPP2CA | 643.874 | −0.623 | 2.68E−06 | 5.12E−04 |
| PRMT9 | 626.415 | −1.450 | 3.13E−09 | 1.00E−06 |
| HMGCS1 | 604.092 | −2.002 | 1.82E−08 | 5.13E−06 |
| TXNL4A | 588.349 | −0.581 | 8.54E−08 | 2.13E−05 |
| JDP2 | 583.695 | −0.896 | 4.40E−08 | 1.15E−05 |
| AZIN1 | 559.688 | −0.646 | 4.91E−06 | 8.82E−04 |
| NR4A3 | 552.102 | −3.755 | 4.22E−20 | 4.47E−17 |
| HSPA1B | 544.938 | −4.841 | 2.79E−33 | 1.48E−29 |
| INSIG1 | 534.902 | −2.125 | 4.89E−06 | 8.82E−04 |
| MTCH1 | 528.116 | −0.865 | 2.33E−05 | 3.46E−03 |
| CYSTM1 | 527.900 | −1.100 | 1.57E−06 | 3.07E−04 |
| NPAS4 | 509.499 | −8.309 | 5.23E−20 | 5.28E−17 |
| NAF1 | 493.518 | −0.741 | 7.25E−08 | 1.85E−05 |
| HSPD1 | 493.259 | −1.688 | 2.70E−19 | 2.49E−16 |
| TMEM184C | 486.387 | −1.320 | 3.78E−14 | 2.11E−11 |
| MSMO1 | 483.773 | −1.860 | 8.48E−06 | 1.39E−03 |
| FKBP4 | 479.426 | −1.090 | 1.80E−09 | 6.05E−07 |
| EGR1 | 470.894 | −5.739 | 2.82E−21 | 3.51E−18 |
| C4orf33 | 448.787 | −1.376 | 4.28E−08 | 1.13E−05 |
| UAP1 | 443.763 | −2.461 | 9.88E−23 | 1.84E−19 |
| BAG3 | 439.711 | −2.592 | 9.71E−06 | 1.57E−03 |
| UFSP2 | 438.073 | −0.947 | 1.74E−05 | 2.62E−03 |
| CYCS | 429.955 | −2.118 | 5.75E−10 | 2.00E−07 |
| HMGCR | 429.914 | −0.825 | 4.53E−06 | 8.28E−04 |
| CACYBP | 428.152 | −1.296 | 8.36E−07 | 1.75E−04 |
| DNAJA1 | 423.249 | −1.569 | 8.79E−15 | 5.04E−12 |
| PTP4A1 | 404.937 | −1.551 | 1.72E−16 | 1.14E−13 |
| SYAP1 | 387.927 | −1.546 | 6.78E−22 | 1.03E−18 |
| IDI1 | 386.000 | −1.639 | 3.72E−11 | 1.61E−08 |
| GABARAPL1 | 384.301 | −0.814 | 1.54E−07 | 3.79E−05 |
| DNAJB1 | 383.949 | −3.687 | 8.95E−34 | 6.32E−30 |
| HIST2H2BF | 378.006 | −2.354 | 8.62E−09 | 2.50E−06 |
| NR4A1 | 374.351 | −5.233 | 3.98E−21 | 4.69E−18 |
| NR4A2 | 373.846 | −3.427 | 4.39E−05 | 5.93E−03 |
| ZNF184 | 373.550 | −1.158 | 1.37E−06 | 2.77E−04 |
| DNAJC27 | 373.271 | −0.478 | 3.33E−05 | 4.64E−03 |

TABLE 55-continued

Differentially expressed genes across all samples

Figure 12:
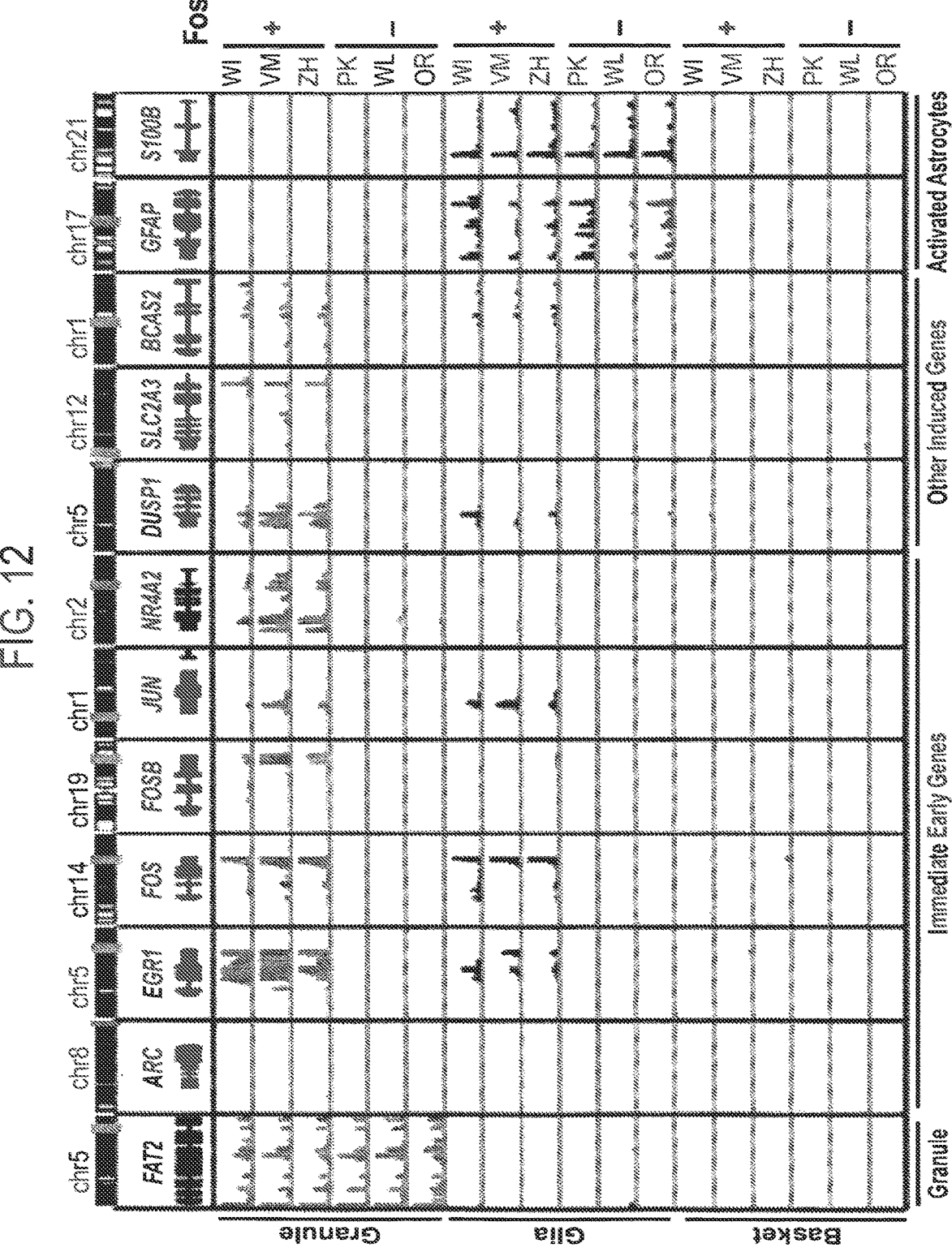
FIG. 12 provides the expression of stress response and immediate early genes in three individuals across three cell types in Fos+ and Fos− individuals. The gene tracks show merged expression from three Fos+ and three age− and gender-matched Fos-individuals.

| Gene | Base Mean | Log2 Change | p-value | p-adj |
|------|-----------|-------------|---------|-------|
| FOS | 369.433 | −6.017 | 1.06E−19 | 1.02E−16 |
| HECA | 368.497 | −0.721 | 4.25E−08 | 1.13E−05 |
| NKRF | 355.175 | −1.361 | 5.40E−09 | 1.61E−06 |
| SNAPC1 | 347.452 | −0.687 | 4.29E−07 | 9.68E−05 |
| C2orf69 | 343.055 | −0.932 | 7.88E−08 | 1.99E−05 |
| SLC2A3 | 342.277 | −2.283 | 3.40E−06 | 6.38E−04 |
| ETF1 | 338.703 | −0.538 | 8.16E−06 | 1.37E−03 |
| DCUN1D3 | 330.486 | −0.959 | 2.15E−07 | 5.17E−05 |
| BCAS2 | 321.395 | −3.293 | 7.30E−42 | 1.55E−37 |
| BTG2 | 313.734 | −2.758 | 2.11E−11 | 9.30E−09 |
| CASP9 | 292.778 | −0.856 | 1.33E−06 | 2.72E−04 |
| HIST1H2BD | 292.613 | −3.518 | 1.85E−22 | 3.02E−19 |
| TOB1 | 288.226 | −1.607 | 4.63E−17 | 3.17E−14 |
| SIAH2 | 280.639 | −0.726 | 1.03E−05 | 1.64E−03 |
| ZBTB21 | 264.251 | −0.836 | 5.53E−08 | 1.43E−05 |
| LINC00278 | 263.479 | 4.992 | 2.41E−07 | 5.68E−05 |
| TMEM198 | 261.699 | −1.077 | 4.71E−07 | 1.05E−04 |
| UBC | 253.145 | −1.724 | 3.16E−17 | 2.23E−14 |
| KLHL15 | 252.472 | −0.902 | 5.28E−07 | 1.15E−04 |
| STIP1 | 245.513 | −1.267 | 8.29E−12 | 3.91E−09 |
| JOSD1 | 234.644 | −0.887 | 4.28E−10 | 1.54E−07 |
| HSPE1-MOB4 | 225.041 | −3.154 | 6.16E−24 | 1.63E−20 |
| SOD1 | 219.698 | −0.721 | 5.44E−06 | 9.60E−04 |
| NUDC | 218.371 | −0.803 | 4.20E−07 | 9.57E−05 |
| MCL1 | 217.860 | −0.600 | 2.67E−05 | 3.82E−03 |
| HERPUD1 | 215.632 | −0.928 | 1.41E−10 | 5.24E−08 |
| DUSP1 | 201.332 | −3.227 | 5.96E−19 | 5.05E−16 |
| FOSL2 | 193.863 | −3.422 | 1.25E−10 | 4.73E−08 |
| LOC403323 | 187.003 | 1.765 | 3.88E−05 | 5.34E−03 |
| SPTY2D1 | 170.668 | −0.616 | 6.16E−05 | 7.97E−03 |
| AHSA1 | 167.130 | −0.966 | 1.61E−07 | 3.93E−05 |
| JUN | 158.789 | −2.706 | 4.89E−07 | 1.08E−04 |
| EIF4A3 | 154.036 | −2.954 | 2.15E−23 | 5.06E−20 |
| MBOAT7 | 144.304 | −0.826 | 3.89E−08 | 1.06E−05 |
| ZNF891 | 142.869 | −0.746 | 7.92E−05 | 9.99E−03 |
| HIST2H2BE | 137.895 | −2.236 | 2.78E−16 | 1.79E−13 |
| TCEAL5 | 136.312 | −1.343 | 5.70E−05 | 7.42E−03 |
| SLC7A5 | 136.094 | −1.629 | 5.59E−06 | 9.80E−04 |
| COQ10B | 135.024 | −1.061 | 2.64E−09 | 8.61E−07 |
| TWISTNB | 133.437 | −1.081 | 1.33E−06 | 2.72E−04 |
| STK19 | 129.998 | −0.704 | 2.70E−05 | 3.84E−03 |
| FOSB | 128.225 | −7.806 | 3.14E−28 | 1.11E−24 |
| ZNF212 | 120.755 | 0.630 | 8.07E−06 | 1.37E−03 |
| ATF3 | 116.871 | −4.132 | 2.75E−21 | 3.51E−18 |
| HSPB1 | 116.181 | −4.761 | 3.53E−09 | 1.09E−06 |
| PARD6G-AS | 115.608 | −1.268 | 2.43E−05 | 3.53E−03 |
| SELK | 113.826 | −2.705 | 6.40E−28 | 1.94E−24 |
| ZFAND2A | 110.276 | −2.621 | 1.04E−22 | 1.84E−19 |
| TCEAL7 | 103.902 | −1.933 | 5.24E−16 | 3.23E−13 |
| PCBP1 | 103.325 | −0.749 | 7.57E−06 | 1.31E−03 |
| TM2D2 | 102.869 | −0.858 | 1.49E−05 | 2.30E−03 |
| RGS2 | 98.031 | −3.533 | 1.04E−22 | 1.84E−19 |
| CSRNP1 | 94.873 | −2.292 | 1.60E−05 | 2.42E−03 |
| UBB | 94.686 | −1.765 | 7.15E−12 | 3.45E−09 |
| MRPL18 | 79.610 | −0.847 | 2.56E−06 | 4.93E−04 |
| PPP1R15A | 79.021 | −4.230 | 1.87E−41 | 1.99E−37 |
| SERPINH1 | 77.852 | −4.809 | 4.41E−10 | 1.56E−07 |
| ZNRD1 | 72.879 | −1.779 | 2.16E−09 | 7.16E−07 |
| PMVK | 72.696 | −1.044 | 1.44E−06 | 2.88E−04 |
| RUVBL2 | 69.260 | −1.045 | 3.67E−07 | 8.46E−05 |
| AVPI1 | 68.283 | −1.098 | 7.60E−06 | 1.31E−03 |
| TCEAL9 | 67.723 | −1.793 | 4.89E−11 | 2.07E−08 |
| ANKRD37 | 59.568 | −2.551 | 2.17E−13 | 1.18E−10 |
| MIR3671 | 56.838 | 1.174 | 2.39E−07 | 5.68E−05 | c-FOS was observed to be induced strongly in granule cells obtained from three (WI, VM, and ZH) of the sixteen individuals (FIG. 12). To further explore this difference, differential expression (adjusted p<0.01, baseMean>50) analysis was performed to identify additional genes that are significantly up- or down-regulated in these three individuals compared to the others, i.e, differential gene expression analysis of granule cells between three fos+ individuals versus the other 13 samples was performed. A very strong response was evident in granule cells from individuals WI, VM, and TM, characterized by induction of 224 genes and diminished expression of 10 genes as shown in Table 56.

TABLE 56

Differentially expressed genes in granule cells

| Gene | Base Mean | Log2 Change | p-value | p-adj |
|------|-----------|-------------|---------|-------|
| SEMA4G | 102.715 | 0.992 | 4.10E−05 | 3.02E−03 |
| CKMT1B | 1897.863 | 0.914 | 1.15E−04 | 7.19E−03 |
| STRC | 326.503 | 0.885 | 1.42E−04 | 8.72E−03 |
| FSD2 | 294.523 | 0.818 | 1.11E−06 | 1.22E−04 |
| MRLN | 197.882 | 0.729 | 5.20E−05 | 3.70E−03 |
| TMEM175 | 506.049 | 0.706 | 4.84E−05 | 3.50E−03 |
| LOC339874 | 706.183 | 0.667 | 1.05E−04 | 6.61E−03 |
| LOC100131655 | 134.170 | 0.661 | 1.05E−04 | 6.62E−03 |
| ZNF253 | 553.671 | 0.631 | 6.73E−05 | 4.58E−03 |
| TMEM254 | 155.920 | 0.615 | 8.88E−05 | 5.80E−03 |
| IKBKAP | 1436.570 | −0.388 | 2.86E−05 | 2.21E−03 |
| RCAN2 | 6494.964 | −0.497 | 5.84E−05 | 4.06E−03 |
| TOP1 | 2113.050 | −0.500 | 3.87E−05 | 2.87E−03 |
| METTL9 | 513.620 | −0.527 | 1.23E−04 | 7.62E−03 |
| SPAG9 | 5601.340 | −0.552 | 1.01E−04 | 6.39E−03 |
| SIK3 | 9746.163 | −0.566 | 5.90E−06 | 5.54E−04 |
| QKI | 1423.676 | −0.567 | 9.24E−05 | 5.95E−03 |
| ESYT2 | 3476.907 | −0.575 | 2.23E−05 | 1.75E−03 |
| USP37 | 1315.358 | −0.596 | 1.29E−04 | 8.01E−03 |
| ZNF131 | 744.578 | −0.635 | 7.62E−06 | 6.94E−04 |
| NEDD4L | 7611.496 | −0.641 | 6.96E−05 | 4.69E−03 |
| ETF1 | 347.286 | −0.659 | 1.07E−05 | 9.39E−04 |
| ZSWIM6 | 8443.682 | −0.675 | 1.34E−04 | 8.29E−03 |
| OXSR1 | 1601.247 | −0.693 | 7.85E−06 | 7.12E−04 |
| TXNL4A | 597.737 | −0.699 | 1.32E−06 | 1.42E−04 |
| SIAH2 | 316.591 | −0.702 | 6.92E−05 | 4.68E−03 |
| NUP58 | 1160.627 | −0.708 | 5.76E−05 | 4.04E−03 |
| C6orf106 | 2991.322 | −0.709 | 2.14E−06 | 2.20E−04 |
| TRA2B | 1340.864 | −0.711 | 4.13E−05 | 3.03E−03 |
| ARIH1 | 5343.603 | −0.715 | 3.46E−05 | 2.61E−03 |
| TRIM26 | 770.020 | −0.722 | 1.94E−05 | 1.56E−03 |
| STK38L | 1412.060 | −0.727 | 9.07E−05 | 5.86E−03 |
| PROX1 | 1545.249 | −0.734 | 1.67E−05 | 1.38E−03 |
| ARHGEF3 | 1624.495 | −0.739 | 5.06E−05 | 3.65E−03 |
| RLF | 2115.267 | −0.747 | 3.53E−06 | 3.55E−04 |
| RNF139 | 191.619 | −0.758 | 4.66E−06 | 4.54E−04 |
| ABHD3 | 472.577 | −0.768 | 7.30E−05 | 4.88E−03 |
| RBM22 | 165.448 | −0.790 | 5.34E−06 | 5.04E−04 |
| HMCES | 199.301 | −0.799 | 3.45E−05 | 2.61E−03 |
| MTCH1 | 329.455 | −0.800 | 1.38E−04 | 8.47E−03 |
| CLCN3 | 2147.890 | −0.815 | 3.44E−05 | 2.61E−03 |
| TCEAL6 | 72.265 | −0.819 | 7.72E−05 | 5.10E−03 |
| TPT1 | 336.150 | −0.822 | 6.11E−05 | 4.23E−03 |
| ZBTB21 | 228.032 | −0.823 | 9.51E−06 | 8.45E−04 |
| USP28 | 2229.297 | −0.836 | 1.36E−05 | 1.15E−03 |
| PDE7A | 3084.356 | −0.839 | 4.78E−06 | 4.63E−04 |
| PPP2CA | 777.730 | −0.845 | 5.68E−09 | 8.46E−07 |
| PIGH | 157.066 | −0.845 | 3.58E−05 | 2.69E−03 |
| BZW1 | 145.806 | −0.853 | 6.05E−06 | 5.65E−04 |
| ECD | 585.982 | −0.855 | 2.14E−05 | 1.70E−03 |
| ZNF304 | 159.500 | −0.857 | 3.31E−05 | 2.54E−03 |
| DNAJC27 | 373.056 | −0.858 | 3.14E−07 | 3.93E−05 |
| ARG2 | 1107.387 | −0.868 | 3.78E−05 | 2.82E−03 |
| FNDC3B | 992.862 | −0.871 | 5.16E−06 | 4.90E−04 |
| FKBP4 | 494.688 | −0.875 | 5.52E−05 | 3.89E−03 |
| NARS2 | 1301.547 | −0.878 | 7.08E−06 | 6.48E−04 |
| STMN4 | 659.070 | −0.888 | 6.50E−06 | 6.04E−04 |
| SBDS | 163.743 | −0.893 | 9.06E−05 | 5.86E−03 |
| CASP3 | 749.428 | −0.896 | 1.92E−05 | 1.56E−03 |
| BTG1 | 342.032 | −0.900 | 1.75E−05 | 1.44E−03 |
| RHEB | 983.068 | −0.901 | 1.40E−07 | 1.82E−05 |
| GNL3 | 177.223 | −0.904 | 5.43E−12 | 1.22E−09 |
| MAGT1 | 145.958 | −0.906 | 8.09E−05 | 5.33E−03 |
| VPS37B | 382.189 | −0.916 | 4.92E−06 | 4.74E−04 |
| HSD17B12 | 3765.986 | −0.918 | 2.17E−05 | 1.72E−03 |
| SF3B4 | 162.476 | −0.922 | 4.41E−06 | 4.34E−04 |
| MLLT11 | 525.918 | −0.932 | 3.72E−07 | 4.57E−05 |
| SRSF3 | 732.944 | −0.941 | 3.91E−07 | 4.77E−05 |
| HTR5A | 248.180 | −0.944 | 8.22E−05 | 5.39E−03 |

TABLE 56-continued

Differentially expressed genes in granule cells

| Gene | Base Mean | Log2 Change | p-value | p-adj |
|---|---|---|---|---|
| SGMS2 | 183.235 | −0.962 | 1.91E−05 | 1.56E−03 |
| MAPRE2 | 5188.446 | −0.966 | 1.01E−09 | 1.65E−07 |
| NEAT1 | 5546.952 | −0.971 | 5.83E−05 | 4.06E−03 |
| MBOAT7 | 127.492 | −0.974 | 4.64E−05 | 3.37E−03 |
| JDP2 | 564.347 | −0.978 | 2.20E−05 | 1.73E−03 |
| RANBP2 | 2169.147 | −0.978 | 1.47E−06 | 1.57E−04 |
| MYLIP | 179.061 | −0.981 | 2.68E−05 | 2.08E−03 |
| HSPA4L | 1163.520 | −0.987 | 1.04E−04 | 6.61E−03 |
| WDR45B | 594.371 | −0.993 | 4.51E−09 | 6.77E−07 |
| ZFAND5 | 1078.857 | −0.994 | 5.43E−05 | 3.85E−03 |
| RRNAD1 | 171.158 | −0.998 | 9.36E−07 | 1.05E−04 |
| TEX14 | 139.757 | −1.000 | 9.77E−07 | 1.09E−04 |
| NFKBID | 127.328 | −1.002 | 4.50E−05 | 3.29E−03 |
| TM2D2 | 114.394 | −1.011 | 1.26E−06 | 1.36E−04 |
| USPL1 | 849.648 | −1.024 | 1.67E−08 | 2.35E−06 |
| RAB33A | 113.715 | −1.025 | 1.99E−05 | 1.60E−03 |
| SLC2A13 | 1670.258 | −1.026 | 3.09E−05 | 2.39E−03 |
| PTPRN | 667.045 | −1.026 | 3.73E−05 | 2.79E−03 |
| GTF2B | 348.417 | −1.028 | 2.03E−05 | 1.62E−03 |
| C14orf1 | 123.632 | −1.031 | 9.22E−07 | 1.05E−04 |
| CRY1 | 3023.061 | −1.041 | 2.63E−06 | 2.70E−04 |
| NUDC | 203.649 | −1.050 | 5.86E−07 | 6.91E−05 |
| ZNF891 | 169.431 | −1.052 | 5.11E−06 | 4.90E−04 |
| JMY | 2627.653 | −1.053 | 1.57E−07 | 2.03E−05 |
| JOSD1 | 256.814 | −1.057 | 3.55E−06 | 3.55E−04 |
| HERPUD1 | 245.474 | −1.062 | 7.29E−12 | 1.56E−09 |
| ARF4 | 715.355 | −1.068 | 7.92E−06 | 7.14E−04 |
| CYSTM1 | 416.800 | −1.090 | 7.61E−05 | 5.05E−03 |
| FEM1C | 1909.695 | −1.091 | 1.93E−05 | 1.56E−03 |
| RGS7BP | 1867.009 | −1.091 | 9.88E−07 | 1.10E−04 |
| CLK1 | 849.898 | −1.102 | 1.31E−05 | 1.13E−03 |
| RASL11B | 83.896 | −1.113 | 4.42E−07 | 5.28E−05 |
| AHSA1 | 157.727 | −1.128 | 1.32E−05 | 1.14E−03 |
| HECA | 402.594 | −1.146 | 1.86E−08 | 2.60E−06 |
| C2orf69 | 371.958 | −1.165 | 1.53E−08 | 2.20E−06 |
| KLHL15 | 316.023 | −1.168 | 4.70E−08 | 6.37E−06 |
| CDADC1 | 366.944 | −1.173 | 4.43E−06 | 4.34E−04 |
| GOT1 | 817.945 | −1.181 | 1.36E−05 | 1.15E−03 |
| MORF4L2 | 956.904 | −1.186 | 2.15E−10 | 3.84E−08 |
| ZNF711 | 420.374 | −1.187 | 1.34E−05 | 1.14E−03 |
| BTAF1 | 2714.626 | −1.209 | 1.09E−10 | 1.98E−08 |
| DEDD2 | 146.087 | −1.217 | 1.04E−05 | 9.21E−04 |
| ETV3 | 121.646 | −1.217 | 1.96E−09 | 3.08E−07 |
| PRNP | 2239.768 | −1.227 | 1.60E−05 | 1.33E−03 |
| P4HA1 | 1013.882 | −1.229 | 5.85E−09 | 8.64E−07 |
| AVPI1 | 95.334 | −1.237 | 2.63E−06 | 4.09E−07 |
| RBM7 | 181.059 | −1.241 | 5.04E−08 | 6.79E−06 |
| NAF1 | 552.597 | −1.254 | 1.07E−09 | 1.73E−07 |
| MXD1 | 1605.354 | −1.263 | 8.33E−13 | 1.13E−04 |
| SNHG5 | 71.208 | −1.276 | 8.33E−13 | 1.93E−10 |
| SLC19A2 | 400.882 | −1.277 | 2.65E−06 | 2.70E−04 |
| BDNF | 698.573 | −1.283 | 9.02E−06 | 8.05E−04 |
| ERRFI1 | 782.451 | −1.285 | 3.66E−10 | 6.28E−08 |
| DNAJB6 | 881.860 | −1.286 | 3.95E−07 | 4.78E−05 |
| ARMCX1 | 54.271 | −1.289 | 1.88E−05 | 1.54E−03 |
| HSPA4 | 809.532 | −1.293 | 3.57E−06 | 3.55E−04 |
| HIST2H2BA | 284.036 | −1.293 | 1.64E−08 | 2.33E−06 |
| ATP1B3 | 4314.169 | −1.296 | 5.30E−07 | 6.29E−05 |
| APEX2 | 65.045 | −1.302 | 4.00E−07 | 4.81E−05 |
| SPTY2D1 | 205.806 | −1.304 | 3.13E−19 | 1.41E−16 |
| RNF122 | 580.993 | −1.319 | 3.67E−07 | 4.53E−05 |
| STIP1 | 237.758 | −1.319 | 2.05E−06 | 2.13E−04 |
| ARL5B | 305.291 | −1.322 | 3.37E−08 | 4.64E−06 |
| FAM122C | 97.552 | −1.323 | 1.59E−05 | 1.33E−03 |
| SERP1 | 113.793 | −1.339 | 7.97E−10 | 1.33E−07 |
| PMVK | 67.643 | −1.364 | 2.69E−06 | 2.73E−04 |
| HTR5A-AS1 | 76.838 | −1.376 | 5.16E−06 | 4.90E−04 |
| DYNLT3 | 133.963 | −1.398 | 6.98E−06 | 6.42E−04 |
| RPL10 | 97.578 | −1.421 | 1.08E−06 | 1.19E−04 |
| SAT1 | 118.125 | −1.428 | 5.15E−05 | 3.70E−03 |
| PPP1R11 | 246.242 | −1.432 | 1.24E−06 | 1.34E−04 |
| MIR7-3HG | 174.673 | −1.433 | 1.36E−07 | 1.78E−05 |
| DCUN1D3 | 408.667 | −1.468 | 2.86E−07 | 3.60E−05 |
| CACYBP | 637.420 | −1.470 | 1.25E−07 | 1.65E−05 |
| ELOVL5 | 2843.838 | −1.505 | 2.67E−09 | 4.12E−07 |
| IDI1 | 362.780 | −1.520 | 7.76E−17 | 2.80E−14 |
| STK19 | 125.037 | −1.536 | 3.38E−12 | 7.72E−10 |
| TWISTNB | 175.263 | −1.540 | 9.94E−15 | 3.09E−12 |
| RHOB | 220.468 | −1.562 | 6.00E−09 | 8.80E−07 |
| UFSP2 | 498.172 | −1.565 | 4.44E−11 | 8.70E−09 |
| GCH1 | 76.340 | −1.572 | 4.23E−06 | 4.19E−04 |
| PTGES3 | 619.522 | −1.577 | 1.02E−10 | 1.90E−08 |
| IFRD1 | 1111.665 | −1.584 | 9.85E−12 | 2.09E−09 |
| TMEM184C | 530.230 | −1.590 | 2.59E−10 | 4.59E−08 |
| TMEM198 | 357.453 | −1.637 | 1.44E−11 | 2.99E−09 |
| CCDC61 | 276.360 | −1.655 | 3.14E−14 | 9.27E−12 |
| DDIT4 | 67.106 | −1.668 | 1.13E−05 | 9.92E−04 |
| COQ10B | 117.908 | −1.677 | 1.07E−10 | 1.98E−08 |
| FTL | 140.398 | −1.694 | 1.48E−08 | 2.13E−06 |
| HOMER1 | 3336.401 | −1.714 | 8.36E−10 | 1.38E−07 |
| EIF2AK3 | 1144.435 | −1.718 | 2.97E−10 | 5.14E−08 |
| INSIG1 | 349.355 | −1.733 | 1.59E−09 | 2.52E−07 |
| CHORDC1 | 771.156 | −1.748 | 1.86E−11 | 3.77E−09 |
| NCALD | 129.180 | −1.756 | 3.36E−05 | 2.57E−03 |
| HSPD1 | 431.085 | −1.772 | 2.95E−10 | 5.14E−08 |
| CD83 | 176.355 | −1.790 | 1.73E−15 | 5.67E−13 |
| SYAP1 | 405.388 | −1.793 | 1.65E−15 | 5.50E−13 |
| ZNF141 | 1183.540 | −1.826 | 4.91E−13 | 1.20E−10 |
| UBB | 57.668 | −1.832 | 3.21E−08 | 4.46E−06 |
| TCEAL9 | 86.349 | −1.852 | 6.08E−10 | 1.02E−07 |
| DNAJB4 | 866.020 | −1.858 | 7.27E−15 | 2.30E−12 |
| NAMPT | 1000.443 | −1.863 | 8.91E−11 | 1.69E−08 |
| ABRA | 130.046 | −1.870 | 1.10E−09 | 1.75E−07 |
| PNPLA8 | 1338.913 | −1.879 | 1.96E−14 | 5.99E−12 |
| PTP4A1 | 447.034 | −1.883 | 3.22E−13 | 8.18E−11 |
| C4orf33 | 623.642 | −1.897 | 9.59E−10 | 1.57E−07 |
| NFIL3 | 103.369 | −1.913 | 6.44E−12 | 1.40E−09 |
| ZNF184 | 468.534 | −1.923 | 6.10E−12 | 1.34E−09 |
| NDEL1 | 848.764 | −1.924 | 7.52E−13 | 1.78E−10 |
| CTH | 138.050 | −1.963 | 9.00E−11 | 1.69E−08 |
| HSPA8 | 2197.083 | −1.983 | 2.05E−13 | 5.44E−11 |
| CRYM-AS1 | 50.232 | −2.006 | 1.42E−05 | 1.19E−03 |
| NKRF | 459.367 | −2.021 | 1.24E−15 | 4.29E−13 |
| DNAJA1 | 428.707 | −2.042 | 8.05E−16 | 2.85E−13 |
| TCEAL5 | 183.612 | −2.043 | 1.44E−28 | 1.08E−25 |
| DNAJA4 | 975.754 | −2.057 | 1.27E−15 | 4.31E−13 |
| TOB1 | 300.715 | −2.109 | 7.00E−20 | 3.51E−17 |
| NAMA | 108.441 | −2.135 | 8.34E−13 | 1.93E−10 |
| CCNH | 1118.384 | −2.176 | 1.15E−13 | 3.10E−11 |
| UBC | 239.133 | −2.201 | 7.65E−17 | 2.80E−14 |
| SLC7A5 | 188.435 | −2.242 | 6.55E−06 | 6.06E−04 |
| TIPARP | 248.559 | −2.253 | 1.02E−11 | 2.13E−09 |
| HSP90AA1 | 6952.285 | −2.356 | 6.65E−13 | 1.60E−10 |
| PRMT9 | 871.569 | −2.480 | 2.82E−13 | 7.26E−11 |
| PDLIM3 | 186.650 | −2.507 | 1.58E−06 | 1.68E−04 |
| TCEAL7 | 154.835 | −2.535 | 1.84E−26 | 1.18E−23 |
| ZNF10 | 1231.938 | −2.539 | 4.68E−19 | 1.97E−16 |
| ZFAND2A | 107.129 | −2.573 | 5.99E−40 | 7.20E−37 |
| HIST2H2BF | 728.823 | −2.593 | 4.35E−23 | 2.53E−20 |
| JUN | 226.853 | −2.650 | 7.88E−14 | 2.15E−11 |
| ZNRD1 | 104.925 | −2.732 | 5.96E−43 | 1.08E−39 |
| TNFSF9 | 57.260 | −2.840 | 3.56E−29 | 2.79E−26 |
| TFRC | 1085.953 | −2.866 | 9.69E−19 | 3.97E−16 |
| HSPE1-MOB4 | 173.395 | −2.904 | 4.42E−19 | 1.90E−16 |
| HIST2H2BE | 193.981 | −2.923 | 1.99E−19 | 9.18E−17 |
| CRYAB | 386.801 | −2.945 | 2.32E−34 | 1.99E−31 |
| BAG3 | 541.609 | −2.955 | 4.93E−18 | 1.89E−15 |
| UAP1 | 679.176 | −3.067 | 2.18E−35 | 2.07E−32 |
| CSRNP1 | 83.832 | −3.142 | 4.62E−15 | 1.49E−12 |
| SLC2A3 | 655.509 | −3.214 | 7.27E−61 | 2.62E−57 |
| SELK | 146.632 | −3.280 | 2.95E−38 | 3.13E−35 |
| BTG2 | 594.298 | −3.307 | 1.71E−39 | 1.93E−36 |
| CYCS | 509.540 | −3.438 | 2.55E−40 | 3.28E−37 |
| NR4A2 | 986.740 | −3.531 | 1.69E−21 | 9.24E−19 |
| ANKRD37 | 93.425 | −3.557 | 6.46E−27 | 4.32E−24 |
| FOSL2 | 401.878 | −3.704 | 5.92E−14 | 1.69E−11 |
| BCAS2 | 476.899 | −3.888 | 3.34E−101 | 2.01E−97 |
| EIF4A3 | 278.631 | −3.994 | 3.02E−115 | 2.72E−111 |
| PPP1R15A | 96.321 | −4.138 | 3.49E−66 | 1.57E−62 |
| DUSP1 | 363.240 | −4.180 | 1.75E−31 | 1.44E−28 |

TABLE 56-continued

| Gene | Base Mean | Log2 Change | p-value | p-adj |
|---|---|---|---|---|
| | | Differentially expressed genes in granule cells | | |
| RGS2 | 156.965 | −4.187 | 1.20E−58 | 3.62E−55 |
| HIST1H2BD | 575.717 | −4.196 | 1.24E−55 | 3.20E−52 |
| NR4A3 | 1009.149 | −4.337 | 4.69E−11 | 9.10E−09 |
| ZNF331 | 7274.277 | −4.338 | 9.41E−28 | 6.79E−25 |
| DNAJB1 | 575.178 | −4.628 | 3.59E−44 | 7.19E−41 |
| ATF3 | 104.384 | −5.269 | 2.56E−36 | 2.56E−33 |
| NR4A1 | 697.801 | −5.330 | 5.63E−12 | 1.25E−09 |
| EGR1 | 1085.415 | −6.047 | 1.06E−42 | 1.74E−39 |
| HSPA1B | 1043.895 | −6.097 | 1.06E−41 | 1.47E−38 |
| HSPH1 | 2891.362 | −6.265 | 3.37E−42 | 5.07E−39 |
| HSPA1A | 1867.480 | −7.238 | 1.33E−121 | 2.40E−117 |
| FOS | 689.775 | −7.902 | 1.80E−19 | 8.54E−17 |
| FOSB | 305.432 | −8.230 | 1.84E−21 | 9.74E−19 |
| NPAS4 | 1337.014 | −9.059 | 1.73E−25 | 1.08E−22 |
| HSPB1 | 54.110 | −9.282 | 1.68E−45 | 3.79E−42 |

An overlapping but weaker response that included 136 differentially induced genes (adjusted p<0.01, baseMean>50) was present in glial cells. Results are shown in Table 57.

TABLE 57

| Gene | Base Mean | Log2 Change | p-value | padj |
|---|---|---|---|---|
| | | Differentially expressed genes in glia | | |
| HSP90AA1 | 8051.585 | −2.662 | 9.43E−38 | 3.67E−34 |
| ELOVL5 | 6044.686 | −2.808 | 4.28E−21 | 4.63E−18 |
| ARIH1 | 4282.811 | −0.847 | 6.39E−05 | 8.07E−03 |
| GLUD1 | 3498.846 | −0.698 | 5.66E−05 | 7.30E−03 |
| FDFT1 | 2492.867 | −1.303 | 3.12E−08 | 7.88E−06 |
| P4HA1 | 2441.044 | −1.274 | 9.81E−08 | 2.33E−05 |
| ESYT2 | 2103.778 | −0.804 | 2.51E−07 | 5.42E−05 |
| HSPH1 | 2050.224 | −4.197 | 4.79E−41 | 4.66E−37 |
| MXD1 | 2034.515 | −2.471 | 2.14E−23 | 2.98E−20 |
| HSPA8 | 2012.773 | −2.201 | 1.29E−13 | 6.78E−11 |
| TSC22D2 | 1985.386 | −0.864 | 9.32E−06 | 1.35E−03 |
| HSP90AB1 | 1905.769 | −1.333 | 2.92E−06 | 4.95E−04 |
| TRA2B | 1669.907 | −0.926 | 2.58E−06 | 4.40E−04 |
| ZFP36L1 | 1619.793 | −1.104 | 1.62E−05 | 2.19E−03 |
| DNAJB6 | 1547.866 | −1.579 | 1.26E−07 | 2.93E−05 |
| ZFAND5 | 1496.257 | −1.603 | 1.34E−07 | 3.03E−05 |
| CRYAB | 1440.147 | −1.641 | 7.16E−06 | 1.11E−03 |
| ZNF331 | 1437.541 | −2.455 | 7.15E−15 | 4.64E−12 |
| HMGCS1 | 1402.003 | −2.585 | 1.19E−16 | 7.64E−14 |
| RHEB | 1393.603 | −0.802 | 6.14E−05 | 7.81E−03 |
| SLC25A33 | 1356.974 | −1.881 | 3.82E−11 | 1.51E−08 |
| DNAJB4 | 1337.044 | −1.647 | 4.71E−17 | 3.98E−14 |
| INSIG1 | 1317.230 | −2.258 | 7.15E−13 | 3.57E−10 |
| IFRD1 | 1258.393 | −1.207 | 4.54E−11 | 1.70E−08 |
| PTGES3 | 1212.490 | −2.293 | 5.55E−15 | 3.72E−12 |
| MSMO1 | 1189.790 | −2.226 | 8.83E−10 | 2.73E−07 |
| SLC25A18 | 1154.904 | −1.440 | 1.47E−05 | 2.02E−03 |
| CHORDC1 | 1030.967 | −1.386 | 4.58E−08 | 1.14E−05 |
| ZNF10 | 1024.343 | −1.541 | 5.32E−11 | 1.92E−08 |
| ST13 | 1014.370 | −1.119 | 2.60E−07 | 5.57E−05 |
| NDEL1 | 989.537 | −1.711 | 1.54E−14 | 8.55E−12 |
| SRSF3 | 958.528 | −1.412 | 3.73E−11 | 1.51E−08 |
| HSPA1A | 929.640 | −3.816 | 8.62E−15 | 5.41E−12 |
| ERRFI1 | 900.528 | −1.185 | 1.93E−07 | 4.26E−05 |
| CYSTM1 | 889.632 | −1.359 | 6.51E−08 | 1.58E−05 |
| ATP1B3 | 866.638 | −1.389 | 1.63E−07 | 2.41E−05 |
| USPL1 | 846.906 | −1.220 | 2.39E−10 | 8.32E−08 |
| ACO2 | 845.377 | −1.027 | 7.85E−06 | 1.18E−03 |
| TIPARP | 821.606 | −1.230 | 5.52E−07 | 1.11E−04 |
| BAG3 | 816.785 | −2.235 | 2.07E−08 | 5.31E−06 |
| HSPA4 | 768.062 | −1.455 | 4.69E−13 | 2.40E−10 |
| DNAJA4 | 753.981 | −2.101 | 8.05E−10 | 2.53E−07 |
| HSPA9 | 752.754 | −0.941 | 1.03E−05 | 1.47E−03 |
| MTCH1 | 742.823 | −1.374 | 2.68E−09 | 7.67E−07 |
| JDP2 | 739.497 | −1.293 | 7.24E−06 | 1.11E−03 |

TABLE 57-continued

| Gene | Base Mean | Log2 Change | p-value | padj |
|---|---|---|---|---|
| | | Differentially expressed genes in glia | | |
| AZIN1 | 713.479 | −1.003 | 1.28E−05 | 1.78E−03 |
| TRIM26 | 704.464 | −0.945 | 1.86E−06 | 3.27E−04 |
| HSPD1 | 699.334 | −2.391 | 3.83E−33 | 1.24E−29 |
| MORF4L2 | 694.829 | −1.221 | 6.95E−10 | 2.22E−07 |
| IDI1 | 669.446 | −2.121 | 1.73E−26 | 3.74E−23 |
| CTH | 651.226 | −1.197 | 1.16E−05 | 1.65E−03 |
| OAT | 623.811 | −1.474 | 9.83E−12 | 4.25E−09 |
| CCNH | 592.219 | −1.433 | 2.97E−09 | 8.27E−07 |
| HSPA4L | 591.874 | −1.787 | 8.95E−07 | 1.68E−04 |
| FKBP4 | 588.315 | −1.754 | 1.12E−06 | 2.03E−04 |
| HMGCR | 578.327 | −1.477 | 9.79E−07 | 1.81E−04 |
| TMEM184C | 567.269 | −1.817 | 1.13E−14 | 6.45E−12 |
| SYAP1 | 516.846 | −1.874 | 2.02E−18 | 1.79E−15 |
| NR4A3 | 499.418 | −3.566 | 7.90E−13 | 3.84E−10 |
| DNAJB1 | 485.312 | −3.405 | 8.35E−19 | 7.74E−16 |
| DNAJA1 | 477.992 | −2.033 | 1.37E−08 | 3.72E−06 |
| SLC19A2 | 475.606 | −1.489 | 2.63E−07 | 5.58E−05 |
| HSPA1B | 473.354 | −3.970 | 1.03E−13 | 5.59E−11 |
| TFRC | 470.015 | −1.879 | 1.10E−14 | 6.45E−12 |
| SNAPC1 | 452.474 | −1.089 | 5.60E−07 | 1.11E−04 |
| HSPE1-MOB4 | 451.895 | −4.139 | 8.48E−30 | 2.36E−26 |
| C2orf69 | 440.376 | −1.096 | 8.97E−06 | 1.32E−03 |
| CASP3 | 439.607 | −0.869 | 1.33E−06 | 2.38E−04 |
| HEY2 | 435.768 | −1.292 | 2.01E−09 | 5.83E−07 |
| PTP4A1 | 410.695 | −1.982 | 9.33E−13 | 4.43E−10 |
| NR4A1 | 401.179 | −5.257 | 1.40E−39 | 6.80E−36 |
| UAP1 | 400.390 | −2.781 | 8.72E−40 | 5.66E−36 |
| SLC25A3 | 399.813 | −0.863 | 6.57E−05 | 8.20E−03 |
| TOB1 | 399.348 | −1.711 | 1.04E−16 | 7.50E−14 |
| FOS | 395.865 | −4.458 | 1.10E−06 | 2.01E−04 |
| GABARAPL1 | 382.667 | −1.262 | 1.93E−08 | 5.14E−06 |
| BCAS2 | 372.249 | −3.587 | 1.12E−48 | 2.19E−44 |
| PER1 | 356.725 | −1.308 | 5.35E−07 | 1.09E−04 |
| CACYBP | 348.147 | −1.809 | 2.00E−08 | 5.26E−06 |
| TCP1 | 338.679 | −1.199 | 2.05E−08 | 5.31E−06 |
| C4orf33 | 327.163 | −1.597 | 3.30E−10 | 1.09E−07 |
| ETF1 | 325.587 | −0.701 | 4.53E−06 | 7.35E−04 |
| UBC | 325.079 | −2.040 | 3.83E−09 | 1.05E−06 |
| HSPB1 | 315.023 | −4.552 | 5.44E−17 | 4.42E−14 |
| STIP1 | 299.597 | −1.774 | 3.42E−07 | 7.09E−05 |
| SOD1 | 294.080 | −1.146 | 8.79E−06 | 1.31E−03 |
| STRAP | 285.147 | −0.776 | 4.17E−05 | 5.45E−03 |
| SIAH2 | 283.467 | −1.346 | 7.45E−07 | 1.44E−04 |
| HIST2H2BF | 263.990 | −2.974 | 2.53E−24 | 4.11E−21 |
| BTG2 | 263.276 | −1.991 | 9.21E−06 | 1.34E−03 |
| HIGD1A | 263.273 | −0.641 | 4.88E−05 | 6.34E−03 |
| JOSD1 | 260.472 | −1.051 | 3.06E−06 | 5.14E−04 |
| CYCS | 257.575 | −2.697 | 9.54E−26 | 1.86E−22 |
| HERPUD1 | 254.675 | −1.091 | 5.85E−10 | 1.90E−07 |
| NKRF | 253.510 | −1.526 | 6.01E−07 | 1.18E−04 |
| EGR1 | 253.290 | −5.076 | 2.03E−24 | 3.60E−21 |
| ALDH6A1 | 252.530 | −0.762 | 9.14E−06 | 1.34E−03 |
| JUN | 251.501 | −2.789 | 7.30E−24 | 1.09E−20 |
| SERPINH1 | 246.958 | −4.987 | 7.15E−23 | 9.29E−20 |
| ATF3 | 240.601 | −4.238 | 1.03E−14 | 6.30E−12 |
| HIST1H2BD | 222.156 | −2.898 | 2.14E−19 | 2.08E−16 |
| CSRNP1 | 210.207 | −1.863 | 1.84E−09 | 5.53E−07 |
| KLHL15 | 208.914 | −1.380 | 3.11E−10 | 1.04E−07 |
| NRBF2 | 206.863 | −1.041 | 2.21E−06 | 3.82E−04 |
| PNP | 206.849 | −1.690 | 5.70E−06 | 9.09E−04 |
| PARD6G-AS1 | 204.794 | −2.172 | 2.59E−12 | 1.15E−09 |
| NAPA | 198.513 | −1.682 | 8.82E−11 | 3.12E−08 |
| AHSA1 | 195.613 | −1.482 | 2.60E−05 | 3.47E−03 |
| ZFAND2A | 189.453 | −3.281 | 6.38E−17 | 4.97E−14 |
| DUSP1 | 183.073 | −2.146 | 1.76E−06 | 3.11E−04 |
| SLFN11 | 169.934 | −1.264 | 7.50E−05 | 9.31E−03 |
| HIST2H2BE | 160.703 | −1.890 | 2.35E−11 | 9.72E−09 |
| MBOAT7 | 158.353 | −1.158 | 1.25E−05 | 1.77E−03 |
| COQ10B | 155.826 | −1.330 | 1.32E−07 | 3.02E−05 |
| GZF1 | 155.696 | −0.962 | 1.67E−05 | 2.24E−03 |
| UBB | 150.735 | −2.195 | 1.00E−09 | 3.05E−07 |
| DDIT3 | 140.294 | −1.498 | 1.60E−05 | 2.18E−03 |
| SELK | 130.261 | −3.204 | 8.73E−21 | 8.95E−18 |
| PPP1R15A | 127.270 | −5.066 | 9.22E−28 | 2.25E−24 |
| EIF4A3 | 111.800 | −2.025 | 4.64E−11 | 1.71E−08 |

TABLE 57-continued

| | Base | Log2 | | |
|---|---|---|---|---|
| Gene | Mean | Change | p-value | padj |
| CD83 | 102.602 | −1.651 | 1.95E−07 | 4.27E−05 |
| MRPL18 | 101.327 | −1.277 | 3.42E−06 | 5.69E−04 |
| MAFF | 97.510 | −1.408 | 1.27E−05 | 1.77E−03 |
| RGS2 | 89.715 | −4.306 | 2.28E−22 | 2.77E−19 |
| TM2D2 | 87.430 | −1.384 | 2.66E−05 | 3.51E−03 |
| TCEAL9 | 87.242 | −2.121 | 1.91E−09 | 5.63E−07 |
| RUVBL2 | 79.176 | −2.076 | 2.83E−09 | 7.97E−07 |
| TCEAL7 | 78.191 | −1.817 | 1.64E−12 | 7.59E−10 |
| ANKRD37 | 67.735 | −1.509 | 9.05E−08 | 2.17E−05 |
| SRGN | 63.289 | −2.390 | 7.28E−06 | 1.11E−03 |
| FOSB | 60.342 | −7.121 | 2.53E−12 | 1.14E−09 |
| GEM | 59.972 | −3.182 | 2.30E−11 | 9.72E−09 |
| NR4A2 | 59.691 | −2.772 | 4.95E−08 | 1.22E−05 |
| NFKBID | 58.178 | −1.579 | 6.34E−06 | 1.00E−03 |
| AVPI1 | 55.589 | −1.640 | 6.76E−07 | 1.32E−04 |
| PCK1 | 50.725 | −4.568 | 8.34E−07 | 1.58E−04 |

The induction of these genes in glia is not due to contamination by granule cells as highly expressed markers for granule cells (e.g. FAT2) was not present in the glial data. This is interesting because induction c-FOS expression by glutamate in glia was thought to occur via a different mechanism than that induced by increased activity in cultured granule neurons (Edling, et al. (2007) Glia 55, 328-340, which is hereby incorporated by reference herein in its entirety). Only two differentially expressed genes were evident in the basket cell data: Heat Shock Protein Family A (Hsp70) Member 1A (HSPA1A) (Base Mean: 102.303, $\log_2$Fold Change: −3.234, p-value: 1.07E-12, padj: 1.06E-08) and Ring Finger Protein 122 (RNF122) (Base mean: 96.812, log 2 Fold Change: −1.552, p-value: 4.20E-06, padj: 0.008).

Figure 13A:
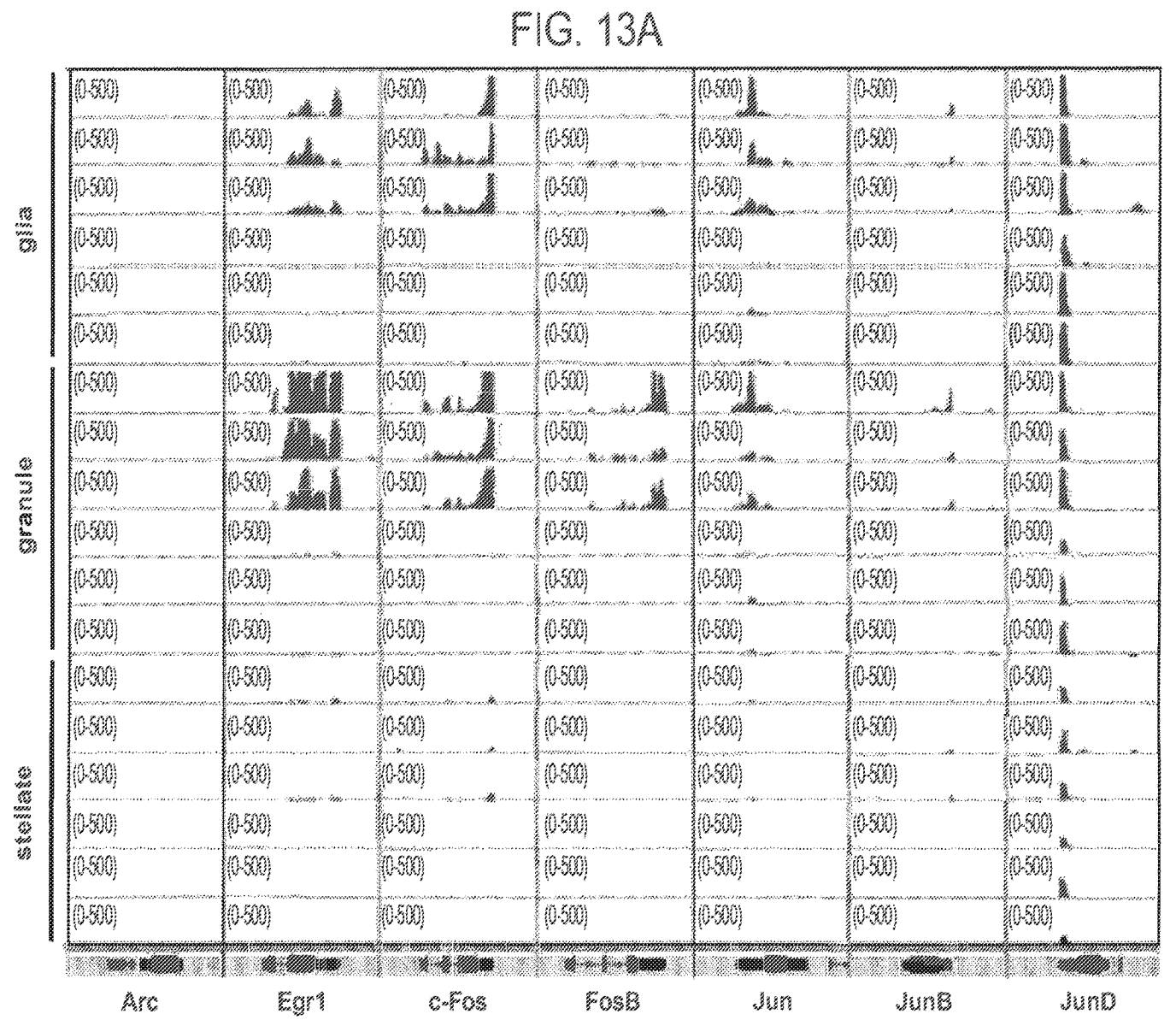

A stress response was observed to induce a group of genes in three out of the 16 samples and that are not explained by race, autolysis time, gender, or age. Gene expression is shown for Activity Regulated Cytoskeleton Associated Protein (Arc), Early Growth Response 1 (Egrl), c-Fos, FosB, Jun Proto-Oncogene, AP-1 Transcription Factor Subunit (Jun), JunB, and JunD Proto-Oncogene, AP-1 Transcription Factor Subunit (JunD) in FIG. 13A. Induction of fos genes and stress-associated genes was observed to be subtly cell-type specific as it primarily occurred in granule cells, although it also occurred in glia. Few changes in expression were observed in stellate cells.

Figure 13B:
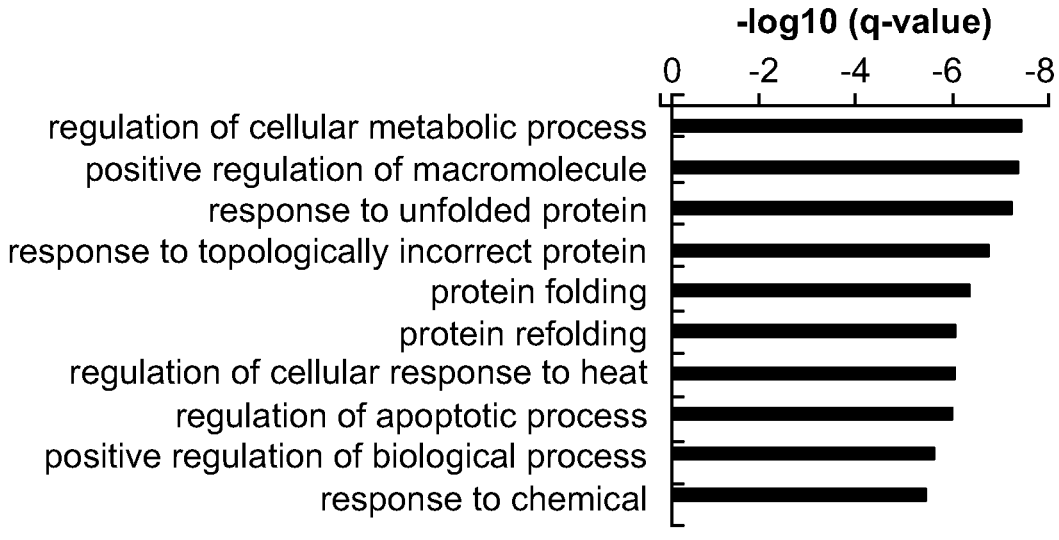
FIG. 13B shows gene expression of long-term stress response genes in these cells.

About 355 genes were observed to be induced in three samples of granule cells, while 25 genes were observed to be down-regulated. Many of these genes were intermediate early genes that mark neuronal activity but there were also many long-term stress response genes that are induced, as shown in FIG. 13B. Examples of affected groups of genes include those involved in: regulation of cellular metabolic process, positive regulation of macromolecule, response to unfolded protein, response to topologically incorrect protein, protein folding, protein refolding, regulation of cellular response to heat, regulation of apoptotic process, positive regulation of biological process, and response to chemical stimuli.

Figure 13C:
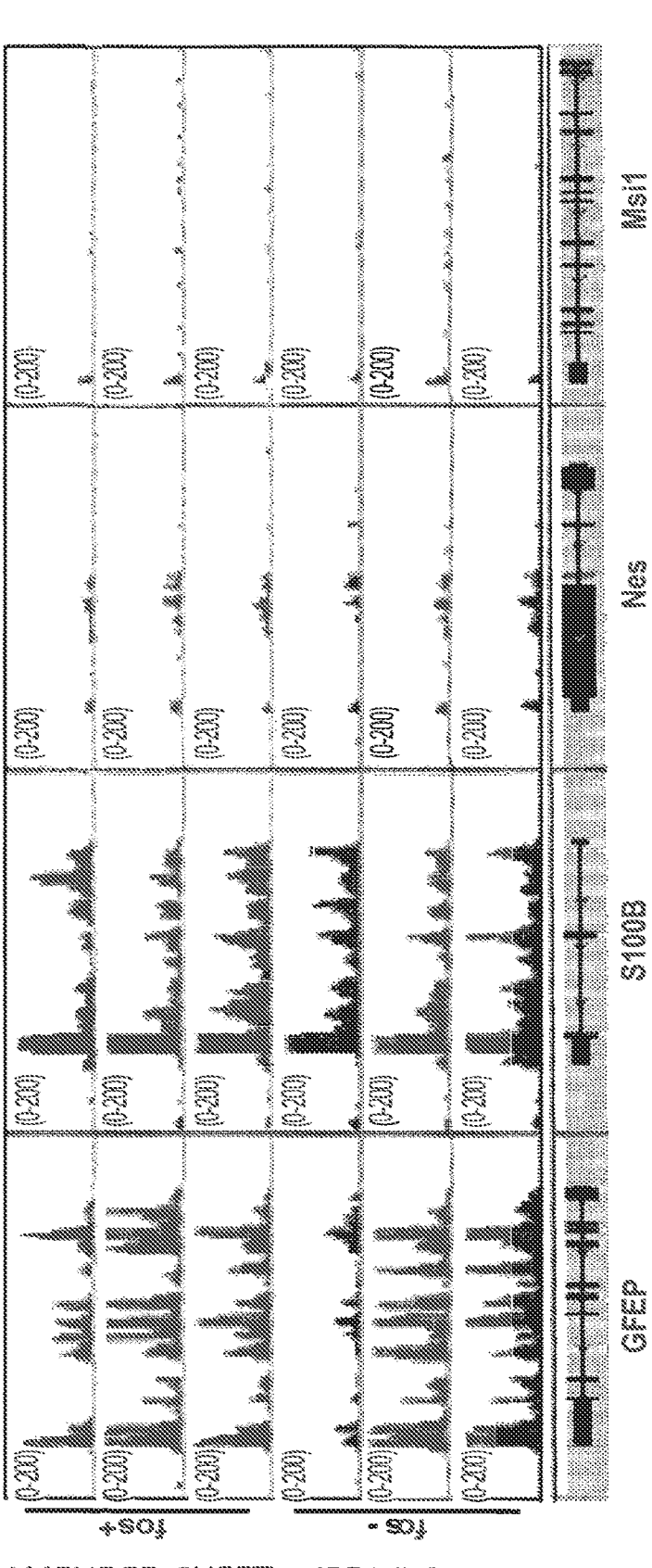
FIG. 13C shows expression of stress-associated genes, such as the activated astrocyte markers GFAP, S100B, Exportin 1 (Xpo1, also known as leucine-rich nuclear export signal (Nes)), and Musashi RNA Binding Protein 1 (Msi1) in glia, separate from markers of more long-term stress.

Stress response genes, such as the activated astrocyte markers GFAP, S100B, Nes, and Musashi RNA Binding Protein 1 (Msi1) in glia, are shown in FIG. 13C. The only significant change observed in expression was in GFAP in fos-nuclei.

Samples WI, VM, and ZH were observed to have fos and stress response genes induced in glia and granule neurons, and to a lesser extent, stellate neurons. The three individuals that were observed to have induced gene expression of fos genes did not appear to have much in common in their clinical histories. The data show reproducible activation of this stress response pathway, which provides details on the biology related to disease.

Given the robust response evident in the granule cell data, GO analysis was performed to determine whether the 224 induced genes in these neurons were enriched for specific functional categories. Significantly enriched GO categories were identifed for the up-regulated genes in fos+ individuals revealing enrichment for genes involved in stress response and protein folding. This analysis revealed categories associated with responses to external stimuli, protein folding/refolding, apoptosis, transcriptional response to stress, ATPase activity, and RNA splicing/metabolism as shown in Table 58.

TABLE 58

| | | | |
|---|---|---|---|
| Gene ontology results for significantly upregulated genes in granule cells | | | |
| ID | Description | q-value | Gene Symbol(s) |
| GO:0006457 | protein folding | 1.66E−10 | BAG3/CHORDC1/CRYAB/DNAJA1/DNAJA4/ DNAJB1/DNAJB4/DNAJB6/FKBP4/HSP90AA1/ HSPA1A/HSPA1B/HSPA4L/HSPA8/HSPB1/ HSPD1/HSPH1/NUDC/PTGES3/RANBR2/UBB/UBC |
| GO:1900034 | regulation of cellular response to heat | 4.86E−10 | BAG3/CHORDC1/CRYAB/DNAJB1/DNAJB6/ FKBP4/HSP90AA1/HSPA1A/HSPA1B/HSPA8/ HSPH1/NUP58/PTGES3/RANBP2 |
| GO:0009408 | response to heat | 6.39E−10 | BAG3/CHORDC1/CRYAB/DNAJA1/DNAJA4/ DNAJB1/DNAJB4/DNAJB6/FKBP4/HSP90AA1/ HSPA1A/HSPA1B/HSPA8/HSPD1/HSPH1/ NUP58/PTGES3/RANBP2 |
| GO:0009266 | response to temperature stimulus | 1.33E−09 | BAG3/CHORDC1/CRYAB/DNAJA1/DNAJA4/ DNAJB1/DNAJB4/DNAJB6/EIF2AK3/FKBP4/ FOS/HSP90AA1/HSPA1A/HSPA1B/HSPA8/ HSPD1/HSPH1/NUP58/PTGES3/RANBP2 |
| GO:0035966 | response to topologically incorrect protein | 4.55E−09 | ATF3/CTH/DNAJA1/DNAJB1/DNAJB4/EIF2AK3/ HERPUD1/HSP90AA1/HSPA1A/HSPA4/HSPA4L/ HSPA8/HSPB1/HSPD1/HSPH1/KLHL15/ PPP1R15A/SERP1 |

TABLE 58-continued

Gene ontology results for significantly upregulated genes in granule cells

| ID | Description | q-value | Gene Symbol(s) |
|---|---|---|---|
| GO:0006986 | response to unfolded protein | 7.15E−09 | ATF3/CTH/DNAJA1/DNAJB1/DNAJB4/EIF2AK3/ HERPUD1/HSP90AA1/HSPA1A/HSPA4/ HSPA4L/HSPA8/HSPB1/HSPD1/HSPH1/ PPP1R15A/SERP1 |
| GO:0034605 | cellular response to heat | 2.91E−08 | BAG3/CHORDC1/CRYAB/DNAJB1/DNAJB6/ FKBP4/HSP90AA1/HSPA1A/HSPA1B/HSPA8/ HSPH1/NUP58/PTGES3/RANBP2 |
| GO:0042026 | protein refolding | 6.81E−08 | DNAJA4/DNAJB1/HSP90AA1/HSPA1A/HSPA1B/ HSPA8/HSPD1/PTGES3 |
| GO:0090084 | negative regulation of inclusion body assembly | 2.71E−05 | DNAJA4/DNAJB1/DNAJB6/HSPA1A/HSPA1B |
| GO:0097201 | negative regulation of transcription from RNA polymerase II promoter in response to stress | 6.66E−05 | BAG3/DNAJB1/HSPA1A/JUN/PPP1R15A |
| GO:0006979 | response to oxidative stress | 1.06E−04 | CASP3/CRYAB/CYCS/DUSP1/FOS/GCH1/ HSPA1A/HSPA1B/HSPB1/HSPD1/HSPH1/JUN/ NR4A2/NR4A3/OXSR1/PRNP/PTPRN/RHOB/TRA2B |
| GO:0033120 | positive regulation of RNA splicing | 1.64E−04 | EIF4A3/HSPA1A/HSPA8/RBM22/SF3B4/TRA2B |
| GO:0090083 | regulation of inclusion body assembly | 1.69E−04 | DNAJA4/DNAJB1/DNAJB6/HSPA1A/HSPA1B |
| GO:0061077 | chaperone-mediated protein folding | 1.73E−04 | CHORDC1/DNAJB1/FKBP4/HSPA8/HSPB1/ HSPD1/HSPH1/PTGES3 |
| GO:0031647 | regulation of protein stability | 1.73E−04 | ATP1B3/BAG3/CCNH/CRYAB/HSP90AA1/ HSPA1A/HSPA1B/HSPA8/HSPD1/MYLIP/ PRNP/PTGES3/RNF139/USP28 |
| GO:0097193 | intrinsic apoptotic signaling pathway | 2.25E−04 | CASP3/CYCS/DDIT4/DNAJA1/EIF2AK3/ HERPUD1/HSPA1A/HSPBA/HSPH1/JMY/MLLT11/ PPP1R15A/TPT1/UBB/USP28 |
| GO:0051131 | chaperone-mediated protein complex assembly | 2.48E−04 | HSP90AA1/HSPA1A/HSPA4/HSPD1/PTGES3 |
| GO:1903313 | positive regulation of mRNA metabolic process | 2.72E−04 | BTG2/EIF4A3/HSPA1A/HSPA8/SF3B4/ TOB1/TRA2B |
| GO:0000302 | response to reactive oxygen species | 4.71E−04 | CASP3/CRYAB/CYCS/DUSP1/FOS/GCH1/ HSPD1/HSPH1/JUN/NR4A3/PTPRN/RHOB/TRA2B |
| GO:0061469 | regulation of type B pancreatic cell proliferation | 4.74E−04 | ERRFI1/HR4A1/NR4A3/PTPRN |
| GO:0043484 | regulation of RNA splicing | 5.68E−04 | CLK1/EIF4A3/HSPA1A/HSPA8/RBM22/ RBM7/SF3B4/SRSF3/TRA2B |
| GO:0070841 | inclusion body assembly | 5.68E−04 | DNAJA4/DNAJB1/DNAJB6/HSPA1A/HSPA1B |
| GO:0050685 | positive regulation of mRNA processing | 8.59E−04 | EIF4A3/HSPA1A/HSPA8/SF3B4/TRA2B |
| GO:0043618 | regulation of transcription from RNA polymerase II promoter in response to stress | 9.18E−04 | ATF3/BAG3/DNAJB1/EGR1/HSPA1A/ JUN/PPP1R15A/UBB/UBC |
| GO:0032781 | positive regulation of ATPase activity | 1.10E−03 | AHSA1/ATP1B3/DNAJA1/DNAJB1/ DNAJB4/DNAJB6 |
| GO:0043620 | regulation of DNA-templated transcription in response to stress | 1.16E−03 | ATF3/BAG3/DNAJB1/EGR1/HSPA1A/ JUN/PPP1R15A/UBB/UBC |
| GO:0051085 | chaperone mediated protein folding requiring cofactor | 1.16E−03 | DNAJB1/HSPA8/HSPD1/HSPH1 |
| GO:0048545 | response to steroid hormone | 1.31E−03 | CASP3/CRY1/DDIT4/DNAJA1/DUSP1/ ERRFI1/FKBP4/FOS/FOSB/GOT1/HSPD1/ NPAS4/NR4A1/NR4A2/NR4A3/UFSP2 |
| GO:1903311 | regulation of mRNA metabolic process | 2.47E−03 | BTG2/EIF4A3/HSPA1A/HSPA8/RBM7/ SF3B4/SRSF3/TOB1/TRA2B |
| GO:0048026 | positive regulation of mRNA splicing, via spliceosome | 2.59E−03 | EIF4A3/HSPA8/SF3B4/TRA2B |
| GO:1903320 | regulation of protein modification by small protein conjugation or removal | 2.79E−03 | CRY1/DCUN1D3/DNAJA1/EGRA/GNL3/ HERPUD1/HSP90AA1/HSPA1A/HSPA1B/ RNF139/SIAH2/UBB/UBC |

TABLE 58-continued

Gene ontology results for significantly upregulated genes in granule cells

| ID | Description | q-value | Gene Symbol(s) |
|---|---|---|---|
| GO:2001233 | regulation of apoptoic signaling pathway | 3.11E−03 | ATF3/CTH/DEDD2/DNAJA1/EIF2AK3/HERPUD1/HSPA1A/HSPA1B/HSPB1/HSPH1/MLLT11/NR4A2/SIAH2/TPT1/UBB |
| GO:0051084 | 'de novo' posttranslational protein folding | 3.88E−03 | DNAJB1/HSPA8/HSPD1/HSPH1 |
| GO:0051384 | response to glucocorticoid | 4.41E−03 | CASP3/DDIT4/DUSP1/ERRFI1/FOS/FOSB/GOT1/HSPD1/NPAS4 |
| GO:0050821 | protein stabilization | 4.47E−03 | ATP1B3/BAG3/CCNH/CRYAB/HSP90AA1/HSPA1A/HSPA1B/HSPD1/PTGES3 |
| GO:0044342 | type B pancreatic cell proliferation | 4.47E−03 | ERRFI1/NR4A1/NR4A3/PTPRN |
| GO:0010035 | response to inorganic substance | 4.93E−03 | CACYBP/CASP3/CRYAB/DUSP1/EIF2AK3/EIF4A3/FOS/FOSB/GCH1/HOMER1/HSPD1/HSPH1/JUN/NEDD4L/NR4A3/PRNP/RHOB |
| GO:0043462 | regulation of ATPase activity | 5.51E−03 | AHSA1/ATP1B3/DNAJA1/DNAJB1/DNAJB4/DNAJB6 |
| GO:0036499 | PERK-medicated unfolded protein response | 6.25E−03 | ATF3/EIF2AK3/HERPUD1/PPP1R15A |
| GO:0042542 | response to hydrogen peroxide | 7.78E−03 | CASP3/CRYAB/DUSP1/HSPD1/HSPH1/JUN/NR4A3/RHOB |
| GO:0031960 | response to corticosteroid | 8.17E−03 | CASP3/DDIT4/DUSP1/ERRFI1/FOS/FOSB/GOT1/HSPD1/NPAS4 |
| GO:0051082 | unfolded protein binding | 3.24E−07 | CRYAB/DNAJA1/DNAJA4/DNAJB1/DNAJB4/DNAJB6/HSP90AA1/HSPA1A/HSPA1B/HSPA8/HSPD1/NUDC/PTGES3 |
| GO:0031072 | heat shock protein binding | 3.24E−07 | CHORDC1/DNAJA1/DNAJA4/DNAJB1/DNAJB6/EIF2AK3/FKBP4/HSPA1A/HSPA1B/HSPA8/PTGES3/STIP1 |
| GO:0060590 | ATPase regulator activity | 1.77E−06 | AHSA1/ATP1B3/BAG3/DNAJA1/DNAJB1/DNAJB4/DNAJB6/HSPH1 |
| GO:0051087 | chaperone binding | 8.72E−06 | AHSA1/BAG3/DNAJA1/DNAJA4/DNAJB1/DNAJB4/DNAJB6/HSPD1/PRNP/STIP1 |
| GO:0001671 | ATPase activator activity | 1.88E−05 | AHSA1/ATP1B3/DNAJA1/DNAJB1/DNAJB4/DNAJB6 |

Analysis of immediate early gene expression indicated that their induction is also selective. For example, induction of EGR1, FOS, and FOSB occurs, but no difference in expression of ARC (a well-characterized immediate early gene) is evident (FIG. 12). Furthermore, although expression of immediate early genes such as c-FOS can become induced in response to damage such as ischemic stroke, no evidence was found for induction of glial genes such as GFAP and S100B that mark astrocyte activation in response to stroke and other forms of damage to the brain (Choudhury, et al. (2016) Neurobiology of Disease 85, 234-244; Ding, S. (2014) Neural Regen Res 9, 2048-2052; Dirnagl, et al. (1999) Trends in Neurosciences 22, 391-397; Kajihara, et al. (2001) Brain Research 909, 92-101; Pekny, M., et al. (2005) Glia 50, 427-434; each of which is hereby incorporated by reference herein in its entirety).

Finally, examination of the clinical records failed to reveal features (gender, age, cause of death) that distinguished these three individuals in FIG. 12 from the 13 other control donors. Although the cause or causes of these molecular events remain obscure, the discovery of this strong and highly reproducible stress response in select post-mortem human brain samples suggests the presence of an occult clinical condition and indicate that analysis of specific cell types using the cellular profiling technique described herein can be used to discover pathways and biomarkers associated with human pathophysiological conditions.

Example 23

Staining and Sorting Nuclei With RNA or DNA Probes

Antibodies often have non-specific targets and may become rate-limiting for expanding the cellular profiling technique described herein to more cell types. An alternative to using antibodies for labeling is to use RNA probes against cell-type specific nucleic acid transcripts. RNA probes are faster and easier to synthesize than antibodies. RNA probes are designed against two classes of transcripts. The first are chromosomal associated transcripts (CATs)—transcripts held at the chromosome while being synthesized. The second class of nucleic acid transcripts are the polyA+ transcripts that are abundant in the ER adjacent to the nucleus. To characterize variability across individuals, gene expression profiles were generated for unsorted nuclei from a few regions of the human brain, and then candidate CAT and polyA+ transcripts were identified. Using in situ hybridization in tissue sections, genes that delineate specific cell types were identified by anatomy and morphology. Antibodies or RNA probes against these candidates were used to label and sort for nuclei from human cell types without the need for prior knowledge from mouse data to determine the amount of variation in gene expression across the population.

Figure 14:
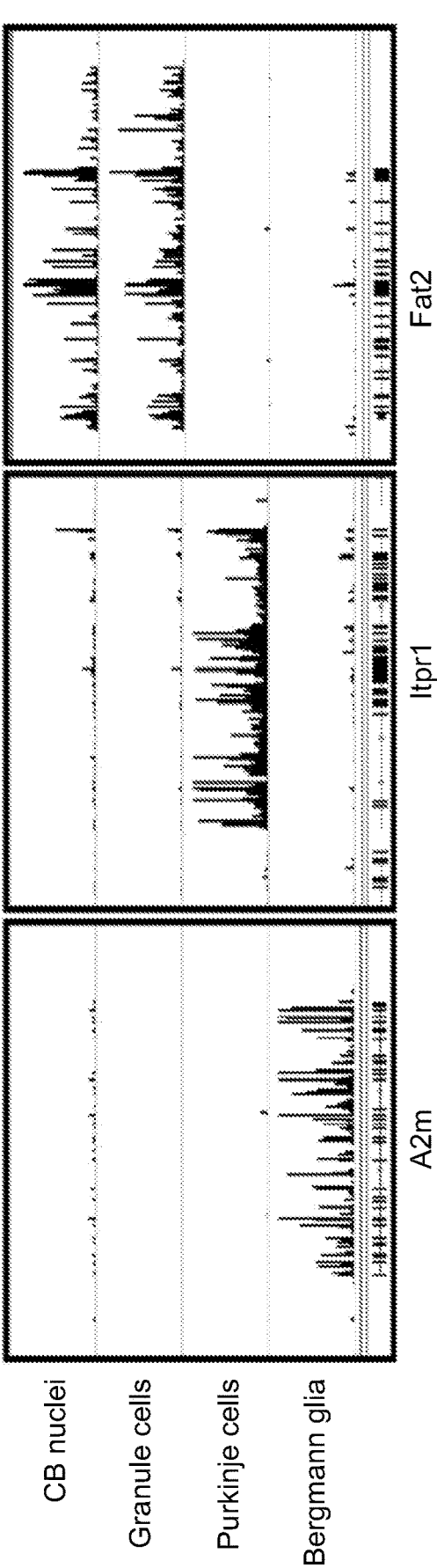
FIG. 14 shows RNAseq data of cell-type specific Chromosomal Associated Transcripts (CATs).

CATs have a unique labeling pattern of two spots at the two chromosomal sites of synthesis, which were observed to be highly specific with low background using in situ hybridization. FIG. 14 provides RNAseq results of CATs. A2m is a CAT specific to Bergmann glia, Itpr1 is a CAT specific to Purkinje cells, and Fat2 is a CAT specific to Granule cells. Therefore, cell-type specific CATs can be detected from a RNAseq profile from all cerebellar nuclei. Based on the in situ hybridization results for CATs and polyA+ transcripts labeled using RNA probes and extensive knowledge of labeling nuclei for FACS, RNA probes may be designed for any cell type.

EQUIVALENTS AND SCOPE

Those skilled in the art will recognize or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any antibiotic, therapeutic or active ingredient; any method of production; any method of use; etc.) can be excluded from any one or more claims, for any reason, whether or not related to the existence of prior art.

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention.

---

SEQUENCE LISTING (38661 sequences)

SEQ ID NO: 1 - DNA, 600 bp, Homo sapiens
  ENST00000543436
aggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgctgaaaagtgctttgctggagtcctgttctcagagctccacagaagacacgtgtttttgtatctttaaagacttgatgaataaacactttttctggtcaatgtctttccctgtttcctgttcattcaataaatatcattgtacatttc

SEQ ID NO: 2 - DNA, 729 bp, Homo sapiens
  ENST00000495442
gtgtgctgtaggataataaagcttttcccccaaaaaacaggtgaatacttaaactaattcaaagagagaagaaagcttcctgaaaggtcatttaattgacttttgctttccaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaaggtaagccactcacactcctccaaaaggcagtcagagctccttcagcttgccccccaaaccttctccttcataaaacgctgggtaaatatttgtcaaaaacatcaaattactcacactgcacattattatagaaaaacacatttattggagagggccgctgactctgtcaaacctcagagagtccataggattgcttatgggtaatgatttggaatagatttggtttcccactgtactgattaggtttccttgggcactatgctacccagaactaagggaaagaatactctctgctcatggagacccaaatctgtcttaattttttttctttccaatgtcacagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 3 - DNA, 509 bp, Homo sapiens
  ENST00000495709
gaacagagctatgtattggcattgacagaggtatatgcgttatgttagttatttaagaaataatctggagaatttatcatcccctctgagagatttctgcacaatttaattaaggaccctatagtgtgctgtaggataataaagcttttcccccaaaaaacaggtgaatacttaaactaattcaaagagagaagaaagcttcctgaaaggtcatttaattgacttttgctttccaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 4 - DNA, 4844 bp, Homo sapiens
  ENST00000318602
gaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacaatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 5 - DNA, 471 bp, Homo sapiens
  ENST00000545828
caaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcattgccagagctgcctggggaatacagcatgaaagtgacaggagaaggatgtgtctacctccagacatccttgaaatacaatattctcccagaaaaggaagagttcccctttgcttta

SEQ ID NO: 6 - DNA, 563 bp, Homo sapiens
  ENST00000542567
ataaattactgaaaagatcattgaagaagaaattctgaaaatcacaggaaaccagtagcccatttttaagatatttatatattactgttgtattaaaggcggacaacttttcaggaggagtttaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggc

SEQ ID NO: 7 - DNA, 546 bp, Homo sapiens
  ENST00000462568
cctctgttctccttccctctctactccctttcttatgtgtggtttcaggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggtgagtctccagcccctagtggatccgggcattaacagcttctattatactatttttatttcccataaatatttactaaaaataatactataattttaacttctttcttctct

SEQ ID NO: 8 - DNA, 593 bp, Homo sapiens
  ENST00000546069
aatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggtttacaacctgctaccagaaaaggacctcactggcttccctgggcctttgaatgaccaggacaatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtc

SEQ ID NO: 9 - DNA, 692 bp, Homo sapiens
  ENST00000472360
agcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtgagttcctggcagcctcaggaatcaagaagggccgtgccaggggctcagagcaaggaaaaatgactggataagtaggataagatcaattaaaattatatttatctaggaattaattgctttgagctctcttgtgggctttcattggtaaggaattatatatatatatatatataactactcacttctgcagttaaaaaaataaacaaaatacaatatattgaa

SEQ ID NO: 10 - DNA, 590 bp, Homo sapiens
  ENST00000539638
ctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgcttgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatga

SEQ ID NO: 11 - DNA, 623 bp, Homo sapiens
  ENST00000404455
atacaagagatgtgagaagcaccataaaaggcgttgtgaggagttgtgggggagtgagggagagaagaggttgaaaagcttattagctgctgtacggtaaaactccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcag

SEQ ID NO: 12 - DNA, 533 bp, Homo sapiens
  ENST00000467091
ttaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctaagtgattcctgtccatgccaactttccctgctgagaacaagggagtgaag

SEQ ID NO: 13 - DNA, 533 bp, Homo sapiens
  ENST00000497324
tgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccggtccattttctattttataaaaataaagacaattctctcccacaaccaaacatggaacaatgccctggagtataaaaatctatagagtgccaaataaaggaacaatttgaaatactggtgttgatattgaaaaagcaagggactctaatgtcagaagagaaatccttttgcagatgaggtggtgatgaattctttgtttcaacacaactgaaggaggaactgaaggaaataccagctgatgagtgatgagaagggattcttgataatagagtactagg

SEQ ID NO: 14 - DNA, 2331 bp, Homo sapiens
  ENST00000460376
ctttcttgatgccgttacgtccatggatttttttccaggattaaatttggaaggctatcctaacagagacagtacgaaatatgctgagatttatggcatttcttctgctcacactttgttgcgggggacactgagatataagggattggaatgctgaataatggattggaatgttgaataatgttgaataccttcctatggtatcctccctaactccttccccttgaaccacccagccccatctatggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggtaggcacccaccactcaacttagagcaaaatatactggatcaatgattgctaatttctactcagaaaaagttaaatattttacatttgtctttgattaattcgttgctctaatgtgggtagagagattaccatgtgccatgttcatgtgggcataaagagtagataaagagaggagctcaatggcaattagaatttgagaaatgcttatctcgaaacactttaccactcagttcccaagcatagtggggtatttttgctttcctgtaggagatttggagtagtcatagaatattacatgaaaacattctttcatatgaccgctgtggcatcctgctggtatacctaatgttggagaactaacctataaattaatctcataaagatctttgtaagaacatgggattacaatccatcatctctgccctgctccagggagcagtgcctgggtgagtctggagaagattctgaaggttaaaacattgctattgttattgttattttacattttaggagaatcctacaacttgagttaccaccttgtaattctgccctttcaagattaaattcaaggagctcccttttgcttcccaaatgagaacatgtataggacttgaactaatgcagccatctcctgtgcttttcaggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatgatcatgctatttgttaatttattgtgccactttttttcttttgttttttttttgttgttgttgttttttgagatggagtctcgctctgtcacccaggctggagtgcagtggcgcgatctcggctcactgcaagctccgcctcctgggttcacgccattctcctgcctcagcctcccaagtagctgggactacaggcacccgccaccacgcccggctaaattttttgtatttttcagtagagacggggtttcaccatgttagccaggatgtccacttttttcttaaatgaacatattgtcttataaccagcaaatgaagttttacttttttagtcagaaaaaatttcgtcataaagctatatttttatatttttaaaattgatacagttagataccttcagattacctaagttaagtttttgccaaaatgctattttatgccctttttgtaaagttatgatttattttgtaaatatagttccttatagttttctcttgagtgtttggacatgagaatagataagattaaattacaatttacaagatcacttcattaggcacaggaaaagtatttaacaaaattcaacaccctttcac

SEQ ID NO: 15 - DNA, 3233 bp, Homo sapiens
  ENST00000393376
cctcagatttctcaggagaccagaactgatctgccagccttgctgccttttgttgctctgctctttacattgtctttacagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatgatcatgctatttgttaatttattgtgccactttttttcttttgttttttttttgttgttgttgttttttgagatggagtctcgctctgtcacccaggctggagtgcagtg

SEQ ID NO: 16 - DNA, 1816 bp, Homo sapiens
  ENST00000473553
catcccagtttcttctaggaattcggagcctcccctgcagcgactcggaagattcgaggcggcgggggacaagtcggcgccccagagcggacgagatattatcagacgcgacacagcctcttgaaagtcagaatttttctcctgtggtgagagatgcagtgattacatccaacggtacattacctgataaatataaatatatccagacactccgggagagcaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatgatcatgctatttgttaatttattgtgccactttttttcttttgttttttttttgttgttgttgttttttgagatggagtctcgctctgtcaccc

SEQ ID NO: 17 - DNA, 3163 bp, Homo sapiens
  ENST00000417368
aaacacctcctacttcccggccttccatcccagtttcttctaggaattcggagcctcccctgcagcgactcggaagattcgaggcggcgggggacaagtcggcgccccagagcggacgagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagccactaacagagaactttaataattctaccctgtattttataaatacgtatgtgaaagtgatga

SEQ ID NO: 18 - DNA, 2922 bp, Homo sapiens
  ENST00000431170
gctgccttttgttgctctgctctttacattgtctttacagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagcca

SEQ ID NO: 19 - DNA, 3126 bp, Homo sapiens
  ENST00000358954
gctgccttttgttgctctgctctttacattgtctttacagtcaccaggtgtcaagatgctgcaagtacataggactggactgggcaggctgggggtcagcctctccaagggtcttcaccacaaagctgtgttggccgtccggagggaggatgtgaacgcctgggagagaagggccccgctagctcccaagcacatcaaaggcatcaccaatctgggatacaaggtcttgatacagccttcgaatcggcgggccattcatgataaggactatgtcaaagctggtggcattcttcaggaggatatttctgaagcttgtctaattttaggagttaaaagacctccagaggaaaaattaatgtccaggaagacttatgcatttttctcccacacaataaaagctcaggaggccaatatgggcttgttggatgagattctaaaacaggaaattcgccttattgattatgagaaaatggtggatcatagaggagtacgggtagtggcatttggacagtgggctggtgtggcaggaatgatcaacattttacatggaatgggtttaaggctccttgctttgggacatcacacaccttttatgcacattggcatggctcataactacaggaatagcagtcaggctgtgcaagctgtccgtgatgctggctatgaaatatctttgggtttgatgcctaagtcaataggacccttaacatttgtgttcacaggaactggtaatgtttctaagggagcccaagcaatctttaatgagctaccttgtgaatatgtggagccccatgaattaaaagaagtttcccaaactggagacctcagaaaagtgtatgggacggtgttaagtcgtcatcatcatcttgtcaggaaaacagatgctgtgtatgatcctgcagagtatgacaaacatccggagcgctacataagtcgttttaatactgatattgcaccctatacaacttgcttaattaatggaatctactgggaacaaaacactcctcgcctcctaacccgccaagatgctcagagtctcctggctccgggcaagttctcacctgctggtgtggaaggctgccctgcattaccacacaaactcgtggcaatatgtgacatttcagctgacacaggagggtctatagagtttatgactgagtgtacaacaatagagcatcccttttgcatgtatgatgcagaccagcatattattcatgacagtgttgaaggctcggggatcctgatgtgttccattgacaatttgccggcacagctcccaattgaagctacagaatgctttggagacatgctttacccttatgttgaagaaatgatattatcagacgcgacacagcctcttgaaagtcagaatttttctcctgtggtgagagatgcagtgattacatccaacggtacattacctgataaatataaatatatccagacactccgggagagcagggaacgtgctcagtcactttcaatgggcaccaggagaaaggttttggttcttggatctggctacatatctgagcctgtattagaatatttatcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcttgtggccaaggcctgcatcacaaacaaagttaacatggtcactgcaagctacatcacaccagcactaaaagaattggaaaagagtgtggaagatgctggcatcacaatcattggtgaattgggattggaccctggtctggatcacatgttagcaatggaaacaatagataaagccaaggaagtgggagccacgattgaatcatatatttcctactgtggtgggcttccagcccctgaacattcaaacaatccattgagatataaatttagctggagtccagtgggagttttgatgaatgtaatgcagtctgccacctatctgctcgatggaaaggttgtgaatgttgcaggaggcatctcctttcttgatgccgttacgtccatggatttttttccaggattaaatttggaaggctatcctaacagagacagtacgaaatatgctgagatttatggcatttcttctgctcacactttgttgcgggggacactgagatataagggattggaatgctgaataatggattggaatgttgaataatgttgaataccttcctatggtatcctccctaactccttccccttgaaccacccagccccatctatggatatatgaaagctttgaatggatttgtaaaattaggtcttataaacagagaagcgcttcctgcctttagacctgaggccaaccctctcacctggaaacaactcctctgtgacctagttgggatttcaccctcctctgagcatgatgtgttgaaggaagctgttcttaagaaactaggaggagacaatacccagttggaggctgctgaatggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggtgaaattggagccaaaggcctaatggggcccttttcaaaggagatctatggaccaatattggagcgaattaaagcagaaggcattatatatactacacagagtacaattaaaccataattgggaattatattttgtttttttcttcccaggcaatacacctctgaacatgtgtgtgataaatgggtttgctaatgtgctgttttaaagtataaagcataatatgttttggttaacacaatgtactttttgaactataaatctttattttaatatggaaatgtttggaacaggagatgcaagcca

SEQ ID NO: 20 - DNA, 722 bp, Homo sapiens
  ENST00000426162
tggattggaatgttgaataatgttgaataccttcctatggtatcctccctaactccttccccttgaaccacccagccccatctatggatatatgaaagctttgaatggatttgtaaaattaggtcttataaacagagaagcgcttcctgcctttagacctgaggccaaccctctcacctggttgggatttcaccctcctctgagcatgatgtgttgaaggaagctgttcttaagaaactaggaggagacaatacccagttggaggctgctgaatggagatttggagtagtcatagaatattacatgaaaacattctttcatatgaccgctgtggcatcctgctggtatacctaatgttggagaactaacctataaattaatctcataaagatctttgtaagaacatgggattacaatccatcatctctgccctgctccagggagcagtgcctgggttgggcttacttggggatgaacaagttcctcaggcagagtccattctggatgccctctccaagcatttggtcatgaagctttcctatggtcctgaagaaaaagatatgattgtgatgagagacagctttggaatcagacatccttctggacatttagaacataaaacgattgatcttgtggcttatggggacatcaatggcttttcagccatggctaaaaccgtggggttacccaccgccatggcagccaaaatgttgcttgatggt

SEQ ID NO: 21 - DNA, 5257 bp, Homo sapiens
  ENST00000326724
atgcccgccggccgctggcccggccatgtcgtcgtccttcttcaaccccagcttcgccttcagctcgcacttcgaccccgacggcgccccgctcagcgagctgtcctggccatcctccctcgccgtggtggctgtgtctttctccgggctcttcgccgtcatcgtcctcatgctggcctgcctgtgctgtaagaagggcggtatcgggttcaaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaattttgagtacaagtgggaggcgggccgcggcgcggaggccttcccggccacgctgagccctggccgcaccgcacgcctgcaggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagacaaaagaaa

SEQ ID NO: 22 - DNA, 2108 bp, Homo sapiens
  ENST00000570932
tcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagacaaaag

SEQ ID NO: 23 - DNA, 4938 bp, Homo sapiens
  ENST00000374792
gatgcggcggctcgggccggggccgcgggcgtcctgagcgcagcgccctcccgggatgcccgccggccgctggcccggccatgtcgtcgtccttcttcaaccccagcttcgccttcagctcgcacttcgaccccgacggcgccccgctcagcgagctgtcctggccatcctccctcgccgtggtggctgtgtctttctccgggctcttcgccgtcatcgtcctcatgctggcctgcctgtgctgtaagaagggcggtatcgggttcaaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagacaaaag

SEQ ID NO: 24 - DNA, 5081 bp, Homo sapiens
  ENST00000417379
gccaccaggtgaaggtccaaggctgctggggcagatggcggtggcaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaattttgagtacaagtgggaggcgggccgcggcgcggaggccttcccggccacgctgagccctggccgcaccgcacgcctgcaggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggccgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctacctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaaga

SEQ ID NO: 25 - DNA, 754 bp, Homo sapiens
  ENST00000573469
agcctcttgctcagccacactgcctgcctggtgcagcccatgtgacgggtcgagctccgggccctgctgtccctggccgggctatcccagtggcttcaggcaccttctccagacctacccagaaagatgcccggatggatcctgcagctccgtggcttttctgggaagcagcggcccctgctctcaagagaccctggctcctgatggtggccccaaggttgccagctggtgctagggactcaggacagtttcccagaaaaggccaagcgggcagcccctccaggggccgggtgaggaagctggggggtgcggaggccacactgggtccctgaaccccctgcttggttacagtgcagctcctcaagtccacagacgtgggccggcacagcctcctgtacctgaaggaaatcggccgtggctggttcgggaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggaca

SEQ ID NO: 26 - DNA, 581 bp, Homo sapiens
  ENST00000573441
cgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctgggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaa

SEQ ID NO: 27 - DNA, 679 bp, Homo sapiens
  ENST00000572339
agccacactgcctgcctggtgcagcccatgtgacgggtcgagctccgggccctgctgtccctggccgggctatcccagtggcttcaggcaccttctccagacctacccagaaagatgcccggatggatcctgcagctccgtggcttttctgggaagcagcggcccctgctctcaagagaccctggctcctgatggtggccccaagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattg

SEQ ID NO: 28 - DNA, 938 bp, Homo sapiens
  ENST00000576053
agtgccctctctgtgccgtggccccagcctcttgctcagccacactgcctgcctggtgcagcccatgtgacgggtcgagctccgggccctgctgtccctggccgggctatcccagtggcttcaggcaccttctccagacctacccagaaagatgcccggatggatcctgcagctccgtggcttttctgggaagcagcggcccctgctctcaagagaccctggctcctgatggtggccccaaggttgccagctggtgctagggactcaggacagtttcccagaaaaggccaagcgggcagcccctccaggggccgggtgaggaagctggggggtgcggaggccacactgggtccctgaaccccctgcttggttacagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactggccaagggactcctgctgcccggggctggctgaggggcagtggagaggaagccttcagtccagcccagccctgggggacacggcccccctccaggaactgctgggtgctggccactgtgcagggcacgaggctgctctgggcagctgctgtccctcagctggggacctcaagggctacctgcggagctgccgggtggcggagtccatggctcccgacccccggaccctgcagcgcatggcctgtgaggtggcctgtggcgtcctgcaccttcatc

SEQ ID NO: 29 - DNA, 475 bp, Homo sapiens
  ENST00000575363
attccagcaccagtgtgcccctgggaagtcctgcctccacactgggctccctcctgggatttggggacctgcgctgggctccctggtggggagctgtgctgagggaaggggctgggcaggcccccaatgctgaccctgtgctacctgattgcacgctgtatcggcaggacccggctggcccccgggcagcaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagc

SEQ ID NO: 30 - DNA, 407 bp, Homo sapiens
  ENST00000572798
tgggtgatgcggcggctcgggccggggccgcgggcgtcctgagcgcagcgccctcccgggatgcccgccggccgctggcccggccatgtcgtcgtccttcttcaaccccagcttcgccttcagctcgcacttcgaccccgcagaagcagccggaccccctggcggccccagatctcggaggggcaggccctgggccccagcacaaaccggcctccgcctgtgggctggcgtcccccgcgtggtcgtgactccgtggctgcctccagggcacagacggcgccccgctcagcgagctgtcctggccatcctccctcgccgtggtggctgtgtctttctccgggctcttcgccgtcatcgtcctcatgctggcctgcctgtgctgtaagaagggcggtatcgggttcaag

SEQ ID NO: 31 - DNA, 4836 bp, Homo sapiens
  ENST00000268251
ggccgggacgctcggcggagccagggagtccggcgagtcgctgggggaagtcgagcagacacccagcgctgccggaactcggggcgcgcatcccgcaagtcggaacccggcggatcggatcccgcagatcggagacggggcctggagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggaggggaggggagggaagggctggtgttgattttcctccctgcagagccaatggtgcacattggtttaagcccagagatcctgcttgagccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcccggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctatgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcgtatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttagctagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatga

SEQ ID NO: 32 - DNA, 466 bp, Homo sapiens
  ENST00000564714
ggcgagtcgctgggggaagtcgagcagacacccagcgctgccggaactcggggcgcgcatcccgcaagtcggaacccggcggatcggatcccgcagatcggagacggggcctggagatgcgcccatccagggtctagcggattgcaaagggcctggtagaatcaaagagggatatactaatgcaacttcgagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacga

SEQ ID NO: 33 - DNA, 1870 bp, Homo sapiens
  ENST00000563992
gagcagacacccagcgctgccggaactcggggcgcgcatcccgcaagtcggaacccggcggatcggatcccgcagatcggagacggggcctggagggtggcagcacgcaaagggtgtccctgtccctcaaggggtcatggcctccatgttgctcgcccagcgcctggcctgcagcttccagcacagctaccgcctgctggtgcctggtaagccccgggggtcttgataagaactggtactaatggaagataccatccagactagggattcctgggctggaagagcccttggggataaagggaccagccagtgagtgtttctgggactgtcccactgtattagtctgttctcatgctgctaataaaggtacacctgagactgggtattttatgaagaaaaagaggtttaatggtctcacagtttcatatggctggggaggcctcacaatcatggcggaaggtgaaggaggaacaaaggcacgtcttacatggctacaggcaagagagcatgtgcaggggaactcccgtttgtaaaaacatcagatcgtgtgagacttactcaattgactatcatgagaacagcatgggaaagacccacccccatgattcaattacctcccactgggtccctcccatgacgtgggaattatgggagctatgatttaagatgagatttgaatgaggacacagccaaaccacatcacccactatccataaaactgtcaccatcgccacctcctttctctctcccatctctgtcatatgatcctgtcccaagtgcctcggtctgatgggattggatccaccctggagccactctgcctgcaggtaggcggtggcctccacagccagatggccccaggccatctctgcagggaccgctggggaaaacacacatctgggatcgctgctaaggaacaaagaaagccataagcgactctgaaattgacctagagcccagctgtgcttcagggtcactggatcactggatgggaggcaccatcttaggaatgtctcacccccactctgccccacacccatggccacttgcactggctccttcttccttctgtttgacgtctttgagacctccctcccaatagtcccatgagggagggaggctcaagtgaatcctattttacaggtgagagaactcaggcttagagaagcaaagccatttgcccaaggtcacacagccacttgcaagcaactctgtccggctccaatgctaactactcctccgtgtgcctccatgtggctctggagacagagccgccagcaggagcctcccttcacatgccccgagagtggcctcctgcagagatataaagtgcctggctcggggctggccatgaaataggttcagaaagaccagtgagcctccagcctgtccccagctctctcacagcccctgtgcttgtcatcatggtgtcccttgttggcaggccttactgccttctgaagacaaactgctagccgtgtccttggtctgcatgttgaatgctggtgtgtatgtcctgggtggcataaacagtaggagcgttcgcccctccccaaggagtatgagtaggctttattttaaaataaacatcttggccgggcgcagtggctcacaactgtaatcccagcactttgggaggcgaggtgggcagatcacctgaggtcaggggtcgagaccagcctggccaacatggtgaaaccccgtctctaccaaaaatacaaaaattagccaggtatggtggtggatgcctgtaatcccaactactcagcaggctgaggcaggagaatcgcttgaatccaggaggtagaggtggcagtgagctggatcgtgccactgtactccagcctgggcaacatcgaggctctgtctc

SEQ ID NO: 34 - DNA, 580 bp, Homo sapiens
  ENST00000568847
gatttagaaccagtgtgtctctcctgcagcctccattctgggtgcctccacccccttgccgtcgtcatgttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggatccagacacattagtcaagctgc

SEQ ID NO: 35 - DNA, 592 bp, Homo sapiens
  ENST00000561870
ataccccctccccatcttgtgatcaccctcattacctcttctgggccccctgtggacctgcgttgacccagcatgggctacaatgggggagttgggtaatcgctcccgctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattc

SEQ ID NO: 36 - DNA, 470 bp, Homo sapiens
  ENST00000569695
atcttgtgatcaccctcattacctcttctgggccccctgtggacctgcgttgacccagcatgggctacaatgggggagttgggtaatcgctcccgttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcacc

SEQ ID NO: 37 - DNA, 2423 bp, Homo sapiens
  ENST00000566590
ctcttctgggccccctgtggacctgcgttgacccagcatgggctacaatgggggagttgggtaatcgctcccggtaggttcctccccaacccccgaggcggggtcaggtggagcgtgggcgccagagcagcccctctgccttgggtgtcttggagatgacttggcgccccccggagccccgtcatggctgtggctgcgtccacaacactgcatcagcagagtcctggggaagccatttaggaatctgaagcccgggatttctgctttgtcccttcaggggttcctgagcctgttaaaaaaaaaaaaaaatctaggaagaggccctggaaggaaaaaggggagggagatagcctattttacaaggtctgaaatgatgtgtcttatccttctggcttaaaccaagctgggcttaaaacatcttttaaaaaaaatctgtattctatttttttctctctgtttatcgctctccttctgcctctgttaatctttgtttctgtgtagttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaa

SEQ ID NO: 38 - DNA, 1548 bp, Homo sapiens
  ENST00000563215
gatgtgtcttatccttctggcttaaaccaagctgggcttaaaacatcttttaaaaaaaatctgtattctatttttttctctctgtttatcgctctccttctgcctctgttaatctttgtttctgtgtagttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggcaagatgtgggaatcctgaaaggttggcgctgaagatcctgcagttggtgtgtgcaagctggcagccaggccgctgccggaggaagggggtcctctgtgctttgcatgtccctgggtatttgggaaacttggcagccggttgctctaagtgaaccctgactctggagtaggcactgggcaccctggcggagaggacagagccggagacaaggactggcctcagggagtttccagttcaaataggaacagacccgatcacacgcgatacgctcaccctcagacacattgctgctgcctgcatttcctccgggctgccatcccccttcccctaccctggcctctgtctgccacgactgcccttgtctacctgccaagctctaattatcgttaaacatcccgtcactgcttcccggaaatctttaacttccacccaagaacagctaacactatacgccctcctctacctgcagaaatcacttggaccctctgacatcacatgtccaaccgacctctttctccacatttgcccgtgagctgcacttcattttgcaaggacataaagaagactattcacgcaactacatgcaaaatgactggctgggattcctaaaacgccaatgtcttttaaaaggcaaaagggctgagaaatggttccaggttaaaagagattaaagagccatgagcccaaatgcaatgtttgatcctaggatgaagcctggatcaggggaacagaaaacacttgtgggctgggctcagtggctcatacctgtaatcccagtgctttgggagtccgagggaggaggatcacttgaagtcaagagttagagactagcctcaggaatatagggagaccccatctctacaaaaaataaatataaaaataaactaaccagacatagtggtgtgtgcctgtgatcccagctactcaggaggctgaggcaagaggatcacctgagcccaagagttcgaggctgcagtgagccatgagccatgatcatgccactgcactccagcctaggtgatagagcgagaccctgtctct

SEQ ID NO: 39 - DNA, 580 bp, Homo sapiens
  ENST00000565016
gcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggatccaatccaggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatg

SEQ ID NO: 40 - DNA, 1959 bp, Homo sapiens
  ENST00000567812
accagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccgtgagtgcaaatgtggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtctt

SEQ ID NO: 41 - DNA, 1923 bp, Homo sapiens
  ENST00000425191
tttgtgtccctttgagtctgcagagaagccagcagctggggctgcagacgggaaaggaatgtcctcagcgtctgccagcacttttgtcttggtcccaacggctgataggaaaatgagaggcagggtcttttctagagagatctggggggtccatttctagccgatgatgcatgcaaagagttcgtgttcacaggacctgggaagcagcggagtagaaagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggagggga

SEQ ID NO: 42 - DNA, 1911 bp, Homo sapiens
  ENST00000569156
gtgtccctttgagtctgcagagaagccagcagctggggctgcagacgggaaaggaatgtcctcagcgtctgccagcacttttgtcttggtcccaacggctgataggaaaatgagaggcagggtcttttctagagagatctggggggtccatttctagccgatgatgcatgcaaagagttcgtgttcacaggacctgggaagcagcggagtagaaagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaagctctcccagcatgtgactttgagaaaccacgctcctcacctacctcctgcctctttcaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatc

SEQ ID NO: 43 - DNA, 634 bp, Homo sapiens
  ENST00000562115
aggaaaatgagaggcagggtcttttctagagagatctggggggtccatttctagccgatgatgcatgcaaagagttcgtgttcacaggacctgggaagcagcggagtagaaagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccatagagtctcactgtcacccaggctggagtgcagtggcgtgatctcaactcaatgcaacctccgcctcttgtgttcaagagattcttctgcctcagccccccgagtacctgggattacaggttacagccaccccgccctgctgaaactcatccaacagcctcaaaatg

SEQ ID NO: 44 - DNA, 596 bp, Homo sapiens
  ENST00000565671
atccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgatacgaagcttggagtagaactgctggccatgtacagctcctgcagatcctgccagacagttctccaaatcgatcgcaccaactccactcccacagccgggggagggttccagtcttgccacatcctcgccaacacggggtatcactggaagatttttctttgactcagagagtaacatacttatccacacatgacaaggaacttgatcccagaaagaaatctaagaaaggcagaaggaacaaagacccaatcctggtcagaaaaggggtccctagccctaaaacgtacttcactttaaat

SEQ ID NO: 45 - DNA, 572 bp, Homo sapiens
  ENST00000564453
ttatttaaatattctaaattgcagagacagagtcccactttgttgcccagcatggtctcaaactcttggcctcaagcaatcctcctgtcttagccacccaaagtactaggattacagatttgagcccgcacatctggcctccattcttcctggcaaaacatgcaacgctctcagcagatcttaatccaacagatcttaatcgttgctgatggtgcttaatgcattatgtgtgttagtttcttttgttgcgagcacagttggtagcctcacgtttcagtacagacctgcaacaattaatacatgagatccactcctgagaaagcactttctacttgtctggactgaatatcggtttggttggaaagatgaagccccgactaccccagagcatctctgagattttgttctgttctattgtttcagagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactc

SEQ ID NO: 46 - DNA, 5586 bp, Homo sapiens
  ENST00000396600
tcttgtgatcaccctcattacctcttctgggccccctgtggacctgcgttgacccagcatgggctacaatgggggagttgggtaatcgctcccggtaggttcctccccaacccccgaggcggggtcaggtggagcgtgggcgccagagcagcccctctgccttgggtgtcttggagatgacttggcgccccccggagccccgtcatggctgtggctgcgtccacaacactgcatcagcagagtcctggggaagccatttaggaatctgaagcccgggatttctgctttgtcccttcaggggttcctgagcctgttaaaaaaaaaaaaaaatctaggaagaggccctggaaggaaaaaggggagggagatagcctattttacaaggtctgaaatgatgtgtcttatccttctggcttaaaccaagctgggcttaaaacatcttttaaaaaaaatctgtattctatttttttctctctgtttatcgctctccttctgcctctgttaatctttgtttctgtgtagttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggaggggaggggagggaagggctggtgttgattttcctccctgcagagccaatggtgcacattggtttaagcccagagatcctgcttgagccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcccggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctatgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcgtatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttagctagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatga

SEQ ID NO: 47 - DNA, 923 bp, Homo sapiens
  ENST00000374733
gtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagtgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtaagctgatgcctccagcttcctcagtagggctgatggcaattacgttgtgcagctactggaaagaaatgaataaacccttgtccttgtaatggtggtgaaggggagggaggtagtttgaatacaacttcacttaattttacttccctattcaggcaggaattgccaaaccatccaggagtggaatatgcaacctggcgtcatgggccagctggttaaaataaaattgatttctggctta

SEQ ID NO: 48 - DNA, 1540 bp, Homo sapiens
  ENST00000423487
gtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgatggatgtgacatgtgatgacattgcacatgggcagttaactgtgccaagaagtgcagcagtagcagcaaccggagatgcaaagcccaacatgatggggagagaaactcttctttcaatatgtgcttctgtaccaaaagtggaatttcacgagagacatattttgaaacatttctccttttgtgtgtgcgtgagtgtttccctgtttccagccaagggtattgtgagtttctcctgggcctccttcagaatctgggtgctctggaaagcagtgttttggcaacatggggaaagtatggcagtgtgggagggtcagctgggtctgggtttgaatattgcatttgaatattttaccagcattgatgtcggataaattatttagtccctgtaagcctcagttttctcttcttctacatacacataatatatttgactctttgttgtgattattggttacacatatgaagagcctggtgtggggcctggcacacaataggtgctcaataaatagaagttgataattt

SEQ ID NO: 49 - DNA, 807 bp, Homo sapiens
  ENST00000494467
ggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggtacactgctttgggcatctgtttggaaaatatgacttctagctgatgtcctttctttgtgctagaatctctgcagtgcatgggcttccctg

SEQ ID NO: 50 - DNA, 10494 bp, Homo sapiens
  ENST00000374736
agagcacaggctttgaccgatagtaacctctgcgctcggtgcagccgaatctataaaaggaactagtcccggcaaaaaccccgtaattgcgagcgagagtgagtggggccgggacccgcagagccgagccgacccttctctcccgggctgcggcagggcagggcggggagctccgcgcaccaacagagccggttctcagggcgctttgctccttgttttttccccggttctgttttctccccttctccggaaggcttgtcaaggggtaggagaaagagacgcaaacacaaaagtggaaaacagttaatgaccagccacggcgtccctgctgtgagctctggccgctgccttccagggctcccgagccacacgctgggggtgctggctgagggaacatggcttgttggcctcagctgaggttgctgctgtggaagaacctcactttcagaagaagacaaacatgtcagctgctgctggaagtggcctggcctctatttatcttcctgatcctgatctctgttcggctgagctacccaccctatgaacaacatgaatgccattttccaaataaagccatgccctctgcaggaacacttccttgggttcaggggattatctgtaatgccaacaacccctgtttccgttacccgactcctggggaggctcccggagttgttggaaactttaacaaatccattgtggctcgcctgttctcagatgctcggaggcttcttttatacagccagaaagacaccagcatgaaggacatgcgcaaagttctgagaacattacagcagatcaagaaatccagctcaaacttgaagcttcaagatttcctggtggacaatgaaaccttctctgggttcctgtatcacaacctctctctcccaaagtctactgtggacaagatgctgagggctgatgtcattctccacaaggtatttttgcaaggctaccagttacatttgacaagtctgtgcaatggatcaaaatcagaagagatgattcaacttggtgaccaagaagtttctgagctttgtggcctaccaagggagaaactggctgcagcagagcgagtacttcgttccaacatggacatcctgaagccaatcctgagaacactaaactctacatctcccttcccgagcaaggagctggctgaagccacaaaaacattgctgcatagtcttgggactctggcccaggagctgttcagcatgagaagctggagtgacatgcgacaggaggtgatgtttctgaccaatgtgaacagctccagctcctccacccaaatctaccaggctgtgtctcgtattgtctgcgggcatcccgagggaggggggctgaagatcaagtctctcaactggtatgaggacaacaactacaaagccctctttggaggcaatggcactgaggaagatgctgaaaccttctatgacaactctacaactccttactgcaatgatttgatgaagaatttggagtctagtcctctttcccgcattatctggaaagctctgaagccgctgctcgttgggaagatcctgtatacacctgacactccagccacaaggcaggtcatggctgaggtgaacaagaccttccaggaactggctgtgttccatgatctggaaggcatgtgggaggaactcagccccaagatctggaccttcatggagaacagccaagaaatggaccttgtccggatgctgttggacagcagggacaatgaccacttttgggaacagcagttggatggcttagattggacagcccaagacatcgtggcgtttttggccaagcacccagaggatgtccagtccagtaatggttctgtgtacacctggagagaagctttcaacgagactaaccaggcaatccggaccatatctcgcttcatggagtgtgtcaacctgaacaagctagaacccatagcaacagaagtctggctcatcaacaagtccatggagctgctggatgagaggaagttctgggctggtattgtgttcactggaattactccaggcagcattgagctgccccatcatgtcaagtacaagatccgaatggacattgacaatgtggagaggacaaataaaatcaaggatgggtactgggaccctggtcctcgagctgacccctttgaggacatgcggtacgtctgggggggcttcgcctacttgcaggatgtggtggagcaggcaatcatcagggtgctgacgggcaccgagaagaaaactggtgtctatatgcaacagatgccctatccctgttacgttgatgacatctttctgcgggtgatgagccggtcaatgcccctcttcatgacgctggcctggatttactcagtggctgtgatcatcaagggcatcgtgtatgagaaggaggcacggctgaaagagaccatgcggatcatgggcctggacaacagcatcctctggtttagctggttcattagtagcctcattcctcttcttgtgagcgctggcctgctagtggtcatcctgaagttaggaaacctgctgccctacagtgatcccagcgtggtgtttgtcttcctgtccgtgtttgctgtggtgacaatcctgcagtgcttcctgattagcacactcttctccagagccaacctggcagcagcctgtgggggcatcatctacttcacgctgtacctgccctacgtcctgtgtgtggcatggcaggactacgtgggcttcacactcaagatcttcgctagcctgctgtctcctgtggcttttgggtttggctgtgagtactttgccctttttgaggagcagggcattggagtgcagtgggacaacctgtttgagagtcctgtggaggaagatggcttcaatctcaccacttcggtctccatgatgctgtttgacaccttcctctatggggtgatgacctggtacattgaggctgtctttccaggccagtacggaattcccaggccctggtattttccttgcaccaagtcctactggtttggcgaggaaagtgatgagaagagccaccctggttccaaccagaagagaatatcagaaatctgcatggaggaggaacccacccacttgaagctgggcgtgtccattcagaacctggtaaaagtctaccgagatgggatgaaggtggctgtcgatggcctggcactgaatttttatgagggccagatcacctccttcctgggccacaatggagcggggaagacgaccaccatgtcaatcctgaccgggttgttccccccgacctcgggcaccgcctacatcctgggaaaagacattcgctctgagatgagcaccatccggcagaacctgggggtctgtccccagcataacgtgctgtttgacatgctgactgtcgaagaacacatctggttctatgcccgcttgaaagggctctctgagaagcacgtgaaggcggagatggagcagatggccctggatgttggtttgccatcaagcaagctgaaaagcaaaacaagccagctgtcaggtggaatgcagagaaagctatctgtggccttggcctttgtcgggggatctaaggttgtcattctggatgaacccacagctggtgtggacccttactcccgcaggggaatatgggagctgctgctgaaataccgacaaggccgcaccattattctctctacacaccacatggatgaagcggacgtcctgggggacaggattgccatcatctcccatgggaagctgtgctgtgtgggctcctccctgtttctgaagaaccagctgggaacaggctactacctgaccttggtcaagaaagatgtggaatcctccctcagttcctgcagaaacagtagtagcactgtgtcatacctgaaaaaggaggacagtgtttctcagagcagttctgatgctggcctgggcagcgaccatgagagtgacacgctgaccatcgatgtctctgctatctccaacctcatcaggaagcatgtgtctgaagcccggctggtggaagacatagggcatgagctgacctatgtgctgccatatgaagctgctaaggagggagcctttgtggaactctttcatgagattgatgaccggctctcagacctgggcatttctagttatggcatctcagagacgaccctggaagaaatattcctcaaggtggccgaagagagtggggtggatgctgagacctcagatggtaccttgccagcaagacgaaacaggcgggccttcggggacaagcagagctgtcttcgcccgttcactgaagatgatgctgctgatccaaatgattctgacatagacccagaatccagagagacagacttgctcagtgggatggatggcaaagggtcctaccaggtgaaaggctggaaacttacacagcaacagtttgtggcccttttgtggaagagactgctaattgccagacggagtcggaaaggattttttgctcagattgtcttgccagctgtgtttgtctgcattgcccttgtgttcagcctgatcgtgccaccctttggcaagtaccccagcctggaacttcagccctggatgtacaacgaacagtacacatttgtcagcaatgatgctcctgaggacacgggaaccctggaactcttaaacgccctcaccaaagaccctggcttcgggacccgctgtatggaaggaaacccaatcccagacacgccctgccaggcaggggaggaagagtggaccactgccccagttccccagaccatcatggacctcttccagaatgggaactggacaatgcagaacccttcacctgcatgccagtgtagcagcgacaaaatcaagaagatgctgcctgtgtgtcccccaggggcaggggggctgcctcctccacaaagaaaacaaaacactgcagatatccttcaggacctgacaggaagaaacatttcggattatctggtgaagacgtatgtgcagatcatagccaaaagcttaaagaacaagatctgggtgaatgagtttaggtatggcggcttttccctgggtgtcagtaatactcaagcacttcctccgagtcaagaagttaatgatgccatcaaacaaatgaagaaacacctaaagctggccaaggacagttctgcagatcgatttctcaacagcttgggaagatttatgacaggactggacaccaaaaataatgtcaaggtgtggttcaataacaagggctggcatgcaatcagctctttcctgaatgtcatcaacaatgccattctccgggccaacctgcaaaagggagagaaccctagccattatggaattactgctttcaatcatcccctgaatctcaccaagcagcagctctcagaggtggctctgatgaccacatcagtggatgtccttgtgtccatctgtgtcatctttgcaatgtccttcgtcccagccagctttgtcgtattcctgatccaggagcgggtcagcaaagcaaaacacctgcagttcatcagtggagtgaagcctgtcatctactggctctctaattttgtctgggatatgtgcaattacgttgtccctgccacactggtcattatcatcttcatctgcttccagcagaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggctcatcgacatggtgaaaaaccaggcaatggctgatgccctggaaaggtttggggagaatcgctttgtgtcaccattatcttgggacttggtgggacgaaacctcttcgccatggccgtggaaggggtggtgttcttcctcattactgttctgatccagtacagattcttcatcaggcccagacctgtaaatgcaaagctatctcctctgaatgatgaagatgaagatgtgaggcgggaaagacagagaattcttgatggtggaggccagaatgacatcttagaaatcaaggagttgacgaagatatatagaaggaagcggaagcctgctgttgacaggatttgcgtgggcattcctcctggtgagtgctttgggctcctgggagttaatggggctggaaaatcatcaactttcaagatgttaacaggagataccactgttaccagaggagatgctttccttaacaaaaatagtatcttatcaaacatccatgaagtacatcagaacatgggctactgccctcagtttgatgccatcacagagctgttgactgggagagaacacgtggagttctttgcccttttgagaggagtcccagagaaagaagttggcaaggttggtgagtgggcgattcggaaactgggcctcgtgaagtatggagaaaaatatgctggtaactatagtggaggcaacaaacgcaagctctctacagccatggctttgatcggcgggcctcctgtggtgtttctggatgaacccaccacaggcatggatcccaaagcccggcggttcttgtggaattgtgccctaagtgttgtcaaggaggggagatcagtagtgcttacatctcatagtatggaagaatgtgaagctctttgcactaggatggcaatcatggtcaatggaaggttcaggtgccttggcagtgtccagcatctaaaaaataggtttggagatggttatacaatagttgtacgaatagcagggtccaacccggacctgaagcctgtccaggatttctttggacttgcatttcctggaagtgttctaaaagagaaacaccggaacatgctacaataccagcttccatcttcattatcttctctggccaggatattcagcatcctctcccagagcaaaaagcgactccacatagaagactactctgtttctcagacaacacttgaccaagtatttgtgaactttgccaaggaccaaagtgatgatgaccacttaaaagacctctcattacacaaaaaccagacagtagtggacgttgcagttctcacatcttttctacaggatgagaaagtgaaagaaagctatgtatgaagaatcctgttcatacggggtggctgaaagtaaagaggaactagactttcctttgcaccatgtgaagtgttgtggagaaaagagccagaagttgatgtgggaagaagtaaactggatactgtactgatactattcaatgcaatgcaattcaatgcaatgaaaacaaaattccattacaggggcagtgcctttgtagcctatgtcttgtatggctctcaagtgaaagacttgaatttagttttttacctatacctatgtgaaactctattatggaacccaatggacatatgggtttgaactcacacttttttttttttttttgttcctgtgtattctcattggggttgcaacaataattcatcaagtaatcatggccagcgattattgatcaaaatcaaaaggtaatgcacatcctcattcactaagccatgccatgcccaggagactggtttcccggtgacacatccattgctggcaatgagtgtgccagagttattagtgccaagtttttcagaaagtttgaagcaccatggtgtgtcatgctcacttttgtgaaagctgctctgctcagagtctatcaacattgaatatcagttgacagaatggtgccatgcgtggctaacatcctgctttgattccctctgataagctgttctggtggcagtaacatgcaacaaaaatgtgggtgtctccaggcacgggaaacttggttccattgttatattgtcctatgcttcgagccatgggtctacagggtcatccttatgagactcttaaatatacttagatcctggtaagaggcaaagaatcaacagccaaactgctggggctgcaagctgctgaagccagggcatgggattaaagagattgtgcgttcaaacctagggaagcctgtgcccatttgtcctgactgtctgctaacatggtacactgcatctcaagatgtttatctgacacaagtgtattatttctggctttttgaattaatctagaaaatgaaaagatggagttgtattttgacaaaaatgtttgtactttttaatgttatttggaattttaagttctatcagtgacttctgaatccttagaatggcctctttgtagaaccctgtggtatagaggagtatggccactgccccactatttttattttcttatgtaagtttgcatatcagtcatgactagtgcctagaaagcaatgtgatggtcaggatctcatgacattatatttgagtttctttcagatcatttaggatactcttaatctcacttcatcaatcaaatattttttgagtgtatgctgtagctgaaagagtatgtacgtacgtataagactagagagatattaagtctcagtacacttcctgtgccatgttattcagctcactggtttacaaatataggttgtcttgtggttgtaggagcccactgtaacaatactgggcagcctttttttttttttttttaattgcaacaatgcaaaagccaagaaagtataagggtcacaagtctaaacaatgaattcttcaacagggaaaacagctagcttgaaaacttgctgaaaaacacaacttgtgtttatggcatttagtaccttcaaataattggctttgcagatattggataccccattaaatctgacagtctcaaatttttcatctcttcaatcactagtcaagaaaaatataaaaacaacaaatacttccatatggagcatttttcagagttttctaacccagtcttatttttctagtcagtaaacatttgtaaaaatactgtttcactaatacttactgttaactgtcttgagagaaaagaaaaatatgagagaactattgtttggggaagttcaagtgatctttcaatatcattactaacttcttccactttttccagaatttgaatattaacgctaaaggtgtaagacttcagatttcaaattaatctttctatattttttaaatttacagaatattatataacccactgctgaaaaagaaaaaaatgattgttttagaagttaaagtcaatattgattttaaatataagtaatgaaggcatatttccaataactagtgatatggcatcgttgcattttacagtatcttcaaaaatacagaatttatagaataatttctcctcatttaatatttttcaaaatcaaagttatggtttcctcattttactaaaatcgtattctaattcttcattatagtaaatctatgagcaactccttacttcggttcctctgatttcaaggccatattttaaaaaatcaaaaggcactgtgaactattttgaagaaaacacaacattttaatacagattgaaaggacctcttctgaagctagaaacaatctatagttatacatcttcattaatactgtgttaccttttaaaatagtaattttttacattttcctgtgtaaacctaattgtggtagaaatttttaccaactctatactcaatcaagcaaaatttctgtatattccctgtggaatgtacctatgtgagtttcagaaattctcaaaatacgtgttcaaaaatttctgcttttgcatctttgggacacctcagaaaacttattaacaactgtgaatatgagaaatacagaagaaaataataagccctctatacataaatgcccagcacaattcattgttaaaaaacaaccaaacctcacactactgtatttcattatctgtactgaaagcaaatgctttgtgactattaaatgttgcacatcattcattcactgtatagtaatcattgactaaagccatttgtctgtgttttcttcttgtggttgtatatatcaggtaaaatattttccaaagagccatgtgtcatgtaatactgaaccactttgatattgagacattaatttgtacccttgttattatctactagtaataatgtaatactgtagaaatattgctctaattcttttcaaaattgttgcatcccccttagaatgtttctatttccataaggatttaggtatgctattatcccttcttataccctaagatgaagctgtttttgtgctctttgttcatcattggccctcattccaagcactttacgctgtctgtaatgggatctatttttgcactggaatatctgagaattgcaaaactagacaaaagtttcacaacagatttctaagttaaatcattttcattaaaaggaaaaaagaaaaaaaattttgtatgtcaataactttatatgaagtattaaaatgcatatttctatgttgtaatataatgagtcacaaaataaagctgtgacagttctgttggtctacagaaa

SEQ ID NO: 51 - DNA, 467 bp, Homo sapiens
  ENST00000512848
ggaagcagggctggggaagaaatggcaaactagggatcttacctgggccttcccagttgagactacgtcaaaatgggctcccatgagactgcctggctcatgcagatggaaggctaacatctttttagaaacaactcgtgctaccctctcctgttccaaaagcctgtctggtcagaatggtgtgatgagccctcctcttcagctaggaaaatgacggtgttcagaaagttaaaacttcttcgctggaaggatttcatcttaaagttgggagactggaagaaattaaagtgttctaaatggaagagcattcaccacatgtgttctgttttgggttgacatttagcttttgtttttattttagaaacggaagactctggtagcagtccttgaaatcttgatgccattgctattttctgcattgtattgtatcttcgttttagtagtgctccaataaaaagacctgctac

SEQ ID NO: 52 - DNA, 328 bp, Homo sapiens
  ENST00000640929
ctaccctctcctgttccaaaagcctgtctggtcagaatggtgtgatgagccctcctcttcagctaggaaaatgacggtgttcagaaagttaaaacttcttcgctggaaggatttcatcttaaagttgttttaggctgttcttcagtgtctttgtttgaacgttatataattgatgatcccaaagctttctacatattggcaggaattgtttttgaccacagcgtcaatgacagcaatggatctttgccacttgcggttaagtatcaattgcgcttcagttactttcagaagaattttatactggggaagaatatattttttcaagatg

SEQ ID NO: 53 - DNA, 4188 bp, Homo sapiens
  ENST00000469908
gtcagccaccctgcgagtacgcggttcgcacccggccgcgcggcagcccgtgcttgcgcactgctctgtgcccgcgcctatgtccagcagggggcgcgcagcggcggtagccgagcgagggcgcggtggcctctgacaggaatgactctgcgcacgtgcgtttcgcagcagtggaagtcttcacacccggaaactcgactttggccgtttctccatttctcctcacgcactgtctttccttgggccctcgtcactcctggcaccgggggaagggcttccccgcctctggccgggcgctggggcgcgaccgaaggcgaggcggcggcgaggaaccttctggaattcggccgtcggggcaggcgtcgagtttacaggagaaggcgcggtgtcccgggatgagcggagtcgccctcacttaaggagcgagggaggcctcgggggtccccagccggtgatgagccctcctcttcagctaggaaaatgacggtgttcagaaagttaaaacttcttcgctggaaggatttcatcttaaagttgttttaggctgttcttcagtgtctttgtttgaacgttatataattgatgatcccaaagctttctacatattggcaggaattgtttttgaccacagcgtcaatgacagcaatggatctttgccacttgcggttaagtatcaattgcgcttcagttactttcagaagaattttatactggggaagaatatattttttcaagatgacatagaaggctggtgcacatcctttctttaccctcccaatccacgccaagaaccccgggaatttccatttgctgttgggggaagtcctggatacaacaaagaaggcttcctggccatacagtatgctgtggataaagccatcatgtggtaccatgctcacaatgcaatgaccaacatgtttgagaatctcaatgtacttgtgaagagattcccatatggaccctatatcgaggacaggttcttcctagtccttcagaatgagttttctgtgttcttcatactcagcttcatgtacattgagctcatcatcatcagttccattgtactggagaaagagaaaagactgaaggattacctgtgcgtgatgggactggaaagctggttacactgggttgcttggttcatcacgttcttcatttctgtcttcattgctgtttctttcatgaccattctcttctgcacagaggtcttattccccctacaagtggatgtgcatatgtcaatggatatgaaatttcacaagagatatttcacattaggaagagcctgggctggtgccccaacatgatgtcttatctgataagttaacagtagcagaacatctttctttctatggtcagctgaagggcctgtcacgtcagaagtgccctgaagtcaagcaggtgctgcacatcataggcctggaggacaagtggaactcacggagccgcttcctgagcgggggcatgagccgcaagctctccatcggcatcgccctcatcgcaggctccaaggtttgaatctctatttactgacttggaactgaggcaggtagagctgggcatctccagctttggggcctctgtcatgaccatggaggatgtcttcataagggtttgtatgttggcagatgccagtacagctgtcccaaacatcaaacatccctctatccatccccagccctgcttagcagaattcctgttgacagaattaaacatcttcattcgaggaccttctcaatacggactgggctgccaatcaaaccaaacactgggttcagtcttctctgccaacaattttatgccatgctcctgaaaaaggtcacatattcttaacacaactggatgttgatgttatcaatacagatcctggtccctctggtgatcatcatgttaagcctcacattcttcaacttcaaagaaagaagcatagaaaatgtcccattggagctgactctgaaaacatatggtcagaccattgttcctttctttatttctcagaattccaggctggatcctcaactttcagaacgctttgcaaatatgtttatggttgagggacagattcctctggaggtcctaggttctgtagatgagttcctattgaaaaaggcaaaagaggagcctgaggactttgataagctctacttagtggcagcttcctttgaagacgtgggaaatcacaccatagtgacagcgctgttcaacaaccaggcataccattcttctgccctggctctggcgctattggacaattttctcttgaagttgctttctggtgccagggcttccattaccgcagccaaccaccctcaacctcagccagccagggaggattcagagaatttcctgtatcaggaacctaaaggacattaccttgttatcaacttgctttttggattagctttcctgtctagctctttttccatgttgacagtcagagagaggcgcgttaaggccaagcttgtccagtttatcaatggagtttatgtggccactttctggctctccactctgctatgggacctcatctccttcctcattcccagtctgctgctggtggtatggcggtggattggttactgtcctcagtttgatgctctgctgaacttcatgacaggccatgagatgctggtcatgtatgcccagatcgggggcatcccagagcaccccatcagtgcttgtgtggaccagattcttgaggatttagtcatgtacatgtacgccaacaagctggtcaagacctacagcatggaggagtgtgaggccctgtgcagccggcggccatcatggtgcaggggcagttcaagtgcctgggcagcccccagcacctcaagagcaagttcagcagtggctactccctgcgggccaaggtgcagagtgaagggcagcaggaggtgctggaggagttcaaggccttcgtggacctgacctttccaggcagcgttcttgaagacaagcaccaaggcatggtccattaccatctgctgggccgcgacctcagctgggcgaagttgagcgcacatttttgacgtgacccactttctggggtgtttggcactctggagcaagccaagaagtacatgctggacaactactcagcagtcaggtcaccatggaggacgtcttcctgagcttcgcatgccctgtgcccctggtccaaagcgaagaccaacgagagcaagcagagcaggtgggctcctcatcgtgctcgctgcctccttccctgcctccctctcggctttcctctcagtctccctccctgcctccctctcagcttttctctcggcctccctccctgcctcctccctcagagcctgtcctgctgtaataaggacagaccagtgccaggttggcccaggtgtgcatggccttccctgggtttccagggcgtacagaggcagctctcgacctagctagctcagcacagggctgtccccctaactgcagtgcacggagcagagtggggcccactggagaacttaagaggcccgctggagaacccaggtgcgtttccttagaaagggatgcccaagtcccacctgagtagcctgtggtcttattgagacctggctgtggaagcagcctcagaacatcttgcatgtcctttccaagggcggtggccatggggtgactacagtactaaccatgacccgaccaggtgccaactctgtggttggtcccctgcaggcattgcgtcatttgatcacatcaccctcaggcccggccttaaggggtctgtcctggtcatccccttgctcatgggcaagaagtctgcagggcagagggaaatgctcacccaaagcttgcgctcttccttctctagaatcccctgcccagatggtttgtccatccagtgcactccctcccagggcaggccatgccgcccaacgcaccctgagatgcgagatgcagcaaagcagtggctctgcagaacttcgggtagagtttggatgggtgcgtggaggtttccacacatgtgtgcagatcccttggaaagcaggatagagccagaaacagagaggagggtgcccgtaggccgctgggggctggctcccatggtcacatgcaagagtgaagcttcatggagaccatgattctaaactcacacctggcctcacaggtggtaatgtcactgttcttctgaaggaaggaggaaataaatattgacaagtttgctagcctaagtcg

SEQ ID NO: 54 - DNA, 1700 bp, Homo sapiens
  ENST00000482286
gtgcttgcgcactgctctgtgcccgcgcctatgtccagcagggggcgcgcagcggcggtagccgagcgagggcgcggtggcctctgacaggaatgactctgcgcacgtgcgtttcgcagcagtggaagtcttcacacccggaaactcgactttggccgtttctccatttctcctcacgcactgtctttccttgggccctcgtcactcctggcaccgggggaagggcttccccgcctctggccgggcgctggggcgcgaccgaaggcgaggcggcggcgaggaaccttctggaattcggccgtcggggcaggcgtcgagtttacaggagaaggcgcggtgtcccgggatgagcggagtcgccctcacttaaggagcgagggaggcctcgggggtccccagccggtgatgagccctcctcttcagctaggaaaatgacggtgttcagaaagttaaaacttcttcgctggaaggatttcatcttaaagttgggagactggaagaaattaaagtgttctaaatggaagagcattcaccacatgtgttctgttttgggttgacatttagcttttgtttttattttagaaacggaagactctggtagcagtccttgaaatcttgatgccattgctattttctgcattgtattgtatcttcgttttagtagtgctccaataaaaagacctgctactagctgccatgcaattgatatcagtttgttgccagacttctacaattttcctgaaaaatagatttcaactagtttatatcccttctataagtgaaacattgaaggctgtcaccgaaatggtggaacagatctttgatgttgagtttgaaggttagatgtaaatatgggtaaggatcgggaggacatttttataaagtacagtttgaagtttttccccgagagttcttacagtagtgattctaaatctagtgtctccaaattctaaagagcctatgaggtggtagttggggggaagctgtccatgagatatttttattatttcaaacaacatatggagtcttgtctatatatgtcagaaggcttcaaggctaattaaaatgttaaatgttaagtatttgtttttaactcactatcatgacacctattatctcatattaatccaaaggtctgattggcaattatatgtctctaataaaaaatggaaggcattcagagagtcagagggtctgaaatagcttctaacttgttaactggtctctgcttctcctcttgtcccattctaatccagtctccgtgtggaggcagaaagatcttcaaaagctcaataggatccagctagtctctagcttaaaccccttcagtggcttcccattgccctgaaagaaaaccagctcttctccaggttctgaccctgcttttttcccagtcttatctagtttggctctttattgtgctcccacacactggtcatgttggtcttttacttcctagaaagcagctacatgaggttttctcccaatagggcctttgcagcaggtgttccttctgacagtgctttgccctcagccttccctgtgcattgctccctcttagtcttcacgtttcagctgaactgatgcctaggaaagcagctaaatcggttttaggtttctcacctctgccttattctctgtcacagaaccctgttttatactttctatcaaaaagggaattttaataaatgtttacatat

SEQ ID NO: 55 - DNA, 476 bp, Homo sapiens
  ENST00000505660
actttggccgtttctccatttctcctcacgcactgtctttccttgggccctcgtcactcctggcaccgggggaagggcttccccgcctctggccgggcgctggggcgcgaccgaaggcgaggcggcggcgaggaaccttctggaattcggccgtcggggcaggcgtcgagtttacaggagaaggcgcggtgtcccgggatgagcggagtcgccctcacttaaggagcgagggaggcctcgggggtccccagccggaaatgaaaattggacatttgacatttgaacctctctcctgtgtttggaaaactctccatcaatgtgatacaatggtggaaagcggggtctaggctcaatggaacagatggagtctcgctctgttgcccaagctggagtgcagtggcgggatctcggctcactgcaacctttgcctcctggattccagcgattcttgtgcctcagcctcacaagtaggtgag

SEQ ID NO: 56 - DNA, 466 bp, Homo sapiens
  ENST00000466730
caaatccagtaccagaactggctgactcagaatttaccttagatggaagatagggtaggaattttggaagaaggatgaccttacagatcaagacagacaattgcaggaaatgaaaattggacatttgacatttgaacctctctcctgtgtttggaaaactctccatcaatgtgatacaatggtggaaagcggggtctaggctcaatggaacagatggagtctcgctctgttgcccaagctggagtgcagtggcgggatctcggctcactgcaacctttgcctcctggattccagcgattcttgtgcctcagcctcacaagtagtgatgagccctcctcttcagctaggaaaatgacggtgttcagaaagttaaaacttcttcgctggaaggatttcatcttaaagttgggagactggaagaaattaaagtgttctaaatggaagagcattcaccacatgtgttctg

SEQ ID NO: 57 - DNA, 3478 bp, Homo sapiens
  ENST00000494925
atgacggtgttcagaaagttaaaacttcttcgctggaaggatttcatcttaaagttggtatggttatctgtgggaagatataagtccttgggggggattgaatgtttaagttaaattggttcataataacgggttaaagaacaattaagaactttacatggaaaggggcccttttctgcaaatgagtcatgtaattattaaagatgacatcattgttactgatttctggccattggagttacagaaaggctaaaaggagatgtttcaagctaattcttactctgtgtttttctttttcgtgtgttttgcagggagactggaagaaattaaagtgttctaaatggaagagcattcaccacatgtgttctgttttgggttgacatttagcttttgtttttattttagaaacggaagactctggtagcagtccttgaaatcttgatgccattgctattttctgcattgtattgtatcttcgttttagtagtgctccaataaaaagacctgctactagctgccatgcaattgatatcagtttgttgccagacttctacaattttcctgaaaaatagatttcaactagtttatatcccttctataagtgaaacattgaaggctgtcaccgaaatggtggaacagatctttgatgttgagtttgaaggctgttcttcagtgtctttgtttgaacgttatataattgatgatcccaaagctttctacatattggcaggaattgtttttgaccacagcgtcaatgacagcaatggatctttgccacttgcggttaagtatcaattgcgcttcagttactttcagaagaattttatactggggaagaatatattttttcaagatgacatagaaggctggtgcacatcctttctttaccctcccaatccacgccaagaaccccgggaatttccatttgctgttgggggaagtcctggatacaacaaagaaggcttcctggccatacagtatgctgtggataaagccatcatgtggtaccatgctcacaatgcaatgaccaacatgtttgagaatctcaatgtacttgtgaagagattcccatatggaccctatatcgaggacaggttcttcctagtccttcagaatgagttttctgtgttcttcatactcagcttcatgtacattgagctcatcatcatcagttccattgtactggagaaagagaaaagactgaaggattacctgtgcgtgatgggactggaaagctggttacactgggttgcttggttcatcacgttcttcatttctgtcttcattgctgtttctttcatgaccattctcttctgcacagagaaatgtggcactgcttaagaacagtgaccctagtctgatatttgtttttctaatgtgttttgccattgccacaattttctttgcattcatgatcagcacattcttccaaagaggtcttattccccctacaagtggatgtgcatatgtcaatggatatgaaatttcacaagagatatttcacattaggaagagcctgggctggtgccccaacatgatgtcttatctgataagttaacagtagcagaacatctttctttctatggtcagctgaagggcctgtcacgtcagaagtgccctgaagtcaagcaggtgctgcacatcataggcctggaggacaagtggaactcacggagccgcttcctgagcgggggcatgagccgcaagctctccatcggcatcgccctcatcgcaggctccaaggtttgaatctctatttactgacttggaactgaggcaggtagagctgggcatctccagctttggggcctctgtcatgaccatggaggatgtcttcataagtcttctctgccaacaattttatgccatgctcctgaaaaaggtcacatattcttaacacaactggatgttgatgttatcaatacagatcctggtccctctggtgatcatcatgttaagcctcacattcttcaacttcaaagaaagaagcatagaaaatgtcccattggagctgactctgaaaacatatggtcagaccattgttcctttctttatttctcagaattccaggctggatcctcaactttcagaacgctttgcaaatatgtttatggttgagggacagattcctctggaggtcctaggttctgtagatgagttcctattgaaaaaggcaaaagaggagcctgaggactttgataagctctacttagtggcagcttcctttgaagacgtgggaaatcacaccatagtgacagcgctgttcaacaaccaggcataccattcttctgccctggctctggcgctattggacaattttctcttgaagttgctttctggtgccagggcttccattaccgcagccaaccaccctcaacctcagccagccagggaggattcagagaaaaggacattaccttgttatcaacttgctttttggattagctttcctgtctagctctttttccatgttgacagtcagagagaggcgcgttaaggccaagcttgtccagtttatcaatggagtttatgtggccactttctggctctccactctgctatgggacctcatctccttcctcattcccagtctgctgctggtgatctcaaaatccttggattatacattcctaatacttccagggcactgcctggggatggctttcaccaacttatattacaactctgaactacagaggttttgcagtgtcaagaacctgagtgtatggcggtggattggttactgtcctcagtttgatgctctgctgaacttcatgacaggccatgagatgctggtcatgtatgcccagatcgggggcatcccagagcaccccatcagtgcttgtgtggaccagattcttgaggatttagtcatgtacatgtacgccaacaagctggtcaagacctacagggtggtggtaacaagccgaagttgagcactggcattgatcgccctgattggagagcctgccttcatcttcctggatgagccatccactggcatggaccccgtggcccggcgcctgttctggaatgctgtggcacacgcccacgagtctggcaaggccatcatcatcacctcccatagcatggaggagtgtgaggccctgtgcagccggcggccatcatggtgcaggggcagttcaagtgcctgggcagcccccagcacctcaagagcaagttcagcagtggctactccctgcgggccaaggtgcagagtgaagggcagcaggaggtgctggaggagttcaaggccttcgtggacctgacctttccaggcagcgttcttgaagacaagcaccaaggcatggtccattaccatctgctgggccgcgacctcagctgggcgaagtgtttggcactctggagcaagccaagaagtacatgctggacaactactcagcagtcaggtcaccatggaggacgtcttcctgagcttcgcatgccctgtgcccctggtccaaagcgaagaccaacg

SEQ ID NO: 58 - DNA, 5677 bp, Homo sapiens
  ENST00000269080
cagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctcccgtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgtggttttttttaaatacatttatttttatagcagcaatgttctatttttagaaactatattataagtacagaaatggttctccgtgtggtgggaggaggaggttcgggtgctgggtaagtgccatgtcagtgtggacagaggcatttgactaagccaacctcctctcacagcctctgtatctctgcaggccatactggttccattgttctgtataatactgaataaataaatttacttttacatgatcgtataagtttctagataagataaacaaattttgtttaaatttttttaataaaaatcttaaaacactttttttctaacctagactgagaaattcatgtttacttttctaggtgtatgatactttgtaaagttgatactttcctaagaatttaacatgtcatatttttgaaatagatttaagtgtgcttcttattgctaaaaatactaaatgtcatgggtcatagtatctgatatcaatatcgttgataacatatccacaggtaacaccatgatgtaggcataaatggaaaacaaaaaccctactatttcaaatatattgtacttttttatttctgtaagccaactgtgtgccattttcactggacttttaaatctagactttagtgatgtctacattgtaaatgatcttttgtggatatttgtcacttggtttcagaaagttcacaaatgtagcaacagctcacatgactgagtaggtagaaaatgtgaaataaatctcatatatatagttttg

SEQ ID NO: 59 - DNA, 5088 bp, Homo sapiens
  ENST00000586539
tccttgcttccattttcccagaagttttggtagcaggatgatgttggcctcataatgtgagttagagaggagtccctctttttcgactgtttggaattgtttcagaaggaatgctaccagctcctcttgtaccactggtagaattcagctgtgaatctgtctggtcctgggctttttttgattgacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctcccgtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgt

SEQ ID NO: 60 - DNA, 445 bp, Homo sapiens
  ENST00000588458
ctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctcccgtgaagaccttgtcagagggaataaagagaaagctgtgctttgtcctgagcatactggggaacccgtcagtggtgcttctggatgagccgtcgaccgggatggaccccgaggggcagcagcaaatgtggtgaggaacattaccacggtcagggacagcacggatgacttgcatggagcctgtgaaccatttttcttctgtaaaaattgtcccttaaactcttttgtggagaacaaaaaaactatcaatgtcacttgtaaaaccaatactttgca

SEQ ID NO: 61 - DNA, 875 bp, Homo sapiens
  ENST00000586292
ataaatcctattgcttcaaacaaaagctcatagaccttgggaggaaggaagacagccccttgctatacactttagaaaggacacttaggtgatattcatggtcaaatgttagcagggctgtttagggccaattcacgtatatgtggacaaaattcaggaaacaaaaaactccctgtttagcaattgtcttttcttttgcagcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagaatttctccaagaagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgca

SEQ ID NO: 62 - DNA, 3071 bp, Homo sapiens
  ENST00000591459
gtgtccagcccctaatggagaggagacccaaagtgggtagctcctttctgcagctggtagtccctaagtctgtgtgaatctggctgagtccaggatttttatgggctcagaaaggaggaagtgtgtgccatttggtccatgagtggccatgggcaggcctggaaaaagcatcataagttctcactctgggtcacagactccacctagaaccggcagcctggcacccaggcttcaggccatccctgaagcttgaaggtggcttgaaggtggggtttcaccagagaaccacccctttctatccaggaacctgtctgcctgctgccatcaacatgccatctatggcacccaggtggtttgtgctgaggtgcacctgcaagtccatgctgagctgccctcagcacccccccggactccctcccacacttgtcagggcccaaaatccagagcgagctgaggtggcaggaggctggcatggcagttccaccctgggcacgtacacacccagcagggttgcaacagcacctgggcttggccacaactttgctccaaaattggagcatgcaactgcccctgagattcagtaaaggatgctccaattcagcgaagggcagggctcttacctgtttctggcccctgccagtcccccggagtacacagccccagtcacacctcccctgctacagccagcatctttgctgtggtggctccagacaggctgccactgccatcaaggagtaactattaaaggtattaagacgtctcccttgctgcagccagcatctttgctgtgatggctgcagacgggctgcagccaccatcaaggggtaattattaaaggcattaagagagaatgtccagcatcagagctgaaattaatgccagaattcacacacatcctatttatactgccatcagtcacacggatttgcactttcagtgagcattgtctttccagtatgtaatatttaatctttcataaaactgtttttaaaaaactgtattagacagttgtccttcacaaaatgcttagttattggaacatacatttttgtgcaaatgcaactatttttggggagtgttttcaagaaatagatcaaaaattagatacaagggggtgaaattgactttaattgtacttctaatttagttgtataaggtggctaggcaaacagaaaaagagctcaggtttatctaagagagacatcatggggtagagataaaacattttctcctaaattctatggcagaagatagaaaaccttaagaactcttttacaaagaatgtccaagggaagtacagaacagaatataaggcagatgcctgtgaaactgtaccgtgggaaaggggctagtagtcaagccaagaaaggaaaagacagcttggaatgctattgacaaatactccactaatgaaagaagagaaaaccgatattcacaatccctctgtagccacagtgagagcagatgttcatgaaggtacctctctgctggtggcttggccaactctaatttagtccttaacttcaatcatggacaccctccaactcagtcaccacctgggcccaaagtcagtattttatttctcattaagcatgggaggaaaggagataactgctcattaatacattggaatgaaatcttgtaaaaggtaagtctgacctgaagtagaaagccagccatttgggtgtcacaaaataagcttaattggatcagccagcgtgagtttttttaatccatgcattctcctgattaaatactttcagtgaacgcttgctgctctatggctggaaggacacatccctgcttgtcttgcaagcagctgcaggaactggcttccctgtccctcttgccacatatttgtcctccccgtcaagcttccacatcaagcttcatccccacacagggctttggtctcgctcttgctctgccccagattccttgctcttgcctttttttccatgactagcatcttctcctctttgttgaaatggccctcagaagacaggctctttctaattaccctacctactgccacttccccagttattcttaccccagcctcctgaatttccataacagcaccacttttgatctgtctttattctgcatgttcatttctctacttgtttattgcctgattcattcagtagaatgaaaactccagataacgaagcactagttattccaccctccgctgtacccacaggcaacacagcacttgttacataggaggtactcaaaagatgttgatccatgagcgaagttaaatagtaattcaatcaatatgcttcattttgacagtgatttaaaaaaaatggatataaactgttggccaggatggacaggcaccacatttatgggatattggatttttcagctgagattggattgttggctgtggacacacttattttcctgtatttgctctctgacaacctttctccaatgcaaaatgattacagattattaaacccaatgaggtttagagtttctctagtttttctaggttcgtgaagagaatgatgtcatggaaatactcaaagaagcagtgcagaaggtaggttctgagagggaactttcatctgcaggtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggtacacagaggagccacatctgttctatacccaagggaggggtggaggaggttgagagtgatgaccctcacaggaaattcaggatgggagactctaaatgctgacccaggtcacactgggtagatttacaactagaaactcctttcctggatatcaaagtattaagtttctttctcatattaaataagaaaatttaaaaaggctgggcgcagtggctcatgcctctaaccccagcactttgggaggctgaggcaggtggactgcttgagctcgtgagtttcagaccagcctaggcaacttggtgaaacctcatctctaaatt

SEQ ID NO: 63 - DNA, 558 bp, Homo sapiens
  ENST00000589980
tgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtaggtgaattatgtggaaaatatgttatctaatggtgaaatagattgataagatttgatgaccttaaaaacaacagattccacttaatccttatataactgaagtgattaatgaactacccaagagaataaattcacgaattatcacataaatgcacacaaaagctaagcactgaaaggttgtcacagaatccttagggtgtcgcttttccagtcaaaacctctggagctggtggcgcctttgcccaagtttggctcagacccgctgggctcattctgtccactcagctcagcaggctgcactctgttcatgccaccagcctggatcccaagcctgccaa

SEQ ID NO: 64 - DNA, 3657 bp, Homo sapiens
  ENST00000541225
ctagatacatggtagagaccaggagaaaatatgaataactttcttctaaacaaggagctcagtggataaaccatacctctagattccttgcttccattttcccagaagaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtaagtatatttcttgtggatgtatactgtatatatttgatatacaattctgagctaatcctttaaattttgccctctgtaggatgataatattatggtctataataaacacaagattacaaattcagttactgacatggtcaaaactagaaattacttcaccaaagtccctaataagaattaattccataaagcctctcttcttttgtctaaatta

SEQ ID NO: 65 - DNA, 2106 bp, Homo sapiens
  ENST00000589533
tcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggaggtaaatatatataatcttacaattcctgactctcctctatcaggaatctcccagatcacccttttaagtgctggaatcttgtttttattgagtaaaccactgcataataaattaacatttggactcat

SEQ ID NO: 66 - DNA, 524 bp, Homo sapiens
  ENST00000590359
tcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaaggtatgcaggtctctaataatctttctgaaaaatgtgaaaagctaacataatatcaatatactcaggcttccaacttaagaaataaaaatgaaaagc

SEQ ID NO: 67 - DNA, 925 bp, Homo sapiens
  ENST00000587206
attgatttcatgtcttattgctcctcatgattctgtgggttgactgggcagtttttctattctggaccaaagtgacaggggctggatgatttaacatggcctcactcacatatctggggcttcagttaggacagctgcgtgtcttttcccacatggaaatatatctttcagaaggcctgctgggattcttcacccaatgatccccatgatcccagcagcaagcaaagacaaatcactaggtggaagctcttcatcagactctgcttgtatcacatttgctaggatactacagggtatataggcaaagctaaatgtgaggggcagacaaagggactacaccttgatgggaaaagctgcagatgagaacatattttgaatatactatgcaactaaagtagaagtttctaatgcctgaattgtataaactgtcaagataaagtcatacgtacatttaattaacagcgattttattaagaaatatcttaagccttatcttgatattaacttttcctttgttacaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacc

SEQ ID NO: 68 - DNA, 1622 bp, Homo sapiens
  ENST00000428549
cagaagtcaaatagttaaagcaaattctagatacatggtagagaccaggagaaaatatgaataactttcttctaaacaaggagctcagtggataaaccatacctctagattccttgcttccattttcccagaagttttggtagcaggatgatgttggcctcataatgtgagttagagaggagtccctctttttcgactgtttggaattgtttcagaaggaatgctaccagctcctcttgtaccactggtagaattcagctgtgaatctgtctggtcctgggctttttttgattgacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggtgagtcaaacgcagcacaaataaataaacggaggaactcaggaaaactgggaatcttcaatgcatctttttttttttgaaatggagtctcgctctgtcgcccaggctggagtgcagtggcgtgatctcagctcactgcaagctccgcctcacaggttcacgccattctcctgcctcggcctcccaagtagctgggactgcaggtgccgaccaccatgcctggataattttttgtattttctgtagagacggggtttcaccgtgttagccaggatggtctcgatctcctgacctcgtgatccacccacctcggcctcccaaagtgctgggattacaggcgcgagccaccacgcccggcctcttcaatgcgtctttattaaaacctgtttctccacaaccaaggggtacaaatgagagatacctacacagaataatttcagatcatgaacaaatttccacttagttaatttcagtggggagaaatgctctgcagtgatggacaaaaaaaaaaaaaaaaaaaaaaaaa

SEQ ID NO: 69 - DNA, 1502 bp, Homo sapiens
  ENST00000585850
ataacctccactctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggtgagtcaaacgcagcacaaataaataaacggaggaactcaggaaaactgggaatcttcaatgcatctttttttttttgaaatggagtctcgctctgtcgcccaggctggagtgcagtggcgtgatctcagctcactgcaagctccgcctcacaggttcacgccattctcctgcctcggcctcccaagtagctgggactgcaggtgccgaccaccatgcctggataattttttgtattttctgtagagacggggtttcaccgtgttagccaggatggtctcgatctcctgacctcgtgatccacccacctcggcctcccaaagtgctgggattacaggcgcgagccaccacgcccggcctcttcaatgcgtctttattaaaacctgtttctccacaaccaaggggtacaaatgagagatacctacacagaataatttcagatcatgaacaaatttccacttagttaatttcagtggggagaaatgctctgcagtgatggacaaaaaaaaaaaaaaaaaaaaaaaaa

SEQ ID NO: 70 - DNA, 509 bp, Homo sapiens
  ENST00000585531
agcgtcctctcccccgccgtggtgagagcctgtctctgctttgtatccgtgctgggtccttgttgcaaatctcagctgcaaattatctttgcttgggaatgggaactggaagcttcctgccccacctgcagtggtagcaggctgttgctttttaccagacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaat

SEQ ID NO: 71 - DNA, 5823 bp, Homo sapiens
  ENST00000430352
ataacctccactctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctggtcgtgttcctcctcactgtcttttgggggtgtctggggttcacatcactgtacagacaccttcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatacttggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggagaatggacaggacaatccaatcggattcctggcatatatcatgttctggctggttttaacatcgagttgcccaccttacattgccatgagcagcatcgatgattataagaacagagctcggtcccagctacggatttccggactctccccttctgcttactggtttgggcaggcgctggtggatgtttccctgtacttcttggtcttcgtttttatatatttaatgagctacatttcaaacttcgaagacatgctacttacaataattcatattattcaaatcccatgtgctgttggttattccttttccctcatcttcatgacatacgtgatttccttcatctttcgcaaggggagaaaaaatagtggcatttggtcattttgtttctatgttgtcactgtattctctgtggctggatttgcgttcagtatcttcgaaagtgatattccatttatcttcacttttttaataccacctgccacaatgattggctgtttgttcttatcttctcatcttctcttttcttctctcttttctgaagaacgaatggatgtacagccatttctggtattcctaattcctttccttcattttatcatttttctttttactcttcgatgtctggaatggaagtttggaaagaaatcaatgagaaaggatcctttctttagtagtgatgtgtgtcaaaatccagaagaaccagaaggagaggatgaagatgttcagatggaaagagtgagaacagcaaatgccttgaattctactaattttgatgagaagccagtcatcattgccagctgtctacgcaaggagtatgcagggaagaggaaaggctgtttttccaagaggaagaataagatagccacgagaaatgtctccttctgtgttagaaaaggtgaagttttaggattattaggacacaatggagctggtaaaagcacatccattaaggtgataactggagacacaaaaccaactgctggacaagtgctactgaaagggagcggtggaggggatgccctggagttcctggggtactgccctcaggagaacgcgctgtggcccaacctgacagtgaggcagcacctggaggtgtacgccgccgtgaaagggctgaggaaaggggatgctgaggttgccatcacacggttagtggatgcgctcaagctgcaggaccagctgaagtctcccgtgaagaccttgtcagagggaataaagagaaagctgtgctttgtcctgagcatactggggaacccgtcagtggtgcttctggatgagccgtcgaccgggatggaccccgaggggcagcagcaaatgtggcaggccatccgggccacctttagaaacacggaaaggggtgccctcctaaccacccactacatggcagaggctgaggccgtgtgtgaccgagtggccatcatggtatctgggaggttgagatgtatcggttccatccaacacctgaaaagcaaatttggcaaagattacctgctggagatgaaggtgaagaacctggcacaagtggagcccctccatgcagagatcctgaggcttttcccccaggctgctcggcaggaaaggtactcctctctgatggtttataagttgccagtggaagatgtgcaacctttagcccaagctttcttcaaattagagaaggttaaacagagctttgacctagaggagtacagcctctcacagtctaccctggagcaggttttcctggagctctccaaggagcaggagctgggtgattttgaggaggattttgatccctcagtgaagtggaagctcctcccccaggaagagccttaaaaccccaaattctgtgttcctgtttaaacccgtggttttttttaaatacatttatttttatagcagcaatgttctatttttagaaactatattataagtacagaaatggttctccgtgtggtgggaggaggaggttcgggtgctgggtaagtgccatgtcagtgtggacagaggcatttgactaagccaacctcctctcacagcctctgtatctctgcaggccatactggttccattgttctgtataatactgaataaataaatttacttttacatgatcgtataagtttctagataagataaacaaattttgtttaaatttttttaataaaaatcttaaaacactttttttctaacctagactgagaaattcatgtttacttttctaggtgtatgatactttgtaaagttgatactttcctaagaatttaacatgtcatatttttgaaatagatttaagtgtgcttcttattgctaaaaatactaaatgtcatgggtcatagtatctgatatcaatatcgttgataacatatccacaggtaacaccatgatgtaggcataaatggaaaacaaaaaccctactatttcaaatatattgtacttttttatttctgtaagccaactgtgtgccattttcactggacttttaaatctagactttagtgatgtctacattgtaaatgatcttttgtggatatttgtcacttggtttcagaaagttcacaaatgtagcaacagctcacatgactgagtaggtagaaaatgtgaaataaatctcatatatatagttttg

SEQ ID NO: 72 - DNA, 3264 bp, Homo sapiens
  ENST00000615593
actctgaaagcagtcttcacagaaacttttcacagaagtcaaatagttaaagcaaattctagatacatggtagagaccaggagaaaatatgaataactttcttctaaacaaggagctcagtggataaaccatacctctagattccttgcttccattttcccagaaacaagatgaggaagagaaagatcagtgtgtgtcaacaaacttgggccttattatgcaagaactttcttaaaaaatggagaatgaaaagagagtccttaatggaatggctgaattcattgctcctactactttgtttgtatatatatcctcatagtcatcaagtaaatgatttttcttcactgcttaccatggacctgggacgggtagatacatttaatgaatccagattttctgttgtatacacacctgtcaccaacacgacccaacagataatgaataaagtagcctctactcccttcctggcaggtaaagaggtcttgggactgccagatgaggaaagtattaaagaattcacagcaaattatcctgaagaaatagtaagagtcacctttactaatacatactcatatcatttgaagttcttgctaggacatggaatgccagcaaagaaggagcacaaggaccatacagctcattgttatgaaacaaatgaagatgtttactgtgaagtttcagtattttggaaggaaggttttgtggctcttcaagctgccattaatgctgctattatagaaatcacaacaaatcactcagtgatggaggagctgatgtcagttactggaaaaaatatgaagatgcattccttcattggtcaatcaggagttataactgatttgtaccttttttcctgcattatttcattttcctcattcatttactatgcatctgttaatgtcacaagagagaggaaaaggatgaaggccttgatgacaatgatgggtcttcgggattcagcgttctggctctcctggggtttgctctatgctggtttcatcttcattatggcccttttcttggcacttgttataagatctacccagtttatcattttgtctggcttcatggtagtcttcagcctctttctcctgtatggattatctttggtagctttggctttcttaatgagcatcttggtaaagaaatctttcctcaccggcctgcatccttggagtggattttaagcttgcttagtccctttgccttcatgcttggaatggcccagcttttacacttggactatgatttgaattctaatgcatttcctcatccatcggacggctcaaatctcattgtagcaacaaatttcatgttggcatttgacacttgcctctatctggcattggcgatttactttgaaaaaattttgccaaatgaatatggacatcgacgtccacctttgtttttcctgaagtcctcattttggtctcaaacacaaaagactgatcacgtggcccttgaagatgaaatggatgccgatccttcatttcatgactcttttgaacaagcgcctccagaattccaagggaaagaagccatcagaatcagaaatgttacaaaagaatataaaggaaagcctgataaaatagaagccttgaaagatctggtatttgacatttacgaaggccaaatcactgcaatattggtcacagtggagctggaaagtcaacactgctaaacattcttagtgggttgtctgttcccaccaaaggttcagtcaccatctataacaataagctttcagaaatggctgacctagaaaatctcagcaagctgaccggagtttgtccacaatccaatgtgcaatttgacttcctcactgtaagagaaaacctcagactctttgctaaaataaaagggattctgccacaagaagtggataaagagatacaaagggttctgctggaattggaaatgaaaaatattcaggatgttcttgctcaaaacttaagtggtggacagaaaagaaagctaacctttgggattgccattttaggagatcctcagattttcctgttggatgaaccaactgctggattggatcccttttcaagacaccaagtatggaaccttctgaaagaacgcaaaacagaccgcgtgatcctcttcagtacccagttcatggatgaggccgacatcctggcggacaggaaagtatttctctcccaagggaagctaaagtgcgcgggctcttctttgtttctaaagaagaaatgggggattggatatcacttaagcttgcagttaaatgaaatatgtgttgaggaaaacataacatcacttgttaaacagcacatccctgatgccaaattatcagccaaaagcgaaggaaaacttatttatacattacccttagaaagaacaaataaatttccagaactttacaaggatcttgatagctatcctgacctaggaattgagaattatggtgtttccatgacaactttgaatgaagtattcctgaagctagaaggaaaatctacaattaatgaatcggacattgctattttgggagaagtacaagcggaaaaagctgacgacactgaaaggcttgttgagatggaacaagtcctctcttcacttaacaagatgagaaagacaataggtggtgtggctctctggcgacagcaaatctgcgcaattgcaagggttcgcttgttaaagttaaagcatgaaagaaaagctcttttagcactgctattaattctaatggctggattttgccctcttcttgtggagtataccatggtgaaaatatatcaaaacagttacacctgggaactttctcctcatttgtatttccttgctcctggacaacaaccacatgaccctctcactcaactactgatcatcaataaaacaggggcaagcattgatgactttatacagtctgtggagcaccagaacatagctttagaagtggatgcatttggaactagaaatggcacagatgacccatcttataatggagccatcacagtgtgttgtaatgaaaagaattacagcttttcgttagcatgcaatgccaaaagattgaattgcttcccagttcttatggacattgttagtaatgggctacttggaatggttaaaccatcagtacatatccgaactgaaagaagtacatttttggaggtaaatatatataatcttacaattcctgactctcctctatcaggaatctcccagatcacccttttaagtgctggaatcttgtttttattgagtaaaccactgcataataaattaacatttggactc

SEQ ID NO: 73 - DNA, 933 bp, Homo sapiens
  ENST00000372515
gtgagcgaatactccacgtgagaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggag

SEQ ID NO: 74 - DNA, 478 bp, Homo sapiens
  ENST00000502549
gggcgtggcgaatagcgccggctaggtcttccaacctctaggtggggtgccagccggggcgggcccagcaccccggccgggcagtactttttttttttttgcatacaccagttctcaggatatcggaatccggtgcacagcagcttcttcaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgagagtctctctttgtcacccaggctggagtacagtggcacgatctcagctcactgcaacctccgcctcccaggttcaagcgattctcgtgcctcagtgtcccaaagtagctgggattacaggagtccagattacatcctaccctgcagtcctggat

SEQ ID NO: 75 - DNA, 5033 bp, Homo sapiens
  ENST00000372530
ggcgaatagcgccggctaggtcttccaacctctaggtggggtgccagccggggcgggcccagcaccccggccgggcagtactttttttttttttgcatacaccagttctcaggatatcggaatccggtgcacagcagcttcttcaggtttgaggttccggatgcctgggggcggagaaacgggaggggaaaaacagatggcaaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccaggggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgtgaggc

SEQ ID NO: 76 - DNA, 774 bp, Homo sapiens
  ENST00000443426
gacgggcggtcccggttccagggcggggctggagacagggagacccggctgggaagtgcaggcaaagccggctgttaccctgcacagccgtcaccctcaactttcccttcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgaggaccaggaaggaaggggaccagcatcaaggagacttcagcgaagtgaagacagaggcttgggccctcagtgctggctgagaaggagggagggatccctgactgcctcatctctcaaccaagggaaaactgaagaaacctttttgtgggggccttggatatataaccctcccctctgtgaaggagttcctttctttcctctcctctacctttcactccagcttctattcagttccaggcttggggttaggtctcttcatcctcgttctaatggccttaggaaaaaaatgtatgatgcaatcctg

SEQ ID NO: 77 - DNA, 5088 bp, Homo sapiens
  ENST00000244533
ttctaatgatcccatcaccaaagtagcaaacgtagtacccaggattttttttttcctagttagtcttcatgttaagtacaatcttacctcaaaattgttaatgtctgtggtttaaaaaaaaacatgaatcagaaatggtgtgggtagtttagaaaatgagttaggttcaggtggccggttagctcagttggtcagaaaatgagttaggttcatctgggaagacttcctgggagaaaagaccctgggttctgaggtaaagtggagtagggataagatgtgcaaggcaggaagggagttgattccttaggtaagtgaattattggaggtgaggggtatgtctggctcctgagtcagccacgatgtgcctccttgtcttcccccttgtccccaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagattgtggtagattaggagcccaaatcaagtggcttctctgttcagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccaggggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgt

SEQ ID NO: 78 - DNA, 4542 bp, Homo sapiens
  ENST00000463024
caacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggtaaccaacctcctatgcacccctgtccttactttgtcctttagcaaacactgagcccctcttatgtgttggacaccttttgggggtcaggggtactaagaagagcaacgcatggtccctttattgggagagttttcaatctggaaagaaggaggtggccaagaaagcgaatcattgtaatcattacaccagagtgttttaaatgctataatagtcagcaaaggaatggaaacatccagtgtcagctattctttcagaaatgtggctgtgcagagaagggatccagagaggagcataggtttgagggaggaccttgttttcagatgggaacaagtacaatgtggtggccatactctccactgagctcctgaacagatgtaagtacaacagctgcttggctgtagccaaagagctatttcttcccttcttcgcccagaatgggcttcattaggaccccttgacctcaggagctgccatctcagtcatgtgacatgaagggggaccctgtgtagaagacagcagcctggggaggcttctaggagtcaagggctgggcatggagggacccagaggagagctggtcctcatattgctcgcctggctctctgcaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggtaatgggggcaggagccccgtgtgagggaggtgtctgcccaggtctggcaggggattgtgaagtacagactctgccccctgctgcatgtgtgccctgagccagtcattgctgcctcccgccttcacagaactggtgtgaggaactgggagaacaggagggaaaaggagtacgttggtaaaatgccagtgtatttgggactcatgggctttgtgactgggtgctcttgggaacttaaaggcccagggtctctgagaacattctcatatcttcagagaagagaaaggagtcaggtttagaatggtctttttgtaaaaacaaaaatttttaaactctgaaagatttttatgcagagggatgtgaccacctgcaagtttactgggagagaaataggaggaaatgaagctccagccagatattaggaattgagcgaagcatgagaaaaagctctgcagtaatgagaagtaaccctggacagagtggcaggcatagctctggcggtcctcttggggatggacattcgtccctctctgctggtcggaatcaaggtttacaaggatggacttgagtcctgctcgaggtctaggggtatccagagcagggtgggttagagagggaggcctaagagtcctgctcgaggtctaggggtatcctgctagggtgggttagacggggaggcctgagaggatgagaggtgggatctgcacacgcactgagaaaggcatagtatagactcagaacagtcctctcccaatctccccttctaccctccaggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccaggggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgtg

SEQ ID NO: 79 - DNA, 285 bp, Homo sapiens
  ENST00000469856
agacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggtcagttaaagatggaggttgcagtggcagggaggtggggggagtccagagccttgggaacttggctgagttaggaggataggaatattttccttagcatc

SEQ ID NO: 80 - DNA, 405 bp, Homo sapiens
  ENST00000372512
cgacagccccctcctcaccacccagcatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatgggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcaggtgggcctgtacccccaccccaggccaaa

SEQ ID NO: 81 - DNA, 733 bp, Homo sapiens
  ENST00000437104
tttttttttttgagatggagtctcgctctgttgcccaggctggagtgcagtggcacgatctcggctcactgcaacctctgcctcctgggttcaagcaattctcctgtctcagcctcccaagtagctgggattacaggcgcctgccaccacgcccagctaatttttgtatttttagtagagacagggtttcaccatgttggccaggctggtctcaaactcctgacctcgtgatccacctgccttggcctcccaaagtgctggaattacaggcgtgagccaccgcgcccagcctctgttgcttcctttaaatgccagcagtccacagcctggggagtctcccacaaacgtcccggtgtccaagctctcccagcagctggtacttctctcccccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccaggggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccg

SEQ ID NO: 82 - DNA, 721 bp, Homo sapiens
  ENST00000505344
gaggagggcatagccaggaaggctttatataaactcacagcagccagggctgatcagggggctgaaatggaggacaggatgagcaggcaaggacagcgaactcctagtgcccagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctgg

SEQ ID NO: 83 - DNA, 883 bp, Homo sapiens
  ENST00000531642
cttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccggcccaggcagcctctggaaggggatcccccacccatgggtctaagatgctgtcccccacccactgccaccacctcggtgcttctcccagccagacctccaactcagtctgctctcgctcactgccctctttgccgcctggggatgcaggcaggaccctgctccctccctactggggctttctgtgccacttccagatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttccta

SEQ ID NO: 84 - DNA, 612 bp, Homo sapiens
  ENST00000526037
agacatgacaggaggcccagcagtcaccgccttcccctgcaccctcactgggacccatgcagggcacatcatcattgatggcattgacatcgccaaactgccgctgcacaccctgcgctcacgcctctccatcatcctgcaggaccccgtcctcttcagcggcaccatccgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttccta

SEQ ID NO: 85 - DNA, 4921 bp, Homo sapiens
  ENST00000389817
agaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcaccatcgctgatcccaaagaactggccagaccaagggaagatccagatccagaacctgagcgtgcgctacgacagctccctgaagccggtgctgaagcacgtcaatgccctcatcgcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttccta

SEQ ID NO: 86 - DNA, 537 bp, Homo sapiens
  ENST00000526168
gccgcaccggcagtgggaagtcctccttctctcttgccttcttccgcatggtggacacgttcgaaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacct

SEQ ID NO: 87 - DNA, 675 bp, Homo sapiens
  ENST00000525022
cgcaccggcagtgggaagtcctccttctctcttgccttcttccgcatggtggacacgttcgaaggtgagttgtaaggcgggcaccccacgtgtacccacagccaccagatgaggcctcagccctggcacgtggtcagacatgacaggaggcccagcagtcaccgccttcccctgcaccctcactgggacccatgcagggcacatcatcattgatggcattgacatcgccaaactgccgctgcacaccctgcgctcacgcctctccatcatcctgcaggaccccgtcctcttcagcggcaccatccgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgccgcaggagggccaccctcagctgtggcccccaccgcgggtggtattcccaccatcctgacccgccccctcctgccctgcccagcatcgagtgcacaccatcctgagtgcagacctggtgatcgtcctgaagcggggtgccatccttgagttcgataagccagagaagctgc

SEQ ID NO: 88 - DNA, 611 bp, Homo sapiens
  ENST00000532220
gacaggtggaggttggggagccacatgactgaccctccctgtgcctccagggagggctgctctgagcaggcagtggatggcagcaaaaggaatctggggccctggcccctctccagccttaagaagagccattctggtggctgaggacagaactaagcgaccatggagtgtgcgccactggcttgctccccacaggtctccaactacctcaactggatggtgaggaacctggcagacatggagctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaagcacgtcaatgccctcatcgcccctggacagaagatcgggatctgcggccgc

SEQ ID NO: 89 - DNA, 611 bp, Homo sapiens
  ENST00000528374
ccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcccggcccccagcaccatcgctgatcccaaagaactggccagaccaagggaagatccagatccagaacctgagcgtgcgctacgacagctccctgaagccggtgctgaagcacgtcaatgccctcatcgcccctggacagaagatcgggatct

SEQ ID NO: 90 - DNA, 4283 bp, Homo sapiens
  ENST00000527905
gcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaagcacgtcaatgccctcatcgcccctggacagaaggtcagagcacgggcccaacccaatgctgcaggacaggcgtgagcaggggatggggcatgcacggagctggatggcttcgcagtcacctcgtggccctccagggcc

SEQ ID NO: 91 - DNA, 440 bp, Homo sapiens
  ENST00000531891
caccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggaccaagggaagatccagatccagaacctgagcgtgcgctacgacagctccctgaagccggtgctgaagcacgtcaatgccctca

SEQ ID NO: 92 - DNA, 665 bp, Homo sapiens
  ENST00000531137
ctggccatcgtgtgctacttcatccagaagtacttccgggtggcgtccagggacctgcagcagctggatgacaccacccagcttccacttctctcacactttgccgaaaccgtagaaggactcaccaccatccgggccttcagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaagcacgtcaatgccct

SEQ ID NO: 93 - DNA, 708 bp, Homo sapiens
  ENST00000524561
cctcagagggatggaaatgtgtagccacagagtgggttcttgcggcctgcagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggat

SEQ ID NO: 94 - DNA, 958 bp, Homo sapiens
  ENST00000526921
atgaccctctgcaagtgctcgggccaactctgaccaggctgaccagctgcatcccctgcctctacccacgccaggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaagg

SEQ ID NO: 95 - DNA, 836 bp, Homo sapiens
  ENST00000529967
ctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggtgtg

SEQ ID NO: 96 - DNA, 547 bp, Homo sapiens
  ENST00000530147
gctcgggccaactctgaccaggctgaccagctgcatcccctgcctctacccacgccagggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactgggtgagggggaacaagggggtcaggctatagggggcagggctggggaggctgtcaggcatcttggcaggaaccaatccgttgtcttggtagcaactgctgagggccacaaagcataagagaccagcactggatggctttatgcatgctgggcatttcagggagaccctgtacaggccaggggtttggtatcacctagacccacagacactccccatcctggcccgggccccccatggtacactcaaggctggcaccaagaagtctcaggaa

SEQ ID NO: 97 - DNA, 727 bp, Homo sapiens
  ENST00000531911
ggccagtctcccactcccctgctctggaagtgatccaggggctggaatcagtgtcttttggctttcatggaggaggggaagccagagactattcactgggaactggctgcctttctgttctctcctgggcggtgggacacgcctaatgaagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggc

SEQ ID NO: 98 - DNA, 2098 bp, Homo sapiens
  ENST00000532728
gagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgaggtgaggggagggtccgggcgagggcactgggcaggcaggtcctgtgtcagcctcaaggcttgctcgagtgatggccaaaccacagctgtttggtcccggaacacacccccattgctgggccttgctgtagctggtcctggttggtcagagggacattggcctgtatggtttcccagctcgccatccctgagcaaggacttgcttacatacctcccaggagaggggactcactgtcactttcacgacaact

SEQ ID NO: 99 - DNA, 549 bp, Homo sapiens
  ENST00000528202
cgcgggtggagacgacccgcaggaaggagatgaccagcctcagggcctttgccatctatacctccatctccattttcatgaacacggccatccccattgcagctgtcctcatatgctgagcgtttccagtgtgggagggacccacaccctgggccaccctggcctcacttgtgcctctgtccacagactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgaggtgaggggagggtccgggcgagggcactgggcaggcaggtcctgtgtcagcctcaaggcttgctcgagtgatggccaaaccacagctgtttggtcccggaacacacccccattgctgggccttgctgtagctggtcctggttggtcagagggacattggcctgtatggtttcccagctcgccatccctgagcaaggacttgcttacatacctcccag

SEQ ID NO: 100 - DNA, 2011 bp, Homo sapiens
  ENST00000635881
gagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccagcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgaggtgaggggagggtccgggcgagggcactgggcaggcaggtcctgtgtcagcctcaaggcttgctcgagtgatggccaaaccacagctgtttggtcccggaacacacccccattgctgggccttgctgtagctggtcctggttggtcagagggacattggcctgtat

SEQ ID NO: 101 - DNA, 598 bp, Homo sapiens
  ENST00000526002
ggaaacctgggcaccaaggcttgtcccactctaggggactggggaaacagggattttgccagcacctcctggcagggcaaccatcaggtcaaagggacctgacccatgaccccttcctcagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagct

SEQ ID NO: 102 - DNA, 4923 bp, Homo sapiens
  ENST00000302539
agaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcaccatcgctgatcccaaagaactggccagaccaagggaagatccagatccagaacctgagcgtgcgctacgacagctccctgaagccggtgctgaagcacgtcaatgccctcatcgcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcct

SEQ ID NO: 103 - DNA, 183 bp, Homo sapiens
  ENST00000612903
ccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattgggtgaccgaatcccaccatctgcacctgtacat

SEQ ID NO: 104 - DNA, 4276 bp, Homo sapiens
  ENST00000515655
gaaaaaaggaacccaaggagataggagagctgttaatttcactcgggacatttcctcgaggctagtttactcggaaagcctcaatgttccctggtagctgcaggatctactttgggggctgccaagtttcctctctcattctttctcctgccccaagagcaggcaggaaggaaagttcctggactgatactcgtctgtttagtaggcgtgggtcctggttgaagtctgtctaggaaaactcctaagtgtagaaatcttcttcgtattaccactgtctctgcactgagatttgggctgctttgcttccagcgtcacacatcataactgagaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattatatccta

SEQ ID NO: 105 - DNA, 4479 bp, Homo sapiens
  ENST00000237612
actgcgttcagctctggcggtccacagcccgaagcgcggcttaggaagttcgtgtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattata

SEQ ID NO: 106 - DNA, 451 bp, Homo sapiens
  ENST00000505480
aaaaggttccgggcgcgcaggagggaagaggcagtgcccgccactcccactgagattgagagacgcggcaaggaggcagcctgtggaggaactggaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgc

SEQ ID NO: 107 - DNA, 391 bp, Homo sapiens
  ENST00000503830
agtgacggcgaccaaacccagctaggtcagacgagaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgc

SEQ ID NO: 108 - DNA, 558 bp, Homo sapiens
  ENST00000569411
aaagcagtttcaggctcatagaattttagaaatgggcctagtttcccagccggatgagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgcc

SEQ ID NO: 109 - DNA, 8735 bp, Homo sapiens
  ENST00000352732
agccctcctcccctttccccgcccactccgggctggccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtcgtcaggggcgtggcggcagttacttgggcggggccggtagcggcgggagctgcactggccaggggttccggctgtatatccatgagcgccgctggcagccggggagctgcaggaaccagactgggggcgagctgagcacctgtagtcaatcacacgcagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacgtgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatactttaaaaagatatttttcctccttcatctcctttgactccaggacagactggaatataagtagtgggtctgcatggatgtttcagggatcaaaggagccacctgggcgcctgagtgccaaccctcagggccacaggtgggtgtggtttgggcacgggtccaagtgactgtgacgggacccgtgggcatgggtccaggtctgtaacctgaagaagttgttttctgacaatcaccaaatcatccgaatgacatcaaaagcagcccttatctcagagactgagatttctgtggtctcaacttcgctttggtataatttctggcactcaccagcctctatcattatgactttccccccagtgtattatttctctaataggtttccttttcacgttcttttagcacagactggcactttaccctctcagtttggaagttagcccctctcctctgttacttttcccttcacccaactacagctgtgatctagaacattcatagtcatatttctgctactactaccttcatttatcaagactttttatgagaataggtaaaccaagcaataacttcctaggactgaatcaccaccccagaagagcgagaggctcctttcatatgcctgaggccacaccccttaacctgttctgacaaaatagtggctggcccatgtaccagctccattcagaaattcaggaagagaaaagacagccctgttgtcacacaaaccggtgtgggggagggtggagcctggtctgcacggcagtcctggtggcccctgtggaggacaggcagggctggcagcatagcctttgttgccacacaaccggaatttgctcccccaggactgtgggagccagtgtcccagctgaaatctttttagtgtgtggctctgaatggcactcacattccattttggctcacatgaaactaactgaagccctttgttcaagcttcaggctcttaggcatggaaatgagaatgtgactgtggctgtcttacaggaaaattcttgtttgtccctgaatgagagcacagaggcattgaattcacagagctgcaaacttgcctgataaatgagggagtggcagtttatagataggtcatcttttttccttcctccaggtgtccttgcctttcttcccaaagtcattcatttctgatgagtatatgaatccccctcttgctagtaaggttctatttgggctaaaacaaggctgaatttttaaagagtatttgaatatattttagaatcaaattgaggctataaattgcatcaatctggacaattccattgcaggaataatatgttaaaaaccaatggggagaagcacccacatctctcctgtagcactccgtgtctcataagcaatttgaagacacttacaagtaactgattccagtcaaattaggattaactgactcaaaaaatggtgtcaagtttctttaatgtttttatgttagaagtgagtttaacagacttgaagaaaactgttatcttttcctgctgtgagtttacacaaatgattccagagcagaatgaaagcagaaagctgttggttacaatattcttttaacctctctgcagcattttacacttactgggaaccttatgattcaccgtaagagtggaaatatacctgagttcgtgtcctaatggtctctaattcacattggatcgtgggcaaatcacctcacctctctgagcctgttccctcctcttagaccatctctaagaccacttcatctatttacacatcatttgcttgaacattgctgaacatctgcgtgaacttggcctctccagcccttgcaggtggaaacagctgtgtcaaggctcaaggctcacgctgaggggacttggagggagggggcttctgcattaagctttcctggtgaagacccttgatcttgtccaaagccctgtgtctttgactggcttctcttcagagtccccgttgtcatcgtaagacccttgctgtttggagggtggtcttgtgactgtggcagctgctggccgctggaatgaggagcctatctccatcctccagtgtgactcaggcagagcattgagaattcccagggcagaaatccttcctgctcaggctttcattctaaaactacagtcttcattaaagctgaactttctgggtagctgagcttatatgcccggcatctgaatgagagctctctttgtaactgtgtgacttgagatctagtttgccagctcctgggaaacaatacatgtgttcttgtttgtgtttgctcagcaagcagatgtctgagatgtaagaagcttttcttttcctgtggcattgattctgacttagagctgaagtaaaagatcactgaaacatcacgtcaagttgaagtcactcataggtctttgtcctttaggcaggacaggagagtcattaagaagcatttcactgtagcattctatcacaatatcatctggaattgttttctttgcccagaaagccttaacttgcctctagagaatccctggtattacaacgatattgcggcattagaattccaactcttctgctgtggaagtttgaagcgaagctgcagcaaaaccagagaatttcctcaagtggcctgtaggctccttgttatcttatgcccccacccctccctcaacaatatgagtgatccagaactggcccaaacacctcagctctggtccctttttgcccttcttggccttactctgttgttcaaagccactttggattgcttggatgcttcgaacagccatgaaaagtagcctgcctgtggcatttagaggccaagcaattgacagaaagggtttcttctacctctgttatctaagcagagggaagtaaacctctcaccgccccccacccctcactgcccccgattaccctagaattgctttcgccaaattgtagttgaagctaaggaaggggaatctggcccctgctgggagagggaactggaatgccacacaaggcaaggcctgcttccttccttcccctctgctgctgctgcctcggaacgctgcagcccaggcttcctcccacagtggcccttggaagcaggccgcagagtagacagctgctccttttggaagagtcagtcccctgtgttttctgaactgtttttcctagcatgtatgtgggtagagctttcatgcatctctagtaataataagctgaaattagttttttttttaattctccaatttaaaacttttaattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagacgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgatttgcttctgatagcttcatcatttctccctgaagtcttttacactcttctgttagtttccttgtttcagtatcatgaagtgaagcactgtgtggttgtggcgtgggcccgtcttgcttagatgcattcagtgggacagctttgctgggttccatgtcattcaatttatcattttcattggggatctccatttggaatccattaattcatgaggttttgcctcattccacacagcttccatatctgaagtgtttagtggagcaaaaattgtaccataaacttgtgtttactcttttcattcggatcatagtcaaagggctgtagcattactgaaacagtcacagttgaccctgggtcaataattccactgttgggcctcacacagtaccggtgaggcacggtagtcttcactttgaaacacacttttctatccgatggatttcgcaatttaagatttgtagtgactacatctgtgaaggggcctttgaatttgaggtctatgggcgggtcgaggaccaggatctgctcgtgcttcgccgtggccccggaggcagacgccattggagagacagcgcagagcagggggcggcttgctcgctgggggcgggggacgatggcgagaggggagggggagcgagttcgcatctctccttttcctggttagactctgttcaaccacattcttatgttggcagatctgcttccagattgatttttagagcaccatcactttcacattcctgattctgattttgttttgttttgtttgggttttctgaaacttaaaatgctgccccgaaaatactatatttttgagtttgtgttctgaaagcctccgtgctgctggatctttggggggaaatacaggatccttcagcactgaggtgtttaagatttgcaactagcaatgcaattttttctaaatatggggatatttacctttattaagaaattatactaaacattgatgtccttgatcattttatgttctcatattacttttgattctactatgattgtgtggtggtgaacaaagatcattacaaacaaaaactgtaattttgttatatttgattcaatggaatttacctaaaaaataaagactaaaaatgtggtgtg

SEQ ID NO: 110 - DNA, 542 bp, Homo sapiens
  ENST00000564876
agttacttgggcggggccggtagcggcgggagctgcactggccaggggttccggctgtatatccatgagcgccgctggcagccggggagctgcaggaaccagactgggggcgagctgagcacctgtagtcaatcacacgcaggttctgtcctcttcatttgcaagccactgctttatccacgagggtgctccctacttatgccagtgaattaatttttggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataag

SEQ ID NO: 111 - DNA, 557 bp, Homo sapiens
  ENST00000569550
agttacttgggcggggccggtagcggcgggagctgcactggccaggggttccggctgtatatccatgagcgccgctggcagccggggagctgcaggaaccagactgggggcgagctgagcacctgtagtcaatcacacgcaggcacagatgaatccttcatatttatctggatttagctggtagcatttgtctcctaagacttggtcacagaggaatccatgtgaccttcaggccttctgctctaaactggcaggagatcctgtttctactcacagcgtccgagcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgct

SEQ ID NO: 112 - DNA, 845 bp, Homo sapiens
  ENST00000565066
acttgggcggggccggtagcggcgggagctgcactggccaggggttccggctgtatatccatgagcgccgctggcagccggggagctgcaggaaccagactgggggcgagctgagcacctgtagtcaatcacacgcaggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggag

SEQ ID NO: 113 - DNA, 2347 bp, Homo sapiens
  ENST00000565973
gggcggggccggtagcggcgggagctgcactggccaggggttccggctgtatatccatgagcgccgctggcagccggggagctgcaggaaccagactgggggcgagctgagcacctgtagtcaatcacacgcagaaataataatgatacttatgttagaagattgttttgagaagtgcatggagttactacatctgaagcatttagaacagtacctggcacaggaggttagagtgatgtctttcgtccctgtggggagtgaggtggaatgtcaggagggcgtagtttgcaaaacatccctcccagtggtactgatgccttttcgcaggttctgtcctcttcatttgcaagccactgctttatccacgagggtgctccctacttatgccagtgaattaatttttggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttttaggtttgtttgaataagagatctgacctgaccggcccaactgtacaactcttcaaggaaaattcgtatttgcagtgggaagaataagtaacattgatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcga

SEQ ID NO: 114 - DNA, 583 bp, Homo sapiens
  ENST00000565825
atccatgagcgccgctggcagccggggagctgcaggaaccagactgggggcgagctgagcacctgtagtcaatcacacgcaggttctgtcctcttcatttgcaagccactgctttatccacgagggtgctccctacttatgccagtgaattaatttttggcacagatgaatccttcatatttatctggatttagctggtagcatttgtctcctaagacttggtcacagaggaatccatgtgaccttcaggccttctgctctaaactggcaggagatcctgtttctactcacagcgtccgagggtctggtggccgagccctgaggggcgctgttgctcccaggtggcagaattcagcatcagagagccacacagctgaaagagatggatggcttgggcgacaagagcgaaactccatctcaaaaacaaacaaacccagagtatttgagcaccgtgatgactccattccacagaaccctctgtgggaggacacgtggtcctagaccaacaccgatttgctaaaaggtttgtttgaataagagatctgacctgaccggcccaactgtacaactcttcaaggaaaat

SEQ ID NO: 115 - DNA, 787 bp, Homo sapiens
  ENST00000562254
gctgcaggaaccagactgggggcgagctgagcacctgtagtcaatcacacgcaggaaaaaccagctctcacacctgctcctctgtaaagcgtcttccccaagcccacacgtaattttgttgctgtccttgaaagtatttcccaagatctccaaaccgctttaaacttccaaggtctgagcctgacctggcctcgctaacaaagggttccactgatgccgactctaagaagaaagttttcaaggttcttcgtatttgaactttctatggctaggcttatgtttaaaataaccacactgatttaaacatggtcttatagtcttcagtggctcccaggtcttgcctctcgggttttttttcctctttcctttgaatgtgccttaaccttcgtcttgcttttatttacctctgagtctggtttagagccacctggaaattgaatggaatctttagtctattagtctaatctagagtccttaccttctggcctttgctcattgcagagcccccacattattagtcagttgtaccacagatactgtgttacataaggtgaggagagggaggtggtgttatcagttccactttttccaggctagagtgcagtggcccgatctcggtgcactgcaacctctgcttcccgggttcaagcgattttcctgcctcagcctctcattttatcttggataaaagagaagctttgaaagattgcctccctatgtgtacagtcactgtaggcatgtatttgtgtactgtttacttagtcatgtcaatgagggcaataaaaaa

SEQ ID NO: 116 - DNA, 588 bp, Homo sapiens
  ENST00000562073
tcctcttctgaccaaagaatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgagtttgctgttgttggtattgaagacatcagtccttttcaaaaa

SEQ ID NO: 117 - DNA, 502 bp, Homo sapiens
  ENST00000568308
ttcttccagggcccaggaaaccttcatgcaatgggatcagtgccggcggttctacaacttcctcatggctgacaacatgaagaagatcatcctctcgcacaggcaagctctttttggagaccatgttaagaaaccccagagcctggaagacacggacttgagccggctctacacagcaacatccctgatgcagattgatgacaatgtgatgaggaagtttcacggctataactccctgaaggaatactatgaggaagaaagttgcatgcggtacctgcacaggatttatgttcctctcatgctggttaatgcagctgacgatccgttggtgcatgaaagtcttctaaccattccaaaatctctttcaggtaagtgtttcttcctgctgccctctcaacagctcagcaagttgccacagtaaattctgtcaccttcaccatgctgtcatctcctggagaccaccctctttagggaaagacatctcatagcagtcagtgttctt

SEQ ID NO: 118 - DNA, 2064 bp, Homo sapiens
  ENST00000289119
gtcggaagccgcgctccgccaggcaggagacactgtggtcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggaggaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcattatattaaaataaattctaccattttaaattgg

SEQ ID NO: 119 - DNA, 1836 bp, Homo sapiens
  ENST00000580981
tcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaatcttttatgtattctaactttaaaagacaagtgcaacaaagttagactgacttctatatgtgctcttttactctgataatattaaattaggactaacttatgttttataatgattataatttacatgcttatttttaaaatagtatatgtggacacatatatatcatta

SEQ ID NO: 120 - DNA, 2080 bp, Homo sapiens
  ENST00000578270
aagtctttgccggtttctggtttacggttggcagaaactttgctctgggcccttctctgatactgcttttcccttcagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatattggttttctggagggaatctggccaagacagtccacttacatggatcgtgtcttcaagcaatttgtgcaagccatggttgagcatggacatgaactctcttaacatgtagttctttgggtgcattttgtctgaaccacaattgtgaaggcagctcagcttagtgcacaaattttaactgttgtatataaagcaaataagccagcagatgggtgaagaggtccagaatgatatgcaaaaactactttttagagaaacaaaacaactttgtagcaacaaattaaatatagtattagattgttacttacgtagattttatttttactatgccttaccaagtacatccttaaacaaagtagtatgtacatgaaattgcacttaaccaaaactattgtgtaaaacaaattttaattcctcagggttttaatttaaactagtatttttttagattatttgttttaggtgatttaatggtactttaataactactaagaaatattggctatttcaatgtaagttataaggtggtacattcctaagggtatttatagttgatgataacatgaaaactgaaataagataaaatacaacgtgctaaa

SEQ ID NO: 121 - DNA, 877 bp, Homo sapiens
  ENST00000577564
gacacgtttgagtatggtactttgtttaattgaaggtatttgtattggtcttgccccatctgcatcaagccttccttgcatgttcatggtctttttgttagtgccaactctaactgtgctgactttaaatggcatgtatgtgcgctgcaagacaggaaaatgataaattattaatactacagtatgtgcaaacaaaggttattttctcatatgtatgactccttgctcctgtttacatttctgcattttacaaatcattaacctcacattgtaatttttgtgctttacttgtcactacttccagacgccaaggacttattgttgtgctaacactgaagacttggagacagttattcaccatgtacacagcctgtacccttctgctcctttcctggcagcaggggtttcaatgggaggaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagcaccgacatatgtttgtaaaacaagttgatatggatcatgtcatgaaggctaaatccatcagagagtttgataagcgattcacttcagtcatgtttggataccaaacaattgatgattattatactgatgccagtccgagtcctagactgaagtcagtaggaattccagtattgtgtctaaattctgtggatgatgttttctcacccagtcatgctattccaatagaaactgctaagcaaaatcctaatgttgctttggtccttacttcttatggaggccatatt

SEQ ID NO: 122 - DNA, 291 bp, Homo sapiens
  ENST00000580477
attatactgatgccagtccgagtcctagactgaagtcagtaggaattccagtattgtgtctaaattctgtggatgatgttttctcacccagtcatggtaatcttagaagctgaaacttacagccttgaccacaatttagaaaatgaaactctgaactttaatatcagttgacttacatggtgattgttttagcatattttcattggattaaggaagtccagtatttctctacccgtttttatatttcactgccctttttaccaataaaaagttcccaacattttaacctta

SEQ ID NO: 123 - DNA, 1311 bp, Homo sapiens
  ENST00000577891
actgtggtcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattgcatcactcaccggctgccatgttgaccttctgattcctgacgcactcccagccatccctggagctgcgttctgaagctgaacttgtagcatgactttcatcactccagttacagaaataatcacttattgctctctccagctgcagtggccttcaaaattatttttccccagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtctt

SEQ ID NO: 124 - DNA, 865 bp, Homo sapiens
  ENST00000579875
ggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagacgccaaggacttattgttgtgctaacactgaagacttggagacagttattcaccatgtacacagcctgtacccttctgctcctttcctggcagcaggggtttcaatgggagggtaaggttttccctttctaaaataatctctgagagggaagctattttattggctgtctctttgagaggactataagctagctgtatggacactttttaaataaatgtctgattatgtttatcatattttattaaatgcggttgattgaatgaacgaaggaaggaaagaattaattcaggtgaattttaatatttttcttaactacgggtctctgtgactgcggattttgtgagcctgaaggtttgtctgaagcccatgaagtcgattg

SEQ ID NO: 125 - DNA, 440 bp, Homo sapiens
  ENST00000584464
cgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttgtgacttaggcactggaggaaatgaagatcaacacgatttcgaaagcaaaagttgcagagtgttatggtcttactcaagtgccttgtaataaatagcttgacgtgaa

SEQ ID NO: 126 - DNA, 604 bp, Homo sapiens
  ENST00000577928
ggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacagatgtgtggtttttaacaacagaggagtggcgggggagaatctcttggtaagtaaatttaaatgacaacagtcttaactttttaaagaatcatttctagttttataacaaaaagcatattctttttatttaaaataactctgtttatgtaagcaatacaaatttattatacaaaaatacagatatg

SEQ ID NO: 127 - DNA, 1664 bp, Homo sapiens
  ENST00000579982
ggagacactgtggtcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgggcttcagcgtcgcttatgccttctactacctgagcagcattgccaagaaaccccagttagtgaccgggggtgagagtttcagccgcttccttcaagaccactgtcccgtggttacagaaacgtactacccgacggtctggtgctgggagggtcgaggacagaccctgcttagacctttcatcacttcgaagcccccggtgcagtacaggaatgaacttattaaaactgcagatggaggacagatttcactggactggtttgataatgataacagtacgtgttatatggatgccagcaccagacctactatcttattgttgcctggcctcacgggaacaagcaaggagtcatatatccttcatatgatccatcttagtgaagaattaggatacaggtaccagtaaaagatttcttttttttcacttgatccattccaaatgaagtacaaatatatctacatgtttgtttcagaaatacttagtacttcttgcatagaaaagcagtcccttaaattattatttttctctgcattctttttttcctctttcttttcaggaagatgcataactgaatcatctcacaagaaatgtcacttagcatagtagacactctgcagatttaggctgagttaatgaatgaaattagaatcatctgagcattgactgagcccttccccccatccccaccccaatggagagtgtgttatggagggagaacagcaattacagacccctgagagagtacacagtggccgtcatgccacattctggggcctggattcactaatcttgtcgccctggctcagctcccaagtgcaaaaaatattcagaatcagcttgtaggttgtccctatttatcaaaggtgatctctgcctcttctgaccacctgagtttgcaggtgcacttggctagtctccagttgttgatgccacagcttttctgagtaaccattattaagctcagtcaccaggtacaatttaattttttgcaagtgattagcaactttgagtttcaagttcagctctagaatcttagagtcattataaaaggtactgcttttttgtgcctcagcttttttttttagctgataattattgtaatggaacactctgtgagttgtatttaaagtagagttgtatcttttgttaaacttgaaacacttgtgtgaaaagctgatggtaagtttaccttaaaaaaataattttaggctggtcacagtggctcatgcctgtaatcccagcactttggaaggcgtaaagccggtggattgcttgagcccaggagttcgagaccagcctgggcaacatggtgagacctagtctacaaaaattagcagggcatggtggcatgcacctatagttccagctactgacaaggctgaggtaggacgatcagttgagcccgggaggtagagactgtagtgaaccatgatcg

SEQ ID NO: 128 - DNA, 876 bp, Homo sapiens
  ENST00000456453
gcaatggtgcgatctcggctcaccgcaacctccgcctcccgagttcaagcgattctcctacctcaggctcccgagtagctggaattacaggtatctagagagtcgagtgggagggaaattgctggctctggccactacagtaacatcagcacctagagcagtgctcaactgactgaaggctcctgtgagtcgccctctccccctggccccccaacccgcggggaaaggctggcgggacgccacacagcacctcgattacgccatttcatttgccactgcaccatctatcggacactagctaggctcttccaggaccggacgcacctccgtccccaaggtgccacctgacagccaacaccgacggggtgatgcatgaatacagtcattattcaaattagctaaaacacctaactcattcgggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatc

SEQ ID NO: 129 - DNA, 1690 bp, Homo sapiens
  ENST00000458276
agtgcgcggaagacgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagtggtgagacagctttcaagaatatgactattccttatggatgggcaaaaaggccaatgctccagcgaattggtaaaatgcaccctgacattccagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaagagtagtgaatacaacacacaaccaggcagccttcttgactatactttgcacatgttttctttaggaattcactcacacatttaaaccagttagtgccttctagaagaatggctttcctttctcctacacaaaattgaaatatacaagtctctaaatataatacctttaaataaaaggttatttgtccctctgatgtactgaaaaactgtaatttttcagctgaaaattttttaatctaactttgctagttatttttatattgcaatctatattaccaatttaggaagtgatttctgagtctcttacactgtaaaggtgcactttattttctttgtcttccccatcatgtatttattgtgtcttgataactgatattaatctaaattcaatgtgtttttatgtaaaaatttgtcagttgtttagaatatttcactttgttttt

SEQ ID NO: 130 - DNA, 618 bp, Homo sapiens
  ENST00000486764
tggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaatgtaaggctttcttcttgtaagttaaatgagctgtgtactaagataggtccaatatatctcattgccctgaaactggaggtaagattctgtggtgtgttcattgttggcaaaataacttttttccttttccttgtcattagaaagtacagaaatgaatgtcgggggctggcaggtaggagttctaaaactttttggtcttgggcccctgttatactcttaaattagtaaggaccccaaggagatttgtttatgggcttattatcaatatttatcatttctaatacaattagaaattaaaattgaataatcaaaaatgttaatttattaatttctttaaaaataatagtaaacccattacagattaaaataaataaaatttgtacc

SEQ ID NO: 131 - DNA, 833 bp, Homo sapiens
  ENST00000013894
gccggcttcgagataagtcccggcgcttgcgcggcggcggctatggcggcggaggaggaggaggtggactctgccgacaccggagagaggtcaggatggctaactggttggctccccacatggtgccctacgtctatatcacaccttaaagaagctgaagagaagatgttaaaataaagtacagaaatgaatgtcgggggctggcaggagtataataccctcatttgacagatgtggaaagaagttagaaggtaatatgacttgccaaagaccttgatcacaggttacttgaggtttgtctgaggtgtgccttgcacatacaaaaaagaacctgttcgtatatctaatggaaataaaatatggacactgaagttctctcataatatttcaaataagactccacttgtccttctccatggttttggaggaggtcttgggctctgggcactgaattttggagatctttgcaccaacagacctgtctatgcttttgacctattgggttttggacgaagtagtagacccaggtttgacagtgatgcagaagaagtggagaatcagtttgtggaatccattgaagagtggagatgtgccctaggattggacaaaatgatcttgcttgggcacaacctaggtggattcttggctgctgcttactcgctgaagtacccatcaagggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttgg

SEQ ID NO: 132 - DNA, 464 bp, Homo sapiens
  ENST00000454293
gtctgagccggactccggccgcgccgggaggccgccttgaccccgcgcggagggtccgccccgttgttgtataagccaccccgcgggccggcgacggagctggccgcggcggccgcaccggctcgggctctgccaagggacccggcctgccccaatgccgccggcgggcggtgcccggtcgaccctgcacctgactgcgaggcgcgggaaatgaccgggtctgtcagcctcccatcgcggcttccgtctacaggtcaggatggctaactggttggctccccacatggtgccctacgtctatatcacaccttaaagaagctgaagagaagatgttaaaatgtgtgccttgcacatacaaaaaagaacctgttcgtatatctaatggaaataaaatatggacactgaagttctctcataatatttcaaataagactccacttgtccttctccatggttttggagga

SEQ ID NO: 133 - DNA, 525 bp, Homo sapiens
  ENST00000413300
agggttaatcatctcattttagtggagccttggggtttccctgaacgaccagaccttgctgatcaagacagaccaattccagtttggatcagagccttgggagcagcattgactccctttaaccctttagctggcctaaggattgcaggaccctttggtttaagtctagtgcagcgtttaaggcctgatttcaaacgaaagtattcttcaatgttcgaagacgatactgtgacagaatacatctaccactgtaatgtgcagactccaagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctggtgactgatatagttgttcagcaataattcatagtctgtgatgaa

SEQ ID NO: 134 - DNA, 631 bp, Homo sapiens
  ENST00000463153
aagtggtgagacagctttcaagaatatgactattccttatggatgggcaaaaaggccaatgctccagcgaattggtaaaatgcaccctgacattccagtttcagtgatctttggcgcccgatcctgcatagatggcaattctggcaccagcatccagtccttacgaccacattcatatgtgaagacaatagctattcttggggcaggacattatgtatatgcagatcaaccagaagaattcaaccagaaagtaaaggagatctgcgacactgtggactgaacacactgaagctctgatgggaaaacctgtgtgctttctggtgaccatgaatggatgctgtcagtagatgccttggtgctctttacggtgctggtgcaactacccccaactgtcaggaagatgtcccctagtggcttatagctgtctcctctgcagaattgcccttggccaaacagctgcttcctcacctgggagatcacacccctgcagccgatgattgactgacacgtgggtgcagaaagcctgccctcttgcctccaggtgggacccagtctgtggtgcaatttgtgttcctgggcacctgtgggactggctgaagttaaacttcagattaaactacatccttaatta

SEQ ID NO: 135 - DNA, 2109 bp, Homo sapiens
  ENST00000225941
tcctatccaccctccactcccctgtcccttggtgactcatccctgagcttcccaaggaagcccccaccctctgccctttcctcccgccttccatgagtggaaaatccacctccgccccctatagcaggccagcccccttcctccccagtctccgaccccatcccccagccgaccagtttcctctccaggaccagggagcaatcacagctgccccgaccttggcttcctctgctgggtgggattgggggctgggcccccaaatgggcccctggcttcccccttcctctgggcaggggacagagagacacaggctcggggagcaggactgacttcctcttgtcccggaatgagcatgcctgccctttgcaagcaggtttgggtctcacgcagaggaaaccaaaagcaataagagggagggaaggcagagcaaccaatcaagggcagggtgagactcaaaacgagcgggctccctggggagccagacagaggctgggggtgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtgtaagcacgctgggccagatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgttttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcctgtgactgccccacagagataaggggccaggagggattgaaaggcatcccagttctaaggctgctgctaattacagcccccaacctccaacccaccagctgacctagaagcagcatcttcccatttcctcagtacccacaaagtgcagcccacattggaccccagacacccctctgcagccattgactgcaacttgttcttttgcccattg

SEQ ID NO: 136 - DNA, 1718 bp, Homo sapiens
  ENST00000419580
ccaggaccagggagcaatcacagctgccccgaccttggcttcctctgctgggtgggattgggggctgggcccccaaatgggcccctggcttcccccttcctctgggcaggggacagagagacacaggctcggggagcaggactgacttcctcttgtcccggaatgagcatgcctgccctttgcaagcaggtttgggtctcacgcagaggaaaccaaaagcaataagagggagggaaggcagagcaaccaatcaagggcagggtgagactcaaaacgagcgggctccctggggagccagacagaggctgggggtgatggcggagctacagcagctgcaggagtttgagatccccactggccgggaggctctgaggggcaaccacagtgccctgctgcgggtcgctgactactgcgaggacaactatgtgcaggccacagacaagcggaaggcgctggaggagaccatggccttcactacccaggcactggccagcgtggcctaccaggtgggcaacctggccgggcacactctgcgcatgttggacctgcagggggccgccctgcggcaggtggaagcccgtatggtgaacatgcatatggagaaggtggcccgaagggagatcggcaccttagccactgtccagcggctgccccccggccagaaggtcatcgccccagagaacctaccccctctcacgccctactgcaggagacccctcaactttggctgcctggacgacattggccatgggatcaaggacctcagcacgcagctgtcaagaacaggcaccctgtctcgaaagagcatcaaggcccctgccacacccgcctccgccaccttggggagaccaccccggattcccgagccagtgcacctgccggtggtgcccgacggcagactctccgccgcctcctctgcgttttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagatgatgtcctgtgactgccccacagagataa

SEQ ID NO: 137 - DNA, 810 bp, Homo sapiens
  ENST00000573347
aacaggcaccctgtctcgaaagagcatcaaggcccctgccacacccgcctccgccaccttggggagaccaccccggattcccgagccagtgcacctgccggtggtgcccgacggcagactctccgccgcctcctctgcgttttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggcctttctgcttttcccccaagacgaagagctgcccctgccactggacctgcctcctcctccacccctggatggagatgaattggggctgcctccacccccaccaggatttgggcctgatgagcccagctgggtgcctgcctcatacttggagaaaggtacctgacttctgggactgaggggcaccggatcccacttcctctgttgccctgatccccattctcctccctctgcaaaggtgtgaatctatcccccgggccccccacacaatttttctgacgaactgacagaactggggagagggcagctggcctggtattaaatattaactaagctggggaggggtcctgaaggcttgcaagaaggcccccaagatggcccctagagtctagtacttgagaccgtgcatccccatggtggtggggggtgagggggagagggcaagaggcattatctcacggcaccctcttctcttgccctgcagtggtgacactg

SEQ ID NO: 138 - DNA, 866 bp, Homo sapiens
  ENST00000571035
gagaccaccccggattcccgagccagtgcacctgccggtggtgcccgacggcagactctccgccgcctcctctgcgttttccctggcctcggccggcagcgccgaaggtgtcggtggggcccccacgcccaaggggcaggcagcacctccagccccacctctccccagctccttggacccacctcctccaccagcagccgtcgaggtgttccagcggcctcccacgctggaggagttgtccccacccccaccggcctttctgcttttcccccaagacgaagagctgcccctgccactggacctgcctcctcctccacccctggatggagatgaattggggctgcctccacccccaccaggatttgggcctgatgagcccagctgggtgcctgcctcatacttggagaaagtggtgacactgtacccatacaccagccagaaggacaatgagctctccttctctgagggcactgtcatctgtgtcactcgccgctactccgatggctggtgcgagggcgtcagctcagaggggactggattcttccctgggaactatgtggagcccagctgctgacagcccagggctctctgggcagctgatgtctgcactgagtgggtttcatgagccccaagccaaaaccagctccagtcacagctggactgggtctgcccacctcttgggctgtgagctgtgttctgtccttcctcccatcggagggagaaggggtcctggggagagagaatttatccagaggcctgctgcagatggggaagagctggaaaccaagaagtttgtcaacagaggacccctactccatgcaggacagggtctcctgctgcaagtcccaactttgaataaaacagat

SEQ ID NO: 139 - DNA, 6783 bp, Homo sapiens
  ENST00000471714
gtgagtaagcccacggcacagctaagtgcagccgcccgcctctgtcactgggagacagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagctccaaaaagccttccagaatttcctgaggcaaaaacacccttcccttttgagaaacctaggggcacattggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgccccagaacctcagactctactgccatcacagtcaacaataggacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgcctcaaaaccatctgagagacctaaaaccacacacagaccagatgcacctcaaattcagcctggttcaaaaccaccaaaacaattacttcctaaaccccaaaccacagcagaaccagacatgccaccaactaaatccgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgccacaatcctcgaaccagttcttagaactgaggcttcagggacaacagcagctcccaaagtgcctcaacgaactcatcgtccacatcccaaacctaaaaccacactgagtcccgaagagcttcagactgaactggttcctgctacaatctttgaaccagtttctcctataaaagaggctccagggacaacattcgttcctgttacagacctcgagcctgttacttttagaactgagatccctgcaacaaccttagctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagttcctactgcggagctcaaacctgttacactcagaactgagacttgggtgacaacacaagctcctaaaacatcacaacgaactcgtcgtccacgtcccaaaactaaaaccacaccaagtcctgaggttcctcaaaccaaactggttccttctacagatcttgaacctggtactctcagaactgaagctccaaaaaccatggttgttactacagtccttgaacctgacacttttagaaccaagtttccagaaacaacgttagctcctaaaacacaacggacacgtcgtccccgtcccagacccaaaactacatcaagtcctgaagtacctcagaacaaatcggtttctgttacaggctttgaacctgttgttcatagtactgatgctccaggaacaacatttgctctgactgaactgcaaactcttattttgaaaccagtgacatcaccaagcctagaaatgacagaaagtcaacctgtttctgatgttctggaatcggttacacttagtactgagtcaccaaaggagaccatagcaccagccaaaacagactatgtatatcccactgccaaagcaccactctggccagaggagccaaagactgaagttgtggaatctattacatatgtatctgaaccacctgagaccacactagaaacgtcgcctctgccttctcaatctataaccctacccagcccagatgagcctcagactgaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttttaagattgagtttttgtttgttatttctgaatggttcatcagtatgttaactataccttttatcgagaaggaaaatcactaagttttattcaggctctaccaacccccattatatctactgtttgtttatgtcctaaattaacctttcatcctatgaagtaataaagttcattttaaaccaa

SEQ ID NO: 140 - DNA, 2984 bp, Homo sapiens
  ENST00000470336
ccatttaatgtatagtttatttctaggttttccttctgtgtttttagacactgaaatgcctaaatattgatttgtttattattttgtttctttatttttccagctcccggtaaaacacaatttatttctctgaaacctaaaatccctctcagcccagaagtgacacacaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttttaa

SEQ ID NO: 141 - DNA, 4498 bp, Homo sapiens
  ENST00000284322
gtgagtaagcccacggcacagctaagtgcagccgcccgcctctgtcactgggagacagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtattttaagagatcatttgtatattatttatcacactgttgtaatgatgttttgagatacttttataacaaaattaacatcaaaaaggtatatactttttaaaaaaaatttacttttattgatgtgtactcttcctattgatgagttaattccataaatctctacttagtttaacttattggatcaaattatcttcagcatgtatatctggggaaaaaaggtccgaattttcacatttatatttaaacttcaattttttatatttaaacttcaattttttagcaacagctgaatagctttgcggaggagtttaatagttacacattcatgctaatatacatttcctttaaacatccacaaattcttaaaaagattgaatcagtaaatttcatttcagctaaaaatggagtctaatatattgtttcaaaagatacatttttacccaccataaatgttacaatatctgaatatgctttgtcaaactatccctttatgcaatcgtcttcatattgtttttatgattctaatcaagctgtatgtagagactgaatgtgaagtcaagtctgagcacaaaaagataatgcacgatgagattgcctaccattttataggatatttactatgtatttatacgttaagacctctatgaatgaatgtatcagagaatgtctttgtaactgtttaattcaatctgtaataaaaatctaactaactaactcatttatttctattaaaaaggtattgtcctttaggcggggaatgggaatccttgctgcactgttgcagtcattctgaaaggacctttccctgtacttacctttcaacatgcttcaatcttatcaacgctacattttgtatttttcaaacaagtataaattctgcaataaagagatgtagtttttttttaa

SEQ ID NO: 142 - DNA, 3650 bp, Homo sapiens
  ENST00000495591
ttatttctctgaaacctaaaatccctctcagcccagaagtgacacacaccaaacctgccccagaacctcagactctactgccatcacagtcaacaataggacctgaaacaccaggaaccaaaccttcaacaacattagctctggaacctgccacgatacaaccggagcccttggtgcccacaactgcctcaaaaccatctgagagacctaaaaccacacacagaccagatgcacctcaaattcagcctggttcaaaaccaccaaaacaattacttcctaaaccccaaaccacagcagaaccagacatgccaccaactaaatccgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgccacaatcctcgaaccagttcttagaactgaggcttcagggacaacagcagttcctgctacaatctttgaaccagtttctcctataaaagaggctccagggacaacattcgttcctgttacagacctcgagcctgttacttttagaactgagatccctgcaacaaccttagctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagttcctactgcggagctcaaacctgttacactcagaactgagacttgggtgacaacacaagctcctaaaacatcacaacgaactcgtcgtccacgtcccaaaactaaaaccacaccaagtcctgaggttcctcaaaccaaactggttccttctacagatcttgaacctggtactctcagaactgaagctccaaaaaccatggttgttactacagtccttgaacctgacacttttagaaccaagtttccagaaacaacgttagctcctaaaacacaacggacacgtcgtccccgtcccagacccaaaactacatcaagtcctgaagtacctcagaacaaatcggtttctgttacaggctttgaacctgttgttcatagtactgatgctccaggaacaacatttgctctgactgaactgcaaactcttattttgaaaccagtgacatcaccaagcctagaaatgacagaaagtcaacctgtttctgatgttctggaatcggttacacttagtactgagtcaccaaaggagaccatagcaccagccaaaacagactatgtatatcccactgccaaagcaccactctggccagaggagccaaagactgaagttgtggaatctattacatatgtatctgaaccacctgagaccacactagaaacgtcgcctctgccttctcaatctataaccctacccagcccagatgagcctcagactgaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaacaaaaatcattgaaaatactatgccgcattcatttaaagctattttgtttactatgtataaaagtctacaatctaattaatagcaatactagatgtttattattagaaaagattgctgagagtatttatcaggttttacaaagtcattttaagaaagcaagatactgatgttaacagaataacatttttggggaagctggctccctattcatggtat

SEQ ID NO: 143 - DNA, 2454 bp, Homo sapiens
  ENST00000487012
ctgtttattttttatgatgcagtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggctcccaaagtgcctcaacgaactcatcgtccacatcccaaacctaaaaccacactgagtcccgaagagcttcagactgaactggttcctgttacagacctcgagcctgttacttttagaactgagatccctgcaacaaccttagctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaacggttccccaaagaggaggccacagaggggaatgccaccagcccaccacagaacccacccaccaacctcactgtggtcaccgtggaagggtgcccctcatttgtcatcttggactgggaaaagccactaaatgacactgtcactgaatatgaagttatatccagagaaaatgggtcattcagtgggaagaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggaaaattttataacataggtgatcagaggggccatggagaagatcactgccagtttgtggattcatttttagatggacgcactgggcagcaactcacttctgaccagttaccaatcaaagaaggttatttcagagcagttcgccaggaacctgtccaatttggagaaataggtggtcacacccaaatcaattatgttcagtggtatgaatgtgggactacaattcctggaaaatggtagatgctgcacaaagttaccttctgtttcatcattgcaaac

SEQ ID NO: 144 - DNA, 618 bp, Homo sapiens
  ENST00000497021
gaacaagtccattcaaatgacaaatcagacattttccacagtagaaaatctgaaaccaaacacgagttatgaattccaggtgaaacccaaaaacccgcttggtgaaggcccggtcagcaacacagtggcattcagtactgaatcagcggacccaagagtgagtgagccagtttctgcaggaagagatgccatctggactgaaagaccctttaattcagactcttactcagagtgtaagggcaaacaatatgtcaaaaggacatggtataaaaaatttgtaggagtgcagctgtgcaactctctcagatacaagatttacttgagcgactccctcacaggtaagcagagctaccagctctgttttcagcccttaacttatgggaatgttttgcagcattgtacaacttggccttttcttaagagtttcaggcacgaatgggtgctgtaaacacaagttttcctctgagcaaaatgttacggaaacagttatcattcctagaaagcaaggatttaagacatgctattagaaggtaaataataaaaatgcaattataaaacagtgccatcatgacaaactggaatgtacattcactaaccatggtcaaactccattttgtt

SEQ ID NO: 145 - DNA, 700 bp, Homo sapiens
  ENST00000486770
cagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggcgccacacagattttatactactgtgaggcccagaacatctgacaagccacacatcagacctggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaaggacctcatgtgcgatacatccaaaagcctgacaacagtccctgctccattactgactctgtcaaac

SEQ ID NO: 146 - DNA, 543 bp, Homo sapiens
  ENST00000469764
tgtatattcatctataatgaggacatgttttctatatactacagtgcgttgttgtccctggggacattaccaacatttatttataggaatatctgaatatatttgtgtgcacttttctgtagaatctattctctgtcatccaactgctaattatcaaacattattttttatttttaaaaaccctgtttttttcgataatgaatctttatgatggctttatctaaaatacaatctcttatccacaatcccagggactcgccgcccacccttgccacccagacctacacacccacgaagaaaacctttaccaccaaataatgtcactggaaagccaggaagtgcaggaatcatttcatcaggcccaataactacaccacccctgaggtcaacacccaggcctactggaactcccttggagagaatagagacagatataaagcaaccaacagttcctgcctctggagaagaactggaaaatataactgactttagctcaagcccaacaagagaaactgatcctcttgggaagccaagattcaaagg

SEQ ID NO: 147 - DNA, 566 bp, Homo sapiens
  ENST00000497395
tactgcaaaaccaaaaacgtcaccaagtccagaagtgtcatacaccacacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagggactcgccgcccacccttgccacccagacctacacacccacgaagaaaacctttaccaccaaataatgtcactggaaagccaggaagtgcaggaatcatttcatcaggcccaataactacaccacccctgaggtcaa

SEQ ID NO: 148 - DNA, 922 bp, Homo sapiens
  ENST00000471901
atcccaaacctaaaaccacgccccatccagaagtacctcaaactaaactggctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagttcctactgcggagctcaaacctgttacactcagaactgagacttgggtgacaacacaagctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctggaagaaacagaccaatccacccaagaacctttcacaactaagattccacgaacaactgaactagcaaagacaactcaggcgccacacagattttatactactgtgaggcccagaacatctgacaagccacacatcagacctgttctgaataggacaactacaagacctactaggcccaaacccagtgggatgcccagtgggaatggagtgggaacaggggtcaagcaagcacccaggccatcaggtgctgatagaaatgtatcagtggactctacccaccccactaaaaagccagg

SEQ ID NO: 149 - DNA, 453 bp, Homo sapiens
  ENST00000527943
ttgtggaatctattacatatgtatctgaaccacctgagaccacactagaaacgtcgcctctgccttctcaatctataaccctacccagcccagatgagcctcagactgaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgttctgcagcctgttacctttagatttgagccaccaaagacaacaatagctcctctagagacacgaggcatcccttttatacccatgatttccccaagtcctagtcaagaggaactacagaccactctgg

SEQ ID NO: 150 - DNA, 475 bp, Homo sapiens
  ENST00000482765
gtttctgatgttctggaatcggttacacttagtactgagtcaccaaaggagaccatagcaccagccaaaacagactatgtatatcccactgccaaagcaccactctggccagaggagccaaagactgaagttgtggaatctattacatatgtatctgaaccacctgagaccacactagaaacgtcgcctctgccttctcaatctataaccctacccagcccagatgagcctcagactgaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctcctctagagacacgaggcatcccttttatacccatgatttccccaagtcctagtcaagaggaactacagaccactctgg

SEQ ID NO: 151 - DNA, 561 bp, Homo sapiens
  ENST00000478235
ctaaaaccacgccccatccagaagtacctcaaactaaactggctcccaaagtgcctcaacgaactcatcgtccacatcccaaacctaaaaccacactgagtcccgaagagcttcagactgaactggttcctgctacaatctttgaaccagtttctcctataaaagaggctccagggacaacattcgttcctgttacagacctcgagcctgttacttttagaactgagatccctgcaacaaccttagctaccaaaacatcaaaaagaacccgccctccacgtcccagacctaaaactacaccgagccctcaggcacctgagaccaaacctgctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctcctctagagacacgaggcatcccttttatacccatgatttccccaagtcctagtcaagaggaactacagaccactctgg

SEQ ID NO: 152 - DNA, 560 bp, Homo sapiens
  ENST00000466947
atttatttctctgaaacctaaaatccctctcagcccagaagtgacacacaccaaacctgctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggctcccaagcagacaccacgtgctcctcctaagccaaaaacatcaccacgcccaagaatcccacaaacacaaccagttcctaaggtgccccagcgtgttactgcaaaaccaaaaacgtcaccaagtccagaagtgtcatacaccacacctgctccaaaagatgtgctccttcctcataaaccataccctgaggtctctcagagcgaacctgctcctctagagacacgaggcatcccttttatacccatgatttccccaagtcctagtcaagaggaactacagaccactctgg

SEQ ID NO: 153 - DNA, 563 bp, Homo sapiens
  ENST00000533795
ccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgcctcaaaaccatctgagagacctaaaaccacacacagaccagatgcacctcaaattcagcctgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggctcccaagcagacaccacgtgctcctcctaagccaaaaacatc

SEQ ID NO: 154 - DNA, 375 bp, Homo sapiens
  ENST00000528305
ctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggctccaaaaagccttccagaatttcctgaggcaaaaacacccttcccttttgagaaacctaggggcacattggcttcaagtgaaaagccatggattgtgcctacagctaaaatatctgaagattccaaagttctgcagcctcaaactgctctgactgaactgcaaactcttattttgaaaccagtgacatcaccaagcctagaaatgacagaaagtcaacctg

SEQ ID NO: 155 - DNA, 3714 bp, Homo sapiens
  ENST00000495063
cttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagctccaaaaagccttccagaatttcctgaggcaaaaacacccttcccttttgagaaacctaggggcacattggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgccccagaacctcagactctactgccatcacagtcaacaataggacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgcctcaaaaccatctgagagacctaaaaccacacacagaccagatgcacctcaaattcagcctggttcaaaaccaccaaaacaattacttcctaaaccccaaaccacagcagaaccagacatgccaccaactaaatccgtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggctaccaaaacatcaaaaagaacccgccctccacgtcccagacctaaaactacaccgagccctcaggcacctgagaccaaacctgttcctgctacagtcctagaacctgtcactcttagacctgaggcctcaacaacattagcttccaaaacatcacaacggacacgtcgtccacgtctcagaacaaaaaccacaccacgtcctgaagcacctgaatccaaaccagttcctactgcggagctcaaacctgttacactcagaactgagacttgggtgacaacacaagctcctaaaacatcacaacgaactcgtcgtccacgtcccaaaactaaaaccacaccaagtcctgaggttcctcaaaccaaactggttccttctacagatcttgaacctggtactctcagaactgaagctccaaaaaccatggttgttactacagtccttgaacctgacacttttagaaccaagtttccagaaacaacgttagctcctaaaacacaacggacacgtcgtccccgtcccagacccaaaactacatcaagtcctgaagtacctcagaacaaatcgggtaaatgtatgaatccttggcttaagtagccaaggaacctgaaccctggcaggctgtcccaataaagtcctaaagaaatgcctatgacgggaagtaacagtcatcatgttttctaagaatcaaattatttaacatgggtagcaactgcttctcgtacagagctatccaggagaacatggcttggagccacttgtgtgcctgatctcctaaatgacttggtttggatgacgttcttggtccctctttaaagatgtgtttacagcgagattagcatactcatgggtatttattgctatatctgcattgaaacatgtgatccatttgttatgattacataaacaggcatttattttcaacttccaagaaaagcaacaagttactttcatatatatttctctctgtattttcgtatctgttgcctaaacaaatttccaaagccaaatatccatactagttagaaaaccaaatacctaggaaaacctcatgtggataatatcaagatatgtaacagagttcaaaggttgtaactaccttctttgatgaattgttctagctagtgtggccaaatcttccaaaagcaactatatgctgcctatcaattcaaaagttttaaaaaattgtgtatcatttgaaactcatgttttaaaataaaaattgaggattttttttaaaaagtc

SEQ ID NO: 156 - DNA, 561 bp, Homo sapiens
  ENST00000528490
aaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggctcccaaagtgcctcaacgaactcatcgtccacatcccaaacctaaaaccacactgagtcccgaagagcttcagactgaactggttcctgctacaatctttgaaccagtttctcctataaaagaggctccagggacaacattcg

SEQ ID NO: 157 - DNA, 527 bp, Homo sapiens
  ENST00000487249
ctcacataataaataagcctatcaagaaggcaatttatattaatttagaataaactagactctgtgtcctctgaattaaacaccaatgagcacccaaaagtttagacttccttgcttttattacttatatctgtttattttttatgatgcagtctctgagcctgttccatttgaaactgaagctccctcaatgaccatagttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactggttcctgccacaatcctcgaaccagttcttagaactgaggcttcagggacaacagcag

SEQ ID NO: 158 - DNA, 450 bp, Homo sapiens
  ENST00000534413
gacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgttcccaccacagacattgagcctgtaactgtgagaactgaggctacagtgacaacattagctccaaaaacatcgcaacgaacaagaacacgtcgtccacgtcccaaacataaaaccacgccacgcccagagacactgcagaccaaactagactttggacctattactcctgggacatcttcagctccaacaacaacaacaaaaagaacccgtcgtccacatcccaaacctaaaaccacgccccatccagaagtacctcaaactaaactgg

SEQ ID NO: 159 - DNA, 261 bp, Homo sapiens
  ENST00000534256
ctcagactctactgccatcacagtcaacaataggacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgtctctgagcctgttccatttgaaactgaagctccctcaatgaccatag

SEQ ID NO: 160 - DNA, 910 bp, Homo sapiens
  ENST00000533855
aaacaccagaggttgaaaaaatctcagcacgacccacaacagtgactcctgaaacagttccaagaagcactaaacccactacgtctagtgcattagatgtttcagaaacaacactggcttcaagtgaaaagccatggattgtgcctacagctaaaatatctgaagattccaaagttctgcagcctcaaactgcaacttatgatgttttctcaagccctacaacatcagatgagcctgagatatcagattcctacacagcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctgctccccagcaaactacatctatcccttctacacctaaacgacgcccccggcccaaaccgccaagaaccaaacctgaaagaaccacaagtgccggaacaattacacctaaaatttctaaaagccctgaacctacatggacaacaccggctcccggtaaaacacaatttatttctctgaaacctaaaatccctctcagcccagaagtgacacacaccaaacctgccccagaacctcagactctactgccatcacagtcaacaataggacctgaaacaccaggaaccaaaccttcaacaacattagcaccacgaaagaccaaaagaccaggtcgtcgcccccgcccccgtccccgccctaaaaccacacctagtccagaagtgcccaagtccaaacccgctctggaacctgccacgatacaaccggagcccttggtgcccacaactgcctcaaaaccatctgagagacctaaaaccacacacagaccagatgcacctcaaattca

SEQ ID NO: 161 - DNA, 251 bp, Homo sapiens
  ENST00000459682
ttttgagaaacctaggggcacattggcttcaagtgaaaagccatggattgtgcctacagctaaaatatctgaagattccaaagttctgcagcctcaaactgcaacaagtgatcgtattctggattctatcccacctaaaacttctagaactcttgaacagccaagggcaacactggctccaagtgaaacaccatttgttcctcaaaaactggaaatctttaccagtccagaaatgcagcctacgacacctg

SEQ ID NO: 162 - DNA, 560 bp, Homo sapiens
  ENST00000483129
aaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactggttctcagcaaaaggaccccggaaacattgcaaactattctaatacctcagtttgaattgccactgagcactctagcttcaagtgaaaagccatggattgtgcctacagctaaaatatctgaagattccaaagttctgcagcctcaaactg

SEQ ID NO: 163 - DNA, 3544 bp, Homo sapiens
  ENST00000475896
aaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagctccactgggaggagtgatactagtccaccttattattccaggtcttaatgaaactactgtaaaacttcctgcatccctaatgtttgagatttcagatgcactcaagacacaattagctaagaatgaaaccttggcattacctgccgaatctaaaacaccagaggttgaaaaaatctcagcacgacccacaacagtgactcctgaaacagttccaagaagcactaaacccactacgtctagtgcattagatgtttcagaaacaacactgggtaattctaagaactttttttttttctaaaaaaacaaaagtaacaacgaaataactcccaggactcacagaaaagaaacctggtgccttaacttctctctccctccccactttctccttttccttccttcctggcagtggttaaccttcctctttcttggacagattccactgaagagttaaccacatggctgatcctggtgactgaacttctgggcaaatctggatgctaattgctaactaaatgccctttttaaccagtctctgggttatacagacagaataccagccttttaactcccaaatcttgggggagaatgaaggaaacctggaagtcttgactctgtgctttctgcttagagtggctttgggaagtcttgtgcatactaaatttgggaagaatccccaaaagtgtcatgcttttaaacaagaatttcatggcacccatgtttgttgtttcttagcccaagagaatctaacttgctttgttgttctctttcccctgaagaaaaggagcagcatgtgttttgttctgtaatttgatgttgatcttctcagccacaccactgccctttgaatgtacaccttcatattttaacagctatgtaacttttccagggaaggttatttccattaaaggtattggctgctctgtgtgcaagagtctgttacaaagcttgctgtgcatgatcatggttaagccacaacatcaaaacccaagtccaggagttgctaactgcactcttttttattgtagttctcagcaaaaggaccccggaaacattgcaaactattctaatacctcagtttgaattgccactgagcactctaggtaaaaaataataaatactgcagctttattattaccttggatattgtatgcatgcttcaaagaagtcttttgaattaattacgctaatttatacccaatcccttaaaggtgacacagtcttcaagtttaggatcccaaagaggctctccctatgacaaattgtttggttgggttgtttttcttttaagtggtcatattttaatattatgtttgattcttttaattcagaatcaatatgtcactgaacaaattgatcatttctgtattttttgtaaatgtgtttactctattgtctctcttaacagagaagatatatttatgatatttctgcagactgcttcttataattcttagaattcttctgagtgaagtatgagaaaaatgagggcagggtgcagcggctcatgcctgtaagcccaacactttgggaggctgaggcaggtggattgcctgaggtcagtagttcaagaccaccctggccaacctggtgaaaccccgtctctattaaaaatacaaaaattagactggcatggtggcatgcgcctgtaatcccagctacccaggaggctgagacaggagaatcgcttgaacccaggaggtggaggttgcagtgagccaagatcgtgccacgcactgcaacctgggtgacagagcgagactccatctcaaaaaaaaaaaagaggttgggggaggagcttacatataaagccacgtagttaccaaaactctatttttaaaagctttcagatggacattttctagttcagatgtgtttgcttggtttaaatttaaatgaaatatatttaagaacacacataaacatagctgaagaaatcagcaaactggtttaataagggtggaaagaagagtccaaatacagtagcttaaatttagtcacttaactataaaaaactgaaaaagaaactttcttatattcaacattgaaacatagatgtaagaaatactactaatggtctcttaacatgatttgcctttttgtgtttgcttttgtttttgcaagcttaaaattttaaaaatctttcctgttactttcacctcaggtcgtaactttctttatgtgtttcattacagctccaaaaagccttccagaatttcctgaggcaaaaacacccttcccttttgagaaacctaggggcacattgggtaataagagtaccttaaatttaatattaaggctgtgggtggtgattgcttaattctgcaggacacatttactgcatcttatttctggaaacctcatgaactgatagttaggcaaacaaatggttgatttgatttttttttaataaatctatttggattttctgcaaattcggtaaaacccatcagtcttaattccacataatccacttagctttttgtccttaaaaatgctgacagtctgacaccaaactctggtctctctctgaccactaatcaaatgttctctggatggatacatactgatttcttactgatatataatgactttttattgtattggtatactgcaggcttctggtagccacttaaccataccagcaacctatttctgtctcgttctcctgttaaaaaaaaaaaaaa

SEQ ID NO: 164 - DNA, 573 bp, Homo sapiens
  ENST00000527258
tgcattgttgttctgtggtacggctggctgcacttttatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaagtaaaaaagtaaatgggaaaatccaaagtacctatgaccaagaccacacagtgccagcatatgtcccaaggaaactaatcccaataacaatcatcaagcaagtgattcagaatgttactcacaaggattcagctaaatccccagaaaaagct

SEQ ID NO: 165 - DNA, 571 bp, Homo sapiens
  ENST00000530539
aagtgcagccgcccgcctctgtcactgggagacagtccacttaaatgcagctccagggttgcgaggcacccaccagcatcattccccatgcgaggtggcaaatgcaacatgctctccagtttggggtgtctacttctctgtggaagtattacactagccctgggaaatgcacagaaattgccaaaagatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaacccacaccatgactggacattgccaagtcactgtcccaatgacagattttatacaattcgctatcgagaaaaggataaagaaaagaagtggatttttcaaatctgtccagccactgaaacaattgtggaaaacctaaagcccaacacagtttatgaatttggagtgaaagacaatgtggaaggtggaatttggagtaagattttcaatcacaagactgttgttggaa

SEQ ID NO: 166 - DNA, 553 bp, Homo sapiens
  ENST00000530236
accagcatcattccccatgcgaggtggcaaatgcaacatgctctccagtttggggtgtctacttctctgtggaagtattacactagccctgggaaatgcacagaaattgccaaaagcaaataaaaggactgaactagtgatacagcatggatggatgagtctcataaaaatgatgctgaatgaaagaagccaggtgtgaagagaacatgtcatgtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctcggtcttcctgtcctggggtttcctcatcaaccc

SEQ ID NO: 167 - DNA, 586 bp, Homo sapiens
  ENST00000532144
atggcaaattagctttttcatgtgcaactggattgatttgctagtattttgttgaggatttctgcatctatgttcatcagggatattggcctgaagttttcttttttcattgtgtttctgccaggttttggtattagaatgatactggcctcatagaatgagttatggaggagtccctcctcctcaattttttggggaataatttcagtaggattggtaccagttcatctttataggtggaatttggctgtgaatctctctggctcagggccttttcaggtaaaaggccaaacctcaaagtccacatcaataccacaagtgactccatcctcttgaagttcttgcgtccaagtccaaatgtaaagcttgaaggtcttctcctgggatatggcagcaatgtatcaccaaaccagtacttccctcttcccgctgaagggaaattcacagaagctatagttgatgcagagccgaaatatctgatagttgtgcgacctgctccacctccaagtcaaaagaagtcatgttcaggtaaaactcgttctcgcaaacctctgcagctggtggttggcactctgacaccgagctc

SEQ ID NO: 168 - DNA, 6841 bp, Homo sapiens
  ENST00000392952
aaagcgaggagaggaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 169 - DNA, 7408 bp, Homo sapiens
  ENST00000392955
ctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 170 - DNA, 2255 bp, Homo sapiens
  ENST00000369253
cgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcgggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaa

SEQ ID NO: 171 - DNA, 3203 bp, Homo sapiens
  ENST00000369256
ataccaggagtttgtcagggaactgtttccaaagccataatgaataatcaggctgttagtaaaagaagcctctccaagttatagcattttttaaaaattctagtagtgaagaaaataattaaaagcccatctggttgagatagtaattcattaaggaaaaagaggaggcagaaggctggggaataatcgatccttttctttctttatttcatgtgtttcagttattgtgaaatgatagtgatcaaaatctggattctggattgtgcagaatgcaggaaaatcctaggaacattcttggcgtgttctaatagtggcttcccagaaacgagtgttttcagtgggtgtggcgtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgatgcagctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttccttt

SEQ ID NO: 172 - DNA, 2657 bp, Homo sapiens
  ENST00000277895
agacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcataggcgtgccactatcactcatttgctgtatctctgtcccaaggactactgcccacgtgggcgtgtatgtaacagcgttgatccttttgtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagattaccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacac

SEQ ID NO: 173 - DNA, 498 bp, Homo sapiens
  ENST00000485570
ggggatgtcagcgggggagtgcgagattaccaggtatggaacactttgtctttcttgaattggccacaccgatagaacagccatgttccaacccagactgctggctccaaggcaacagtttctgttgagaagatgcttgttgtggttgatctctctagtcattactctatagccgtgaagagcagacatgcctggtgcctgggtcaagctgtccctgcaggccttggggacactgcatgaaccaggccaggtgtagggggtctctcttgctttggccttggagagtcctctctggggtggaagtggaccagcatcaagggtctgctcatatacagtttttcttcttttaattataatctctcagtactttaggccacccttttcctgcgcgttctcaaatgaaaagacactgatgtcttagccaataggagagagcagtttgccctcatgacattcctttctcactagaacctcaatcttgttaaaaaaagaaagaaa

SEQ ID NO: 174 - DNA, 541 bp, Homo sapiens
  ENST00000440467
tgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgtactgtttgaagtcatccttttgttgttaatttaagaataaaattctcagcatttga

SEQ ID NO: 175 - DNA, 854 bp, Homo sapiens
  ENST00000428430
gaggcgtgagagagcgtgcctgcccgccgcacacggggctggtttccggagtgcgtctctagagggatgcacgttgccttagccgagcttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggtaaagcggacattgcacaaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagc

SEQ ID NO: 176 - DNA, 448 bp, Homo sapiens
  ENST00000466400
caaagagttaacaaacattgtgactttaaattctcttttatttttctagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggtaagggtgactgttcctggattcactctatataacaaactatgtttctgtgattttttcccctactattgatagcacattgaaaaatcaacgactaaacatttccatccctctcccagagcaaaatgaaaactggtatccaactatattttatgctctatcttttcttgaaacatcagtcatcctaagcctgtgttcattttgatttattaaataattatattttgacagcg

SEQ ID NO: 177 - DNA, 518 bp, Homo sapiens
  ENST00000481974
ctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaagtaaggctgggcgcgggcacgcgttcctttcagtgggcaccgggcgttgtggttcttctgcaggtcctggtctcaggggccccaccccatcaatggtgctgaaattgttcacatcctgccatcataatgaacttgttgctataaaacttttgaaaagaa

SEQ ID NO: 178 - DNA, 356 bp, Homo sapiens
  ENST00000477638
aaggatcattttggacaactaatgactgggtaactgtgtatgtagcttcaagtagctgccacttgccacagcaggaaatgggcctttagtggcccaccctcaggaccctcaccacccatcagagaagcctgtcattcactgccataaatgtggggagccttgcaagggtgaagtgcttcgggtccagaccaaacatttccacatcaagtgtttcacctgcaaagaaacttctagaccatttagaaaagaccaaggaccaaggagactgcccagagaatcaagattgttcagccaaattgtctgttttcagtgatcctttcctgggctgtcccatatataaaatcaactactcccta

SEQ ID NO: 179 - DNA, 7606 bp, Homo sapiens
  ENST00000533213
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagatttccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 180 - DNA, 7690 bp, Homo sapiens
  ENST00000369252
gtcattgagctgatgtgcttttgcaaggggtctctttagaagtggtaggggcagggtcgagagaagaaggggatgcagaatctgtacatgaggaaggagccagagtcactcaggaaactcctcattcttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgcatgttaatgaccttggaaatgactgagctcacggaccctcatcacaccatgggagactacaaagtggcccaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccacccggagaccgagtcacattcaatgggagagactgcctttgtcaactctgtgcacagccgatgtcgtccagtccgaaagaaaccaccttctccagcaattgtgccggctgcggaagagatatcaagaatgggcaggcgctgctggcgctggataagcagtggcacttggggtgctttaaatgcaagtcctgcgggaaggtcctcaccggggagtacatcagcaaggatggtgctccgtactgtgaaaaggactaccagggactctttggggtgaaatgtgaggcgtgtcaccagtttatcacagggaaagtcctggaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcggctgccaaacattcggcgttcttcatccgatttcttttattccaaaagtctgattcgacgcacaggacggtctccgtctctgcagcctaccaggacatcctcggaaagtatttattctaggccaggctccagtattcctggctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaactcccctctcccttaccggccagacagccgccctctaactccaacttacgctcaggcccctaaacatttccatgttccagatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagatttccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgtacagacttgtccaatcatgtgtgtggttcctgcgagttgctgatgactccgcattgaagctctctgagttctttgattttaagttgggtttatggaattttttcaaatgttggaaggtgtgtggttcttcctgccctccctccccttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgt

SEQ ID NO: 181 - DNA, 2230 bp, Homo sapiens
  ENST00000369266
ttcggagagaagcctgatatgtaacccaggcaggtgggagcctcagtctgtcgggctgaggtctggcatctacaaagcctcttggccgtgttctgaacttgaagcctggaggagttctctgctcagcacagccaaggaacagaattagaagaaaaggaaccctggcctgaggcaggtgacaaacattaccaccccagctgtgcacgatgcagcagatgcaaccagatgttcacagaaggagaggaaatgtatcttcaaggctccaccgtttggcatcccgactgtaagcaatctacgaagaccgaggaaaagctgcgggcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctgatcaaggaatcaacatttaccgaaagccacccatctacaaacagcatgctgccttggcagcccagagcaagtcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcttcaccggcctgtttctaccgacttcgctcagtataacagctatggggatgtcagcgggggagtgcgagatttccagacactcccagatggccacatgcctgcaatgagaatggaccgaggagtgtctatgcccaacatgttggaaccaaagatatttccatatgaaatgctcatggtgaccaacagagggcgaaacaaaatcctcagagaggtggacagaaccaggctggagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgc

SEQ ID NO: 182 - DNA, 2756 bp, Homo sapiens
  ENST00000512594
ctactcttttcttatcttctgcagctggcaaaattttactcaatggcttttaaaggacaattttgatcattttagtgctttaatcctattctgagcagctaatttttagattctcaaggaaaacagcatgtttatatacaaggataattaggaagaggggcctttgttttggcgaatttgcagttggttggattcaaacaccagccaggatgcagaggcgcagatggagtgagccccctaaggtgttcttagttcaccgcccagccctctgccctcagcaatgtcgctcctctgccttgggactctggacagacttcaactcagggttggattagcaagtccttggacacagtctgggaacgtggatgaggcccacactccttcccctgggcaggggatctgggctgctccaccagacaggagagatggggctcgctgcaaataagcttttcatgcttgaaatattctactttgctttcccgtttccccttctatctgctgcctttgcccttccgtctggaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaaga

SEQ ID NO: 183 - DNA, 3396 bp, Homo sapiens
  ENST00000361737
gtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaa

SEQ ID NO: 184 - DNA, 1944 bp, Homo sapiens
  ENST00000509819
atgtattctcggtgaccttctgctcagttctttggtgccagcatacacttgcttcgtgaggtgaccctgtggtttcctcccccaacagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattat

SEQ ID NO: 185 - DNA, 2974 bp, Homo sapiens
  ENST00000514025
agaaggggagctgccgccgccgcggtggcactgcctgatgctcggcccagtgtgccggtgccccgctgggtgacagtggactcccagggcgcagcaggagcaggtgacagactgttggctgaaggtgagggtgtccaccctcgcaggcacacgttccagggagcacggcactcaagcagggccgtcagactgggctctggtgcccagaagctgtgcaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattat

SEQ ID NO: 186 - DNA, 2902 bp, Homo sapiens
  ENST00000447017
gactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagcca

SEQ ID NO: 187 - DNA, 2589 bp, Homo sapiens
  ENST00000341937
acctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaa

SEQ ID NO: 188 - DNA, 2472 bp, Homo sapiens
  ENST00000361581
acctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaa

SEQ ID NO: 189 - DNA, 2291 bp, Homo sapiens
  ENST00000407564
gggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagcctgccccactggtgtgtgccgggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcga

SEQ ID NO: 190 - DNA, 1680 bp, Homo sapiens
  ENST00000505872
atgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaatacaagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctga

SEQ ID NO: 191 - DNA, 2573 bp, Homo sapiens
  ENST00000428004
tgcggcggcgctgcctggcgtgtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgtgagtggttcttttgaagaaggagccgtgatgtgcacaaaatgcctcgcggcaaagaggccccagaactcagagctatccccctacatctaagccttgcctgttaaaaagcatgaaagcaaagcccacaaatctaaggaccgaccggaaggaaatatggggcttttgcagtttgccggcttcccaagaactgtccccgagccagtgtgctaacgagggccacgcctgcatgtcccctcacagatttccaaggtgtgcaagaatgcagaaacccagacctgctcctgggctgtttaggagaaaggcgtccgggctgccgggtggaagtcagggcctgttccctccagagcagacatgggcatggtccggctgatgagtgcagacttggagttggtgatgggcaccatccctgtcccctgtgactcatcctgaacgaggcacagcctcaggcttcatagagagacagtgatggtgtctgcctgaccctaggggtgttttgaagactgaatcaggagtgattttcaaatgtagagaaaactccagataatgctgtttgcttccggccgctgtaaatcataggtgaaaaccagtagcaagtgctcactcagtgcctcccagaagcggtctgcgggtctcagctgggctgggggcagttttcattgggcaaggcttgggcttagcttcgaagcaggggctgggagaggatggatgggggtgtgagagcagaagaaagacctggctttgcagtgaggcagtcccaagttcaaatctgagctcaccactgacccgtcgtgtgatgggcgccaggtgttaggagactggaactgggtatgtgtgtggcattcggccggccatagtagctgctcagtaaacagaaactgtttctcatcctcatcctcatcctcatgcctgcaaactgtaaaccgtcctacttaacaatgaaagtagaaaagtgtttcaatgtgacaggaaagagtgaagacacagaagcttggaaatgatgatgtgttaaagaatcactttaaacaaagaaa

SEQ ID NO: 192 - DNA, 1168 bp, Homo sapiens
  ENST00000504172
gagcaggcttggcgttgatttgcctctgtgagtggggagagcagggctttgtattttcacgctgaaaatcactgtctctcctggaagaaggagaaacaggtagccgttgagagtaacgagatgttagtgtattcggaacggaactgctcagtcttcaattttggccttatcttgtcaaggtcctgtagcccaatcccaaatttccaagctctctggcctggtatcagtcttgtccttggtggtgcaggaggcagggtacggcaaaagacagacgggcccgagcccgccgcccgctgcagctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgtgagtggttcttttgaagaaggagccgtgatgtgcacaaaatgcctcgcggcaaagaggccccagaactcagagctatccccctacatctaagccttgcctgttaaaaagcatgaaagcaaagcccacaaatctaaggaccgaccggaaggaaatatggggcttttgcagtttgccggcttcccaagaactgtccccgagccagtgtgctaacgagggccacgcctgcatgtcccctcacagatttccaaggtgtgcaagaatgcagaaacccagacctgctcctgggctgtttaggagaaaggcgtccgggctgccgggtggaagtcagggcctgttccctccagagcagacatgggcatggtccggctgatgagtgcagacttggagttggtgatgggcaccatccctgtcccctgtgactcatcctgaacgaggcacagcctcaggcttcatagagagacagtgatggtgtctgcctgaccctaggggtgttttgaagactgaatcaggagtgattttcaaatgtagagaaaactccagataatgctgtttgcttccggccgctgtaaatcataggtgaaaaccagtagcaagtgctcactcagtgcctcccagaagcggtctgcgggtctcagctgggctgggggcagttttcattgggcaaggcttgg

SEQ ID NO: 193 - DNA, 1028 bp, Homo sapiens
  ENST00000510277
ggagcacggcactcaagcagggccgtcagactgggctctggtgcccagaagctgtgcaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagtcccctcagttgctctcgccaacgccgaccgagggggatcaggatgaccggtcctacaagcagtgtcggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgcccccctccacctaccagcaggcacctcgccacttccacgtcccagacactggcgtaaaagataacatctataggaaaccccctatctacagacagcatgctgccaggcgatcggatggggaggatggaagcttggaccaggataacaggaagaagagcagctggctgatgctcaagggggatgcagacacaaggaccaattctccagacctggacacccagtccttgtcccacagcagcgggaccgacagagaccctctccaaaggatggcaggggacagctttcac

SEQ ID NO: 194 - DNA, 545 bp, Homo sapiens
  ENST00000515079
aggttttttccaggagaccctgctgctcagtgctgtaaacagccatggtggctcctttcttcttgcatcaggcagttacaagcatgggccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgcccccctccacctaccagcaggcacctcgccactt

SEQ ID NO: 195 - DNA, 297 bp, Homo sapiens
  ENST00000502800
tgcggcggcgctgcctggcgtgtgcgcaaggagcgggcgcggagccggcgggcgggcggaggatagcgcgggcgcggcacctgcgggcccgagggtctggctgtcgcagcgccgggccgccccgactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaag

SEQ ID NO: 196 - DNA, 1972 bp, Homo sapiens
  ENST00000545242
gactccgagcggctgctgagatgagtgcagtgtcgcagccccaggctgctcccagcccgctggagaagtcgcccagcacggcgatcctgtgcaacacgtgtgggaatgtgtgcaagggcgaggtgctgcgggtgcaggacaagtacttccacatcaagtgcttcgtctgtaaagcatgtggctgcgacctggccgagggcggcttcttcgtgcggcagggcgagtacatctgcacgctggactaccagaggctctacggcacccgctgcttcagctgcgaccagttcattgagggtgaggtggtgtcggcgctgggcaagacctaccaccccgactgcttcgtgtgtgccgtctgccggctgcccttcccccccggggaccgagtgaccttcaacgggaaggaatgcatgtgccagaagtgttccctgcccgtatcggtgggcagcagcgcgcacctgtcccagggcctccgaagttgtgggggctgcggcacagaaatcaagaatggccaggccctggtagccttggacaagcactggcacttgggctgttttaagtgcaagagctgtgggaagctcctgaatgccgagtacatcagcaaggatgggctgccctactgcgaagctgactatcacgccaagttcggcatccgctgtgacagctgtgagaaatacatcacggggcgcgtgctggaggccggagagaagcactaccacccttcctgcgcgctatgtgtcaggtgcggccagatgtttgcagaaggcgaagagatgtatcttcaaggttcctccatctggcatccggcgtgtcgacaagcagccagaactgaagacagaaacaaggaaaccagaacttcctcagagagcatcatttctgtccctgcttccagcacctcagggtctccgagccgtgtgatttatgccaagcttggtggtgagatcctggactacagggacttggcagcccttcctaaaagtaaggccatctatgacatcgaccgccccgacatgatctcctactcaccctacatcagccactctgcaggggacaggcagagctacggcgagggggatcaggatgaccggtcctacaagcagtgtcggacctccagcccaagctccactgggtcggttagcctcgggcgctacactccgacctcacggtcaccacagcactacagccgtccagctggtactgtgagtgtgggtaccagtagctgcctctccctgtcccaacacccaagccctacatccgtgttcagacatcattacatcccctacttccgaggcagtgaaagtggccggagcacccccagcctctccgtgctctctgacagcaagccgccccccccacctaccagcaggcacctcgccacttccacgtcccaggccccagacactggcgtaaaagataacatctataggaaaccccctatctacagacagcatgctgccaggcgatcggatggggaggatggaagcttggaccaggataacaggaagcagaagagcagctggctgatgctcaagggggatgcagacacaaggaccaattctccagacctggacacccagtccttgtcccacagcagcgggaccgacagagaccctctccaaaggatggcaggggacagctttcactcacgattcccctattccaaatctgaccctctcccaggacatggaaagaatggcttggaccagcggaatgccaatctggccccctgtggagcagacccggatgccagctggggcatgcgagaacagatctatccgtatgactccctcatcgtcacaaaccgaattcgcgtgaaactgcccaaagacgtggaccggacgagactggagagacacttgtcgcccgaggagttccaggaagtgtttgggatgagcatcgaggagtttgaccgcctggccctctggaagaggaatgaccttaagaagaaagcccttttgttctgacggctgccagc

SEQ ID NO: 197 - DNA, 4164 bp, Homo sapiens
  ENST00000326685
gagcggccgcgccccctgcgctgccaacccgcgagcccgcatcatggatgtcgagctcccctatttcgcattgctagccctggaattcgagaccccagacgaggaccaggattcatgaaatcagtcgcaggggccggggcaggggcctctggctcccgacactggccgagaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctgctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaacctgtgtgcttctgttgtttcttgtgtgggagtggaaatgactgacatgggaagaggctgaaccctgcacatttttcaaaatgaaagcaccaaaacagcagcc

SEQ ID NO: 198 - DNA, 4326 bp, Homo sapiens
  ENST00000309868
ctgccaacccgcgagcccgcatcatggatgtcgagctcccctatttcgcattgctagccctggaattcgagaccccagacgaggaccaggattcatgaaatcagtcgcaggggccggggcaggggcctctggctcccgacactggccgagaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgggcccgagagtggccggagctctccataccatagccagttagatgtgaggtcctccactccaacctcttaccaggctcccaagcactttcacatcccagctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 199 - DNA, 4569 bp, Homo sapiens
  ENST00000506113
ggccggggcaggggcctctggctcccgacactggccgagaggtgggttccggggcgggtcgctgctccttgaagccgggcggggacgcgctgcccccgccctgcctccctgtggtccacaccccctttgggctccggagccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgggcccgagagtggccggagctctccataccatagccagttagatgtgaggtcctccactccaacctcttaccaggctcccaagcactttcacatcccagctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 200 - DNA, 4178 bp, Homo sapiens
  ENST00000515171
agccgctgggcaggaatagtccggggtgcgcgcgagcaggcgctgccaaccccacttctgcccgggattccaatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggacatctccagggatggagagctcatccctgcctcctgctttaccttccgcatcaccatcacttgttaattcagcaagtgaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctccttactttctcttttctaagtgctgtgggatctgggaagggatttgaggggactctgtccttttattggggatcctttttatactgaaacatctgtcctaacttgagtgccccaaggtccaactctctttcctaaagaaggtgcctgaagaagtctctcttctctctgcttcgtggcccctttcttaaatttctagggctgatgctgaccatgtggtttccacaccttattggccccagaggggccctcccatgggaagatctgcagcagtctccccaaatcagtgagcacctttgagcgcccacgaagaactttctcaacacccccaattaggagctcagtgctctcttggggcaatgcagttaaaagggtgagcctcaaatctagtcattacaccagtcaacagaagtggacagggcctaggcctctcctcagctccttaaccctcctccttctgccctggattgtaacctctcccttgtccaaatctaggattcctggtaggaaaaggaaaaggcccttcccttccctccaccacttccaactggcccctttgcctgacctggacttggagaaccagaggaaaagagagggagcggaagtgggagatggagcagggcacctgttagaatcagagctgcaggatttcttgggaccctcctctctccctcactgctcccagcacctcctgacccttccctctttcaaggagaagcccatgattgcagcttgtattctttagccttattacaatctatgtgcctgacaactcaacacaccgcagggctaatgttcccaccagagctccaactgaacaaccagacagacaactctcatcatcctccagagagaaaataggccgtgtctcaaagaaaggttcttggtctatgcctctggtctgtgggctggcagggcaaccataccatacccccgccagtcctcggctcctgctgcaaagttggccatgtttcacagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 201 - DNA, 2774 bp, Homo sapiens
  ENST00000504238
caatctgaggagcaggaggaccggggcgccggtgtcctgccgcctccttctccttgctctcacctgcgcctattagtccacgcgccttcaaggccaggggctacagcccagacagagaggggacagcagagggagagagagcacctgaggatacagagctggcactggactgccttttcaccccccaggtgatgagtgaggttcgaagaacggaagatttaaaaagcagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgacatctacgagaacctggacctccggcagagacgggcctccagcccggggtacatagactcccccacctacagccggcagggcatgtcccccaccttctcccgctcacctcaccactactaccgctctggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagggaaacttttggaagagtggctgcttatgagattccaaaatgaagtgttggccaacaccgctcatggccatcctggattttcccagtggcttcccttcctgctcgcctccctgaacaggggagaaagcttaacctctcttctcctctccaaacctttcaccttgaatgggtaatgtttggtgggggctgttccttcttggagaagccttgagtcggaccattttgagatcatggaggaaggatgaagaagtgaaaatgacaataatgactctcaagaggctggcgatgtgacatggcaaatgtagaactgacttaaattgaacaaaccctcactgagcacctctgatgttgagcacctgctgaatactgagcactgaatgggggagggggaggggagcacggggtgagtcaacctgggactcggtctcagggatatgcctaccaatagcgggtatcgtaaggcatgtacccaaacataacggatgtaaggcagaaagtgatcggagaaggaatgagaaagtgtgcgtgatgttaatgaaaagtcatatgcagctagagcagacccaggaaagctttctggaagagattgcatctgaggaaattcaggaaggatctttgtagattggggggagattctaaattgaaggggtgatggggtgaggggccagagggaagtctgctgtgttctcatgtaggatgtcagccctccctgcaacttctctttttggccaatgtcttttcactttcctgaccctttagaatcatccccagccagacgcaatcatggaagttgccttattgtcactggttaagaacttggcgagattgaagggcttttgttattgttgttggatatttttgtttcccataaaagcacatcatttcaaccctaaa

SEQ ID NO: 202 - DNA, 2011 bp, Homo sapiens
  ENST00000508983
cagccggggcctccgtattgaatgaaagacccagtgcaaagacatcaccatgaacactagcattccttatcagcagaatccttacaatccacggggcagctccaatgtcatccagtgctaccgctgtggagacacctgcaaaggggaagtggtccgcgtgcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccactgtgccgggtgcaaggaggagatcaagcacggccagtcactcctggctctggacaagcagtggcacgtcagctgcttcaagtgccagacctgcagcgtcatcctcaccggggagtatatcagcaaggatggtgttccatactgtgagtccgactaccatgcccagtttggcattaaatgtgagacttgtgaccgatacatcagtggcagagtcttggaggcaggagggaagcactaccacccaacctgtgccaggtgtgtacgctgccaccagatgttcaccgaaggagaggaaatgtacctcacaggttccgaggtttggcaccccatctgcaaacaggcagcccgggcagagaagaagttaaagcatagacggacatctgaaacctccatctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgctggagacagtaacatctaccggaaacccccgatctacaaacggcatggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggct

SEQ ID NO: 203 - DNA, 530 bp, Homo sapiens
  ENST00000515796
gcacaacaaccacttccacatcagatgcttcacctgtcaagtatgtggctgtggcctggcccagtcaggcttcttcttcaagaaccaggagtacatctgcacccaggactaccagcaactctatggcacccgctgtgacagctgccgggacttcatcacaggcgaagtcatctcggccctgggccgcacttaccaccccaagtgcttcgtgtgcagcttgtgcaggaagcctttccccattggagacaaggtgaccttcagcggtaaagaatgtgtgtgccaaacgtgctcccagtccatggccagcagtaagcccatcaagattcgtggaccaagccgtgagtcctccccacgggtatctccctgtccatgggtgtgatctctctgggctcccctttcccagcactgccaactgctcccacgggcctggagggaagtgggagaggttcccaacctggaggcctcctgcatcatgaccccattggcatgtggcccagactcacaagcttcacaagcacaatgcagggaag

SEQ ID NO: 204 - DNA, 557 bp, Homo sapiens
  ENST00000514212
atctcaccccctggatccagcattgggtcacccaaccgagtcatctgcgctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgggcccgagagtggccggagctctccataccatagccagttagatgtgaggtcctccactccaacctcttaccaggctcccaagcactttcacatcccagctggagacagtaacatctaccggaaacccccgatctacaaacggcatggtatggtcagaggtagatagggcttggccacacaaggagagggggg

SEQ ID NO: 205 - DNA, 466 bp, Homo sapiens
  ENST00000519549
gctaaagtggataatgagatccttaattacaaagacctggcggctctccccaaggttaagtctatctacgaggtacaacgccccgacctcatttcctatgagcctcattccagatacatgtccgacgagatgctggagagatgtggctatggagagtcgctgggaacattatctccctactcccaggacatctacgagaacctggacctccggcagagacgggcctccagcccggggtacatagactcccccacctacagccggcagggcatgtcccccaccttctcccgctcacctcaccactactaccgctctgccaggaagcaaagtcaagcttgtttctgccaacgtggtgcatgagagcacatgctgcttccgccccggaacctgagcacgctgagacgccccagcccatcccccatctctgctgtcatcacctcaccacttcctaaactgccaccgcgtt

SEQ ID NO: 206 - DNA, 2287 bp, Homo sapiens
  ENST00000517451
ctaagcctcgattgaaggagcacatcccttccattgaagctgcagaggagcagctgccaccctgtgcacccacacttgcttaagggtctagctggataacaaaaggaggcccagaatcggtggagcttggagatgagcgaagcagtcctgcaccaggttctgaactaattagctggtggaggggacaatacgagtttaaacagcggctctgggtgcctaagattctacattttatacagacatccttggttccagagggggctgagcaggggggtccgaggtgagtctgtgagcatgtgcaagtctgtaccagcttgtgaaggacatgccatgtcccctgagtactcatagaaagacaccaacatgacaaaggtagtttggctttatacctagaaaaggcccccaggtcacaagcttctcaggactttgtgggattttccaggtgggccctgaggggtggcactaaagcagactcaagaggagtctggggtggaggtgggttgcttggaaaagagggcggaggaaaaagctaaatgcagtcagccaggaggggctgcccaggacccaagtcaaagagaagaatttgaaagctttggaagcaagtgctgttgtgggggctgcatagcccagggctggctgaagctgatccaccacgctctgccactctggctccacagagcacagagcttgtccctaaagcttcctgtagctgaccatgagaaatggtcatgcagccacacacacttccccagcccctctctctgctctaccagcctgtcacccacgtttgggccacgagaagtcactgctctgtaagtagttgtgactgcagtgggtctttttggtcacccctgtcctgggcttacttcaggtggaagcttgaagctggatggcagctgagccagcagaccgattctgacacttacagatgaggaaactaaggcagagatggtaggacctgcccagtgttacagctgagtaaagtggcagagctgggaccagaacccaggtttgctgactccctgtctagcactccttccttcaggctatgtagtccctgagcagaatgtggcatctcaggttgtgagaaatgatggagttcaaatttataacaaggaaggcttctaaagggctaggaaggcttctaaagggctggggctcacctgggacctgtccagtcttatttgaggagccacacccttagaggtcattctggaacagacctgggaatccatggaatgtgctggaaagagccctgggctgggatctggtccagttctggtgctcacatgctatgtggtcttaagcaagccccttcccctctctggtgctccaattactaaatgcaaaatgagggtttggccccagtgcttttccagctccgatgctccatggcccagttctaacagagagccctgatcttgaagtggactcactcccctgggctggagcctggtaaagataggaaaagggtacacagtcccatcccggtcactctgccttcctgaagtgctctccttgggtcctctgcaggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgagagtacaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctc

SEQ ID NO: 207 - DNA, 778 bp, Homo sapiens
  ENST00000502855
caacatttcctgtcccttcttggcccacttttcctgaatcctgccctaggtctcttgcctactgaaatcagatactctccctgggcttcagagacactctgttggcttgccagtcaccaaatattagacacttacattcgggaggtcatgtgcccatattattccatgggcacatggcaaatacctccaagcttattcctagtagtattaggggactctcttgggccttgtcttttgagagaaggtatcttaagactgctgggcaaccccaagaagggcagatccagctcttcctccagacttaatttctggccatttctggatagaacagagagcccagacacaaaatgtacctgaaaggaacaagcccaccaccctcacccaagctggagaccacccccctttctccttagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctctctactgaagctcggtataatcctctcttgtgtaatgggacacactgcctgccatgagacttgcttttctgtactgtcaggcaagcccacgtcatcgagatatttttatgctcctta

SEQ ID NO: 208 - DNA, 2290 bp, Homo sapiens
  ENST00000356541
ctaagcctcgattgaaggagcacatcccttccattgaagctgcagaggagcagctgccaccctgtgcacccacacttgcttaagggtctagctggataacaaaaggaggcccagaatcggtggagcttggagatgagcgaagcagtcctgcaccaggttctgaactaattagctggtggaggggacaatacgagtttaaacagcggctctgggtgcctaagattctacattttatacagacatccttggttccagagggggctgagcaggggggtccgaggtgagtctgtgagcatgtgcaagtctgtaccagcttgtgaaggacatgccatgtcccctgagtactcatagaaagacaccaacatgacaaaggtagtttggctttatacctagaaaaggcccccaggtcacaagcttctcaggactttgtgggattttccaggtgggccctgaggggtggcactaaagcagactcaagaggagtctggggtggaggtgggttgcttggaaaagagggcggaggaaaaagctaaatgcagtcagccaggaggggctgcccaggacccaagtcaaagagaagaatttgaaagctttggaagcaagtgctgttgtgggggctgcatagcccagggctggctgaagctgatccaccacgctctgccactctggctccacagagcacagagcttgtccctaaagcttcctgtagctgaccatgagaaatggtcatgcagccacacacacttccccagcccctctctctgctctaccagcctgtcacccacgtttgggccacgagaagtcactgctctgtaagtagttgtgactgcagtgggtctttttggtcacccctgtcctgggcttacttcaggtggaagcttgaagctggatggcagctgagccagcagaccgattctgacacttacagatgaggaaactaaggcagagatggtaggacctgcccagtgttacagctgagtaaagtggcagagctgggaccagaacccaggtttgctgactccctgtctagcactccttccttcaggctatgtagtccctgagcagaatgtggcatctcaggttgtgagaaatgatggagttcaaatttataacaaggaaggcttctaaagggctaggaaggcttctaaagggctggggctcacctgggacctgtccagtcttatttgaggagccacacccttagaggtcattctggaacagacctgggaatccatggaatgtgctggaaagagccctgggctgggatctggtccagttctggtgctcacatgctatgtggtcttaagcaagccccttcccctctctggtgctccaattactaaatgcaaaatgagggtttggccccagtgcttttccagctccgatgctccatggcccagttctaacagagagccctgatcttgaagtggactcactcccctgggctggagcctggtaaagataggaaaagggtacacagtcccatcccggtcactctgccttcctgaagtgctctccttgggtcctctgcaggtgatttgtctacagcaaccaagagcaaaacaagtgaagacatcagccagacctccaagtacagtcccatctactcgccagacccctactatgcttcggagtctgagtactggacctaccatgggtcccccaaagtgccccgagccagaaggttctcgtctggaggagaggaggatgattttgaccgcagcatgcacaagctccaaagtggaattggccggctgattctgaaggaagaaatgaaggcccggtcgagctcctatgcagatccctggacccctccccggagctccaccagcagccgggaagccctgcacacagctggctatgagatgtccctcaatggctcccctcggtcgcactacctggctgacagtgatcctctcatctccaaatctgcctccctgcctgcctaccgaagaaatgggctgcacaggacacccagcgcagacctcttccactacgacagcatgaacgcagtcaactggggcatgcgaggtgagtgcaagatctacccttatgaactgctgctggtgactacaagaggaagaaaccgactgcccaaggatgtagacaggacccgtttagagcgccacctgtcccaggaagagttctaccaagtctttggcatgaccatctctgagtttgaccggctggccctctggaagaggaatgaactgaagaagcaagcccggctgttctaggcagaggctctataaatatatatgcatttatataaagatatatgtaaaatctc

SEQ ID NO: 209 - DNA, 2755 bp, Homo sapiens
  ENST00000311955
cacactcattttagccagtgtccaggctatcagcagagaaagacaggtgggcagcatggctccgggcgaaaaggaaagcggggagggcccagccaagagcgccctccggaagatacgcacagccaccctggtcatcagcttggcccgaggttggcagcagtgggcgaatgagaacagcatcaggcaggcccaggagcctacaggctggctgccgggagggacccaggactcacctcaagctcctaaaccaatcacaccccctacttcacaccagaaagctcagagtgccccaaagtcgccaccccgcctgccagaaggacatggagatggacaaagctcagagaaagcccctgaggtttctcacatcaaaaagaaagaggtgtccaaaacggtggtcagcaagacttatgagagaggaggggacgtgagccacctcagccacaggtacgagagggatgctggtgtgcttgaacctgggcagccagagaatgacattgacagaatcctccacagccacggctccccaacgcggaggagaaaatgtgccaacctggtgtctgagctaaccaagggctggagagtgatggagcaggaggagcccacatggaggagtgacagcgtagacacagaggacagcggctatggaggagaggctgaggagaggcccgagcaggatggagtgcaggtggctgtggtcaggatcaagcgccccttgccctcccaggtaaacagatttacagagaaactcaactgcaaagcccaacagaaatatagcccagtgggcaacttgaaagggagatggcagcagtgggctgatgaacacatacaatcccagaagctcaatcctttcagtgaagagtttgattacgagctggccatgtccacccgcctacacaaaggagatgagggctatggccgccccaaagaaggaaccaaaactgctgaaagggccaagcgtgctgaggagcacatctacagggaaatgatggacatgtgcttcattatctgcacaatggctcgccacagacgagatggcaagatccaggttacttttggagatctctttgacagatacgttcgtatttcagataaagtagtgggcattctcatgcgtgccaggaaacatggactggtagactttgaaggagagatgctatggcaaggccgagatgaccatgttgtgattacgctactcaagtgaaccttcaaaaacaaaagccaaatttggcccactatggtcttaatgctaaatgctcatgtaggtaaaatgaaaatgcaaactctctgtaataagttagtaaatattaaacaatttttacataaacgactttctggcattctatttctatctagaatgaggaattttggagattttgagaaggcacaaagcatttcagaaagcacatagaatgttaatgtataataatagtattaatagttgaaattccacagggtgtttttgtttttgttttgagacagattctctttatgtcaccaaagctggtcttttaactcctggcctcaagtgatcctctcacctcagcctcccaagtagctgggattataggcatgagcaacagcacccagccacttgtatattttaggcaaaatatttagctagtcattgtagaaactactatagatttttaattaaacattacatctaagaagaatgctgacttgagataaatatcagtagaacatataataatgtgtctttatttggaaaaaagaaaataccattaagtttggtaaaactaaacttaaaattttttcagaagcttgactttgtattattgtttatatcatagcatcacttacaaaacaagcacatatataaaaagttgtcaagatgttgctgaaattgttgaagttcctctgtgggcttggattctaacaggtttccagtaagagttcaccttcctcttgtttgatttcagcaaatcacataaaaacagacacttcctgtcttagtaccaacaaaggaaggcacaccctcactaaaagtagagcagaggtgagagattcagatttacttgcctttgtaggacttcttggagaagtttattgtttcattacatgtcagcatataacgagtcaagctgcttgcattaacatcaatgcaatgatatgtatttctccaacaatggagaaatacagaaaatctatgaagtggaatgttcagtattagaaaaatcccatagaatcattggtgaattaaaaacagatttgagacagtttaatgttcctcatactgtaacaaagaaaactttatgaaatgtttaagtcataaaactgcaatattagttctgccaaagtaaaaaatatacaatgatgatggcaaggagaaaatcattggacattaatgtgcctatgtgatcttaaaaacaaatggaatggaatgtgagattgcaattcttactggattcaatgaaattactaaaatgcattgatagtatagcactttggtgttaaatgtaaaaattaatgtctaaatatgatacctcaaaataataggtattagactgctataagaattatatttgttttcatgtatgagtctctttcaaactgaaggttctggtatcttaagaaagtatgcgtattttgtttccataccgtatttataaagctataagttaatgaccaatatttctaagtaggatttcatgtaagatgcacacttctattacaagtgaaacctacgccaaatgttaaagacaaatagcataagaataaaagatgttttcttgta

SEQ ID NO: 210 - DNA, 4902 bp, Homo sapiens
  ENST00000435224
agaagtttgcagagcgctttctcgccggctggtcccggactcgcgctgcgccctgcgccctgcgccgccgcctcctccttctgccgccgccgccctgttctcccgggattccttctctgtggaggactgactctctgcttgtgggaattagaggtggacaagggggagtgccggggggtagcgacggggttctttccagtggcagctgcgagtcgggacgccgggagcgtggggctcctgctggccacggatctcggccaccttcccgcggcctccgggcaggcaatgcggccgccgagccccgcgacgcagagaggaaggagggtggcccggagggcctagagcttgtttctgcccacttgggaaagagggcatggagttgtgagtgcccctcgctcggcgacgccgccctcggcaggctccccatggccgggacgtacagctcgactctgaagacgctggaggacttgaccttggactccgggtatggggccggggactcgtgccgctcgctcagcctctcgtcctccaagtccaactcgcaggcgctcaactcttcggcgcagcagcaccgcggggcggcctggtggtgctactccggctccatgaacagccgccacaacagctgggacacggtgaacacggtgctgcccgaggaccccgaagtggccgacctcttctcgcgctgtccgcggctccccgagctggaggagttcccctggaccgaaggagacgtggcccgggtgctccgcaaaggcgctggcggccggcggctgccccagttctccgccgaggcggtgaggcgcctggccgggctgctccgcagggcactgatccgcgtggcccgcgaggcgcagcgcctgagcgtgctgcacgccaagtgcacccgctttgaggtgcagagcgccgtgcgcctggtgcacagctgggcgctggccgagagctgcgcgctggcagccgtcaaggcgctgtccctgtacagcatgagcgccggcgacgggctgcgccggggcaagtccgcgcgctgcggcctcaccttctcagtgggtcgctttttccgctggatggtggacacccgaatctccgtgcgcatccacgagtacgcagccatctccctcaccgcctgcatggagaacctggtggaggagatccgggccagggtgatggccagccacagccctgatggcggaggggccggaggcggggaggtgtctgctgaggccctggagatggtcatcaacaacgacgccgagctctggggcgtcttgcagccctatgagcatctcatctgcggcaagaacgccaatggtgtcctctccctccccgcatacttcagcccctacaacggcgggtccctgggccatgacgagcgagccgatgcctatgcccagctggagctccgaaccctggagcagtccctcctggccacctgcgtgggcagcatctcggagctgagtgacttggtctcccgtgccatgcaccacatgcaggggcgtcaccccctgtgcccgggtgccagccctgcccgccaggcccgccagccgccacagcccatcacttggtcccccgacgccctccacacgctctactactttctgcggtgtccacagatggagtccatggagaaccccaacctggaccccccgagaatgaccttgaacaatgaacggcccttcatgctgctgccgcccctcatggagtggatgcgcgtggccatcacctacgcagagcaccgccgcagcctcaccgtggacagcggcgacatccggcaggcagcccggctgctgctgcctggtctggactgtgaacctcggcagctcaaacccgaacactgtttcagttccttccggaggctggatgcccgagcagctactgaaaaattcaaccaggacctgggtttccgcatgctcaactgtgggaggacggacctcatcaaccaagccatcgaggccttgggtccggatggggttaacaccatggatgaccagggtatgacgccactgatgtacgcctgcgctgctggggacgaagcgatggtccagatgttgattgatgctggggcaaacttggacatccaggttccaagcaactcccccaggcacccttccatccaccccgacagccggcactggacctcactgacattcgctgtgctgcatggacacatctctgtggtccagttgctgctggatgctggtgcccatgtcgagggctcggcagtgaacggcggcgaggacagctatgcggagacgcccctgcagctggcctctgcggcagggaactatgagctggtcagtttgttgctgagccgaggcgccgaccccctcctcagcatgctggaggcccacggcatgggctcctccctccacgaggacatgaactgcttcagccactcagctgcccacggccacaggaacgtcctgaggaagctcctgacgcagccacagcaggctaaagcggacgtgctgtccctggaggagatcctggccgagggtgtggaggaaagtgatgcgtcgagccagggcagtggcagcgaggggcccgtgcggctgagccggacccgcaccaaggccctacaggaggccatgtactacagcgctgagcacggctacgtggacatcaccatggagctgagggcactgggagtcccctggaagctgcacatctggatcgagtctctgaggacctcgttctcgcagtcgcggtactcggtggtgcagagcctcctgcgggacttcagctccatcagagaggaggagtacaacgaggagctggtgaccgagggcttgcagctcatgttcgacatcctcaagaccagcaaaaacgactccgtcatccagcaactggctaccatcttcacccactgctatggcagcagtcccatccccagcatcccagagatccggaagaccctgccggccaggctagatccacactttttgaacaataaggagatgtcagatgtgaccttcctggtggaaggaaagctgttttatgcacataaagtcctgctggtgacagcttctaacaggttcaagacactaatgaccaataaatcagaacaggatggggacagcagcaagaccatcgagatcagcgacatgaagtaccacatttttcagatgatgatgcagtatctgtactacggaggaacagaatccatggagatccccaccactgacatcctggagctgctgtcagctgccagcctgttccagctggatgccctgcagaggcactgcgagatcctgtgctcccagaccctcagcatggagagtgccgtgaacacctacaaatatgccaagatccacaatgccccagaactggccctgttctgtgagggcttcttcctcaagcacatgaaggccctactggagcaggatgccttccggcagctcatctacggccgcagcagcaaagtgcagggcctggatccactgcaggacctgcagaacaccctggcagagcgcgtgcactctgtctacatcacctcccgggtgtgaggcagggggcggaggctgccgaggccagggcctgtggaggtgccagggcccaccatgtcggggtatggttgtaggccctcttggagccaggttcacggggctgtttcctcctcctcccccagatgtcccccctgtcaccgggcagctcaccctcatctcctctgccctagagctgtttgttcaatcactgatgggcaaaggggagatgtagctaactggtggccctcctccccatctcagtttgcaactcaagggcagccatgcactcccccggggtgtcgctctcccctcctgcaggtcagcagctgatcctgatccacctccgcccaggccctccaagctctactcacccctagggcctcagtaaactcagaccatcccaactggggctcctgggggtacaggaatccttatgaatgtatagaatgcatactgcctaggcccccagtcgtctgcagtaattcaaaagctggtatttttcttcctaaatgtcacatagcaaaggctgcccaaatccccaaacttgttcttcaaaggtttgacaggcttaatgtgggcatccagtggcctgtggacccccccctgccaccacgactgctgccacccggagttcccccattgtctttggtgcctgggcttccagagtccctcccatcaggactaccagcttgctcagttagcagcagagggcagttccccagcttgatggtttctgagctaagtctggcatggaggggcaaggggtaggggatggggtgctgtgtaggaatggcctcagctcttgttttgctgctggttttaggggccaaagtaaatgggtggattctggaacctcaggcctagactaggttgcctttgtgggggcgatgaagcagagtcccctggtcaagtctctcggctcctttaatgtaggattgagagctgggcaaacaggtcccactggggactgtgactcttggagattaaaggacagggcattgatggaaggtaagggccaggagaagaggcctttctgctgtgtcccctcacggccttgccctcgaattctgcaggccctgggctcccctgacacctgtcatatttatggaccagacactggggcagcatcaggcacagtctgtctgggtgcaacttcttcagctgtctggccgcaccttaaaaactatttattcaccaaaagccccaggcatttcagaaggtggcactcaggtcaccctgaaaagcccccaggggcttgcaattctggaaaatattttgactagctgcttggctggatgtacaaagaaataggcattattttattgctgtaatattgtatgatactttaactgtacaataatgttgtcacttactgtaaatgtactatggttttattaacaataaacactcattaacaatg

SEQ ID NO: 211 - DNA, 566 bp, Homo sapiens
  ENST00000530814
aaaaatgccatggtccagcagccactcagctcagtggggtggtacatacaggggcgcgtgacaaggatgaggtgtcctctccctccccgcatacttcagcccctacaacggcgggtccctgggccatgacgagcgagccgatgcctatgcccagctggagctccgaaccctggagcagtccctcctggccacctgcgtgggcagcatctcggagctgagtgacttggtctcccgtgccatgcaccacatgcaggggcgtcaccccctgtgcccgggtgccagccctgcccgccaggcccgccagccgccacagcccatcacttggtcccccgacgccctccacacgctctactactttctgcggtgtccacagatggagtccatggagaaccccaacctggaccccccgagaatgaccttgaacaatgaacggcccttcatgctgctgccgcccctcatggagtggatgcgcgtggccatcacctacgcagagcaccgccgcagcctcaccgtggacagcggcgacatccggcaggcagcccggctgctgctgcctggtctggact

SEQ ID NO: 212 - DNA, 2249 bp, Homo sapiens
  ENST00000281182
agggtgcagtgggacaggcgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggcttttaaaaa

SEQ ID NO: 213 - DNA, 1336 bp, Homo sapiens
  ENST00000526026
aacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgaccgagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaacatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccggggcttttctctaaggttatcgagtacgtggttctca

SEQ ID NO: 214 - DNA, 1189 bp, Homo sapiens
  ENST00000524426
gaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaagcatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagaaaaagcaagagactttgaagctttggatcacttagaaaaggcgcctccgagatgtcttaccgaggctcctgcaccaggtgctggtctaagcccctcagtcttgtctggttctctgctccctgtgctgcagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccag

SEQ ID NO: 215 - DNA, 1032 bp, Homo sapiens
  ENST00000534433
aaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggagctgttcccagtggatgtgatgcggaaggcagcccagctaggcttcggaggggtctacatacaaacagatgtgggcgggtctgggctgtcacgtcttgatacctctgtcatttttgaagccttggctacaggctgcaccagcaccacagcctatataagcatccacaagaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgctaacctacctttgaagcagttgcttctattaggattttcaacaggagcatatgaaatacaacagggcattattaaacactaggcctctggggaaagtgacaatgtttgccagtaaattcttcaagccacctgtgagtgttctgacctctcctgcctctgcttttggcctgtgttccttatccagctgcttacgttggtgcactttgttgctccaggaagagacgcttagagaagacctggtgttggccacaagtctcagtaatggaaggcgtgtggtcccttttgcttctttgatt

SEQ ID NO: 216 - DNA, 1797 bp, Homo sapiens
  ENST00000374752
ggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgaccgaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggctttt

SEQ ID NO: 217 - DNA, 509 bp, Homo sapiens
  ENST00000525961
gttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaaggtaggcgtttttcttgtgcttagacgttctaacaacagatgtctcaggcagacctttatctttgtctcctgataatgtaattgttaaatgtctcctccacttaccaactcttactgcaagtgagaataccggtagtggatgatttttcctagaaggcatcctgatcatcttgtacataactttttttttgttagttgaataaagatttggatataaaactaaggcagttctatagataataaaaagaaacttcttaatgcca

SEQ ID NO: 218 - DNA, 1437 bp, Homo sapiens
  ENST00000530533
agactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaagcatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgctaacctacctttgaagcagttgcttctattaggattttcaacaggagcatatgaaatacaacagggcattattaaacactaggcctctggggaaagtgacaatgtttgccagtaaattcttcaagccacctgtgagtgttctgacctctcctgcctctgcttttggcctgtgttccttatccagctgcttacgttggtgcactttgttgctccaggaagagacgcttagagaagacctggtgttggccacaagtctcagtaatggaaggcgtgtggtcccttttgcttctttgattaaaaataaagtaaaactcattggagatgattgtgggtatttcagcaacccaagaaggacacttaggtactgtaagtaatttgaaaagtaagatacttctaggattaagagccgccatggccagggcatgaacaggagacttgtgatcatgtaaccgtaattggtaataagggctcaagacccattcagattttttagaccagatgctcaaagcagtcatctctctctagtttgtactgttatggggggactttgtgagagaaggcaggtaatgaaatgacccctaagtgtacctctttctcacagctcctcgggtttctgtattttcctacaggatccttcctgatcctctgtaactgtaaggcattatgcattttagcatccccttctctttggtaacacagcaaccatttcctaggcttctactgtgtgtgaagcccatgctaactcctgggcaggaagaccttcagtaaaa

SEQ ID NO: 219 - DNA, 566 bp, Homo sapiens
  ENST00000534240
gactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgct

SEQ ID NO: 220 - DNA, 3197 bp, Homo sapiens
  ENST00000533387
gactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgacccatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgctaacctacctttgaagcagttgcttctattaggattttcaacaggagcatatgaaatacaacagggcattattaaacactaggcctctggggaaagtgacaatgtttgccagtaaattcttcaagccacctgtgagtgttctgacctctcctgcctctgcttttggcctgtgttccttatccagctgcttacgttggtgcactttgttgctccaggaagagacgcttagagaagacctggtgttggccacaagtctcagtaatggaaggcgtgtggtcccttttgcttctttgattaaaaataaagtaaaactcattggagatgattgtgggtatttcagcaacccaagaaggacacttaggtactgtaagtaatttgaaaagtaagatacttctaggattaagagccgccatggccagggcatgaacaggagacttgtgatcatgtaaccgtaattggtaataagggctcaagacccattcagattttttagaccagatgctcaaagcagtcatctctctctagtttgtactgttatggggggactttgtgagagaaggcaggtaatgaaatgacccctaagtgtacctctttctcacagctcctcgggtttctgtattttcctacaggatccttcctgatcctctgtaactgtaaggcattatgcattttagcatccccttctctttggtaacacagcaaccatttcctaggcttctactgtgtgtgaagcccatgctaactcctgggcaggaagaccttcagtaaaaggcttagaaatggagtttatcctatcaacaaaagagagcaaggaaatgatgtaaaggcagtctattttcagagccagagaggaactgggagattgtagatagtttgtggttttcaattagaggcactgaaattgggggcagttggtgtcacaatcctaaaagaagttgtgagaagtgtttgtaggttagtcaggtagagtagacattagtagattctcttaataagttagaaaatgtttagctgaaacaggtatctttctgagtgctgacaggcctttaaacctgaactttttctttttcctcattttaagttcttgtgggtctaagtcttgggtgctgaaacccatacctcacaggctcccgtccccagggaaggccgccctacctgctggattgttgggcaaccacgcagtccctgatttttgccaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaaccaggccttgcagatgcacgggggctacggctacctgaaggattacgctgttcagcagtacgtgcgggactccagggtccaccagattctagaaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcctttcttggatccactttatcttgattagtctgcattttactagttcactggatccctcctctaggggcctggggactttcactgatgctcttcctgattctagagcaaaggtgtgggaaggggaaatggaggaatgccctcctgtctgtgtcgttctctgtgccacagctacagatgcagaaggtttctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatattttttttgtgtttttgtttccttttctgaagctgttcctccttttaaatatttttaatcacattgataaaatctatccttcaccacctctggttctactatagttgatttttattttaaatgtttaattgtatttgattaaacacttaactggattttggaataataaaactctcgtccaatttggctttt

SEQ ID NO: 221 - DNA, 1262 bp, Homo sapiens
  ENST00000527082
gctgaacgcggagctgcggcggctatgctgtggagcggctgccggcgtttcggggcgcgcctcggctgcctgcccggcggtctccgggtcctcgtccagaccggccaccggagcttgacctcctgcatcgacccttccatgggacttaatgaagagcagaaagaatttcaaaaagtggcctttgactttgctgcccgagagatggctccaaatatggcagagtgggaccagaagcatgtgtgcctggatgattgatagcttcggaaatgaggaacagaggcacaaattttgcccaccgctctgtaccatggagaagtttgcttcctactgcctcactgaaccaggaagtgggagtgatgctgcctctcttctgacctccgctaagaaacagggagatcattacatcctcaatggctccaaggtactagcgtgcgtcctcccagagcactttggagattgttcccagcttcctcctgacatcctctggttccttcacatccgcgggttaatactcccataggatttttatgtgttgggaagagaacctctgacccatttctctttctttattctcactgtttgtatctctcctaatctgattccagatcatttcgttgacttttgtctatcctttttatactctcttggactgcctctctgatctgcagtcactgcagcgaccttttacctcacctcagtctctgtgccattggaccttattgtcagtctctgtgccattggaccttattgtcagtctctgtgccattggaccttattgtcagtctctgtgccattggaccttattgtcagtctctgtgccattggaccttattgtcagtctctgtgccattggaccttattgtcaggaggacccagtggtgttcccagacgctgtgagaactcaagcattccctggtccttttgcaccccttttacccccacaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgctaacctacctttgaagcagttgcttctattaggattttcaacaggagcatatgaaatacaacagggcattattaaacacta

SEQ ID NO: 222 - DNA, 703 bp, Homo sapiens
  ENST00000524547
gccggcgtttcggggcgcgcctcggctgcctgcccggcggtctccgggtcctcgtccagaccggccaccggagcttgacctcctgcatcgaccgaagtgggagtgatgctgcctctcttctgacctccgctaagaaacagggagatcattacatcctcaatggctccaaggccttcatcagtggtgctggtgagtcagacatctatgtggtcatgtgccgaacaggaggaccaggccccaagggcatctcatgcatagttgttgagaaggggacccctggcctcagctttggcaagaaggagaaaaaggtggggtggaactcccagccaacacgagctgtgatcttcgaagactgtgctgtccctgtggccaacagaattgggagcgaggggcagggcttcctcattgccgtgagaggactgaacggagggaggatcaatattgcttcctgctccctgggggctgcccacgcctctgtcatcctcacccgagaccacctcaatgtccggaagcagtttggagagcctctggccagtaaccagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccatctgcaa

(The sequence listing continues in the following parts.)

---

The invention claimed is:

1. A method of profiling the gene expression of a human, mouse, or rat nucleus, the method comprising:

(a) processing a human, mouse, or rat tissue sample containing a plurality of cell types to expose nuclei, wherein the tissue sample comprises brain tissue, brain stem tissue, and/or spinal cord tissue;

(b) permeabilizing, and then labeling at least one nucleus of the nuclei from the processed tissue sample by contacting the nuclei from the processed tissue sample with two or more affinity labels, wherein each of the two or more affinity labels binds a different nucleic acid transcript or protein of the nucleus of at least one cell type of the plurality of cell types contained in the tissue sample, wherein the different nucleic acid transcript or protein is encoded by a gene selected from the group consisting of: Cadps2, Reln, Synpr, Galnt5, Ccm21, Srrm4, Tmem266, Cckbr, Cerkl, Chn2, Grik2, Mal2, Fat2, Adamts16, Len8, Fst15, T11, Vsnl1, Rit2, Slc8a2, Slc17a7, Zp2, Tspan18, Fgf5, Pragl, Slc6a7, Rims1, Cdh7, Licam, Mical2, Ptk2b, Kcnhl, Arhgap29, Cdk15, Pde3b, Itga4, Etv1, Tmem178, Chgb, Coll3al, Rnf152, Kenk1, I116, Sstr2, Als2, Barhl1, Scn2a, CbIn1, Dusp5, Ndst3, Lurap11, Kenj 12, Snai2, Ifnlrl, Neurod1, Cdyl2, Pppiric, Jkamp, Neurlla, Trhde, Mfsd9, Xkr7, Barhl2, CbIn3, Uncx, Ptchd1, Cblb, Runx1t1, Sphkap, Gabra6, Coro2a, Bmper, Dkk4, Camk4, Uncl3c, Trp53i11, Ephb1, Glb113, Mdgal, Kencl, Tmem252, Mpp7, Hipk4, Tmem51, Cacnb3, Cyb5a, Tmem?2, 6430573f1 Lrik, Rasgrp1, Rab37, Adarb1, Svop, Pgm5, Mthfd11, Cdh15, Vwe2, Disp2, Tspan15, Sle26a5, Lhfp, Arhgef33, Car8, Slcla6, Calb1, Ppplr17, Itpr11, Zfp385c, Ryrl, Aabr07030473.1, Slc9a3, Aabr070067 13.1, Aabr070067 13.2, Red1561557, Gpr63, Aabr07049491.1, Aabr07006727.1, Plxdcl, Cep76, Fam 107b, B3gnt5, Far2, Ac108261.1, Grid2ip, Aabr07072628.1, Kcnip1, Aabr07006724.1, Trpc3, Phka2, Car7, Fam117a, Hes3, Casq2, Dekh, Arhgap26, Trabd2b, Nelll, Bcl1 1a, Coll8al, Loc 100125362, Ptchd4, Camk2a, Dyrk4, Kitlg, Kcnab1, Nxnl2, Ltk, Loc689927, Aabr07056156.1, Cpne8, Htrlb, Aabr07033570.1, Icmt, Aabr07047598.1, Cstf2t, Grik1, Itpka, Loc 100910996, Hpcall, Efna5, Myol10, Rgs8, Skor2, 1122, Slc12a3, Cpne9, Aabr07007980.2, Cacnalg, Doc2b, Sptbn2, Loc108351705, Aabr07035926.1, Aabr07037943.1, Pep2, Aabr07061860.1, Aabr07024820.1, Impg1, Nkiras2, Krtap 12-2, Tmem 123, Aabr07044009.1, Ptprr, Homer3, Garn13, Sos1, Cntn3, Loc304725, Stk17b, Aabr07047604.1, Zdhhc23, Scn4b, Ac126640.1, PdeYa, Ptprb, Prkcg, Pcp4, Aabr07056374.1, Fst14, Ppp4r4, Nup93, Bhlhe22, March11, Kit, Tfap2b, Clmp, Lbx1, Slc38a5, Frmd3, Btbd11, Lipg, Rab3b, Lrrc38, Galnt14, Cnrl, Tcerg 11, Cbln2, Siah3, Stac2, Scgn, Rspol, Lmcd1, Lpl, Adralb, Gad2, Chrna3, Socs2, Trpc6, Kcena3, Syn3, Em115, Nefl, Fam84a, Trpc5, Kiaal644, Hrh3, Disp3, Tfap2a, Gjd2, Adamts2, Sorcs3, Ptprk, Timp3, Gjb4, Ehd3, Cxcl12, Actcl, Pnma2, Fam43a, Adam11, Dact2, Rgs16, Slc5a8, Exph5, Cfap221, Myol6, Megf10, Cacnald, Pax2, Plch1, Gabrg2, Prrt4, Itga5, Sp5, Nefm, Grik3, Cx3cl1, Fbxo024, Lect2, Nefh, Efnb3, Grk3, Mpz, Syt2, Scrtl, Cdc42ep3, Trim67, Grin2b, Rab3c, Plxna4, Fzd8, Elmod1, Smim17, Slc8a3, Nrip3, Plekhg5, Arl4a, Grm8, Cntnap5a, Maats1, Lox12, Arap3, Dcx, Nyap2, Skor1, Pvalb, Ppm1j, Slc5a4a, Tmem132e, Cygb, Slprl, Gjal, Lgi4, Efemp1, Etnppl, Aqp4, Regma, Lgr6, Lcat, Tril, Serpini2, Pgghg, Slcla3, Gfap, Aldhlal, Pla2g5, Fxyd1, Wdr49, Glil, Nfatc4, Scara3, Sle4a4, Lama2, Cdc42ep4, Gabrg3, P2ryl, Gabra2, Colec12, Mlc1, Slc7al1, Aldh111, Sox9, Lgals3, Mgstl, Gats13, Ahnak, Pipox, Rhoj, Arhgef26, Arhgef28, Srpx, Mt3, Atpla2, Fxyd7, Lfng, Lamb2, Gdf10, F3, Sdc4, Hspb1, Hes1, Slc12a4, Mertk, C3, Ai464131, Id4, Vit, Fjx1, Ccdc80, Adora2b, Ryr3, Mfge8, Plekho2, Elov12, Fam179a, Cebpb, Acss1, Slc13a5, Ednrb, Pltp, 1133, Tlr4, Fam198b, Isynal, Glis3, Dao, Fefr3, Ncan, Msx2, Spatcl, Pdgfrb, Tubb2b, Fat3, Fam167a, Col22al, Tcf711, Ndrg2, Nhsl1, Ddit41, Pbxip1, Ras112, Sh3bp2, Apllnr, Robo3, Rubcnl, Rab34, Gtf2all, Fefr2, Kank2, Rfx4, Klk6, Mog, Gldn, Cndp1, Gm20425, Tmem98, Sle5al1, Mag, Carns1, Gpr37, Cdk18, Hhatl, Anln, Enpp2, Folhl, Sec1415, Myrf, Plp1, Mal, Gjb1, Itga2, Cpm, Plpp2, Cntn2, Ermn, Opalin, Abca8b, Lpar1, Pld1, Salll, Cercam, Dock5, Pil6, Man2al1, Pex51, Tmem63a, Tmem125, Gipr, Sh3tc2, D7ertd443e, Kel, Ldb3, Cedc152, Cldn11, Synj2, Lrp2, Ninj2, Psrcl, Ndrg1, Actn2, Sgk2, Trim59, Plekhg3, Larp6, Slc45a3, Cnp, Col4a5, Pde8a, Rhobtb1, D16ertd472e, Qdpr, Enpp6, Rhou, Sema3c, Gsn, Cyr61, Capn3, Hoxd1, Frmd4b, Tmem144, Galnt6, Pkmyt1, Fbxo32, Pla2g16, Dpyd, Sh3g13, Primal, Ras-all, Fa2h, Fam124a, Treh, Paqr4, Azgp1, Plekhh1, Dapk2, Knop1, Sema3b, Elovll, Shroom4, Car2, Necabl, Aspa, Gab1, Kif6, Hhip, Ugt8a, Iqgap1, Map6d1, Eln, Pllp, Fermt1, Lims2, Clql1, Sstr1, Olig1, Bambi, Usp43, B3gnt7, Pdgfra, Cl1q12, Olig2, Fmo3, Cspg5, Galrl, Gpc2, Fibin, Cspg4, Colllal, Bche, Col9al, Afap112, Cldn1, Plpp4, Sox13, Plat, Neu4, D630023f18rik, Col20al, Pxylp1, Asic4, Spsb4, Prelp, Gpr34, Best3, Stk32b, Akrlc14, Susd5, Ophnl, Mmp16, Sulf2, Prkg2, Tns3, B3galt4, Fefbp3, Nkain3, Ntnl, Ascll, Sema5a, Hrasls, Gal3st4, Ebf4, Tmem 132d, Nt5e, Jagl, Megfl1, Ildr2, Plpprl, Dec, Ntn4, Sox6, Cacng4, Pxdn, Sapcd2, Tnk2, Slc43a3, Adamts6, Vsig8, Itm2a, Marcks11, Alk, Smocl, Cacna2d3, Tm4sf1, Bgn, Pdgfc, Atp2c2, Aldhla3, Prrx1, Meis3, Cxxc4, Cd27, Sema3e, Adamts17, Akrlc20, Arhgap10, Crispld2, Sipall2, Ppplr36, Gng12, Syt17, Midn, Gadd45a, Khdrbs3, Thbs4, Vipr2, Ccnd1, Iffol, Atoh8, Exosc4, Pde7b, Tesc, Itga7, Rbfox3, Aabr07013140.1, Calb2, Aabr07030880.1, Prrt2, Gabrd, Aabr07026032.2, Sv2b, Car4, Nrep, Aabr07043098.3, Rtn4r, Shisa8, Sel113, Grb7, Rg13, Lamp5S, Pagr1, Cemip, Gpre5Sc, Shf, Wdr66, Tmem44, Pax6, Capn1, Calhm3, Aabr07043098.1, Selm, Sema3g, Loc100360491, Diras2, Agb112, Mctp1, Mvp, Plk5, Mrgprf, Loc100910401, Ak4, Wscd2, Grin2a, Cfap74, Rnf39, Fzd7, Golga7b, Aabr07033679.1, Ptpn22, Grin2c, Ablim1, Arpp21, Clrl, Zscan30, Maf, Rtn4rll, Kenk12, Actl6b, Aabr07053850.1, Sdcl, Camkk2, Nuded3, Cedc155, Cbfa2t3, Aabr07037151.1, Jph3, Itgall, Rnf182, Rgd1560784, Plcxd3, Ablim3, Nyx, Aabr07034445.1, Aabr07025051.3, Kenk10, Kcnk3, Nol3, Atp2a3, Clic6, Plekhd1, Sycpl, Pde5a, Tspan11, Pet100, Strip2, Dagla, Gng13, Rnf207, Arhgap20, Grip1, Cck, Ebf1, Beanl, Tuba8, Smpx, Ebf2, Slc19al, Ccdc85a, Flt3, Sh2d4b, Clec21, Hrh2, Ksr2, Chtf18, Vax2, Foxp4, Ankrd33b, Corin, Prkag3, Cep126, Slc20a1, Akain1, Nrk, Pihlh3b, Inpp5a, Lhx1, Paxbp1, Dner, Tspoap1, Gfra2, Fh15, Dmd, Kenab2, Serinc2, Dnah6, Prmt8, Mdfi, Nek2, Fmnl1, At12, Cfap161, Lin28b, Cacna2d2, Pkp3, Shank1, Grid2, Aabr07001734.1, Lypd6, Lama3, Gldc, Aabr07047823.1, Aabr07001623.1, Aabr07070578.1, Hpcal4, Aabr07061428.1, Coll2al, Enpp1, Plk2, Rgd1561667, Asic2, Aabr07026472.1, Ac124896.1, Aabr07052084.1, Aabr07059478.1, Nt5dc2, Aabr07041885.1, Henl, Prdm8, Phf24, Esrrg, Mir346, Tmem200a, Aabr07003600.7, Scn9a, Inpp4b, Ace, Kcna2, Adrald, Sle32al, Cntnap4, Gridl, Trpe7, Begain, Aabr07049535.3, Frmpd4, Aabr07054088.3, Zcchc16, Trpv6, Grb10, Nrxn3, Tyms, Myt11, Aabr07063359.1, Btnlal, Rn60_10_0565.6, Aabr07041972.1, Osbp110, Six4, Mir384, Tbc1d4, Cabp1, Aabr07003600.2, Aabr07057590.1, Adrb2, Plxncl, Dusp22, Hecw1, Gdpd4, Rno-Mir-344a-1, Lgi2, Aabr07060291.2, Adarb2, Angptl, Rspo4, Rn50_7_1158.3, Aabr07065531.31, Onecutl, Mkx, Rgs4, Kcnce2, Hef, Fef13, Itga8, AabrO7070578.2, Apcdd1, Trim15, Aabr07070161.1, Itih3, Slc25a18, Nkain4, Tne, Slc7a10, Aqp9, Mt2a, Pou3f2, Cacng5, Cyp2d5, Aabr07058658.1, Aabr07070161.6, Aabr07070161.3, Fam107a, Nat8f3, Ctxn3, Entpd2, Rbm24, Cxcll4, Hif3a, Acsbg1, Aabr07070161.7, Notch3, Nwd1, Samd91, Gabrb1, Plpp3, Cxcr4, Pdlim4, Sgca, Sncaip, Prodh1, Agt, Slcl4al, Aabr07032343.1, Aabr07035782.1, Marc1, Aabr07070161.5, Ac109886.1, Prr5, Aabr07035780.2, Sh2b2, Sparcll, Evala, Cyp2d4, Crifl, Sod3, Chst1, Aabr07001555.1, Aabr07063346.1, Mpp6, Ptch2, Aabr07031767.1, Ac105604.1, Pygm, Slc15a2, Casp4, Grial, Camk2g, Cbs, Aabr07035175.1, Ntsr2, Aspg, Sfxn5, Ccbel, Gramd3, Shroom3, Myh11, Mobp, Aabr07006310.1, HapIn2, Selplg, Aabr07046961.1, Abi3, Tmem88b, Rasgrp3, Prr51, Loc 100362909, Tmem176b, Loc100302465, Cx3crl, Ctss, Tmem176a, Tf, Cl qb, Apod, Slpr5, Rn60_5_1374.5, Insc, Mbp, Pls1, Pafahlb1, Loc361016, Trim36, Aabr07017693.1, Gpatch4, Hamp, Csflr, Gjc2, Car14, Aabr07053870.1, Gpr84, Ghr, Kndcl, Slco2b1, Cd74, Trpv3, Aabr07008030.1, Aplp1, Tgfbr2, Ptp4a3, Pik3c2b, Aabr07036035.1, Pld4, Fam102b, Cd33, Cdknla, Nkd1, Elov17, Piga, Inf2, Blnk, Enpp4, 1118, Spatal3, Mettl7a, Inpp5d, Gyjc3, Trim2, Aabr07012039.1, Aabr07033887.1, Pacs2, Clqa, Trem2, Anxa3, Aabr07022098.1, Fam89a, Rgd1561849, Rlbp1, Tmem255b, Itga9, Ppfibp1, Snx22, Col5a3, Pmel, Cav 1, Serpine2, Aabr07052897.1, Cdk2, Aabr07010022.1, Matn4, Aabr07049948.1, Pxdel, Rgd1566029, Aabr07003304.1, Mmp15, Rgcc, Slc22a6, Sema5b, Qprt, Pnlip, Slc6al2, Rgd1311892, Aabr07003306.1, Aabr07044671.1, Rbpjl, Chst5, Traf4, Cox6b2, Pedh15, Cd101, Xylt1, Aabr07003304.2, Calcrl, Col-lal, Lama4, Elfnl, Ampd3, Fam212b, Slc6al3, Sema3d, Ac141997.1, Cpne7, Ptgfrn, Wbscr28, Gpsm2, Netol, Chst11, Slc22a8, Pstpip2, Aabr07044668.1, Bcas1, Igf2, Lbh, Olfm2, Ndnf, Vstm2b, Aabr07058656.1, Rep15, Vtn, Ramp1, Pmepal, Gpnmb, Ptpro, Limd1, Cdh13, Nrxn2, Mgp, Mytl, Marcks, Loc 100362216, Aabr07043601.4, Loc 102553018, Masp1, Tle6, Fam114al, Tmem100, Ccnd2, Rasgef1b, Ppfia4, Sidtl, Rims3, Olfm3, Des, Svep1, Cacna2d1, Cacnale, Patj, Atp2b3, Marveld2, Rab15, Rapgef4, Lin7a, Igfbp5, Vatll, Msra, Rps6kal, Ryr2, Kif26b, Adamts 18, Mmp24, Cdh8, Cadm3, Ntf3, Pld5, Syndig11, Galnt15, Sh2dla, Panx2, Speg, Bsn, Rnfl12, 120rb, Slc16a10, Adcyl, Mapk12, Boc, Syt12, Tead4, Clen1, Pgm211, Tmtc4, Abcc8, Olfm1, Nedd41, Lurap1, Krt24, Adamts15, Penk, Galnt18, Asgrl, Chst9, Flrt2, Chacl, Pla2g4e, Camklg, Stc2, Lamb1, Coro6, Kirrel, Cdkl1, Asns, Cryba2, Aldh112, Kcnab3, Tg, Prkcd, Cgn, Tctel, Serpinil, Slce7al, Gpr22, Cntn4, Slce7a3, Atplb1, Parm1, Dock7, Cnih3, Mtfp1, Ret, Zfp423, NIn, Neu-rod6, Grin2d, Angpt13, Rasgrfl, Scnnlg, Ly6e, Rph3a, Rai2, Igsf3, Tmem179, Sorbs2, A2m, Mybpcl, Slco4al, Fam20a, Acotl1, Vim, Prex2, Cables1, Pla2g¢7, Phkg1, Gjb6, Plcel, Pax3, Gpr153, Abi3bp, Rpusd3, Igdcec3, Ucp2, Frem1, Gli2, Efhd2, Zic4, Oplah, Atp13a4, Trafl, Dmp1, Gabra4, Etv4, Map2k6, Wwel, Syt110, Sparc, Mxra8, Egfr, Slc39a12, Slce8b1, Glipr2, Axl, Aass, Hk2, Itpkb, Ramp2, Pyroxd2, Garem2, Wnt6, Dfna5, Fam92b, Plxnb11, Vamp1, Tnfaip6, Fthl, Pkd211, Kenk13, Ppp1r14a, Gatm, Serpinbla, Tnnil, Glul, Tmprss5, Nipal4, Slc12a2, Litaf, Edil3, Mboat1, St6galnac3, Gng11, Myold, 4933413¢19rik, Pigh, Map7, Depdc7, Aatk, Stmn4, Chdh, Nek4, Palm2, Arsg, Rftn1, Itgb4, Emilin2, Nkain2, Adamts14, Hen2, Plxnb3, Dpy1911, Arhgap23, Tubb4a, Kcetd13, 3110035e14rik, Tes, Rprm, Amz], 181004 1115rik, Tox3, Sh3bp4, Galnt3, Grm5, Mmp2, Coll 11a2, Ren1, 5730559c 18rik, Lpcat2, Fh13, Tspan6, Rin2, Basp1, Fzd9, Abhd2, Ctxn1, Cfap20, Cdol, Gsx1, Sertm1, Slclal, Matnl, Has2, Mycl, Klh15, Kcenh5, Kcenh8, Slc5a7, Cav2, Adm, Adam12, $100a4, Mfsd2a, Igfbp3, Asap3, Abcg2, Dock6, Fbn1, Frrs1, Slitrk6, Ptpnl4, Dpys13, Slc44a5, Eyal, Phox2a, Swap70, Mrm2, Lypd1, Shisa7, and Pcdh17, wherein the affinity labels are selected from the group consisting of an antibody, a RNA probe, and a DNA probe;

(c) purifying the at least one labeled nucleus using the affinity labels on the at least one labeled nucleus; and (d) measuring expression of one or more nucleic acid transcripts and/or proteins in the at least one labeled nucleus, thereby profiling the gene expression of the nucleus.

2. The method of claim 1, wherein:

(i) the different protein is a transcription factor localized within the nucleus; or (ii) the at least one cell type of the plurality of cell types is from a single cell type of the plurality of cell types of the tissue sample; or (iii) the at least one nucleus is a plurality of nuclei from different cell types of the plurality of cell types of the tissue sample.

3. The method of claim 1, wherein the at least one cell type:

(i) originates from cerebellar tissue, and is selected from the group consisting of: granule cells, Purkinje cells, glia cells, Bergmann glia cells, dopaminergic neurons, basket/stellate cells, astrocytes, brainstem motor neu-rons, oligodendrocytes, upper motor neurons, lower motor neurons, and neurons from cerebellar deep nuclei; or (ii) originates from basal ganglia tissue, and is selected from the group consisting of: striatonigral medium-sized spiny neurons (MSNs), striatopallidal MSNs, striatal cholinergic interneurons, subthalamic nucleus, dopaminergic neurons, and bed nucleus of the stria terminalis (BNST) neurons; or (iii) originates from thalamus tissue, and is selected from the group consisting of: thalamocortical neurons, thala-mostriatal neurons, and thalamic reticular nucleus neu-rons; or (iv) originates from cortex tissue, and is selected from the group consisting of corticostriatal neurons, entorhinal cortex layer 2/3 neurons, fast-spiking cortical interneu-rons, and layer 2/3 pyramidal cells from pre-frontal cortex tissue; or (v) is cholinergic projection neurons from medial habenula tissue of a pineal gland; or (vi) originates from hippocampus tissue, and is selected from the group consisting of: neurons from cornu ammonis region 1 (CA1), neurons from cornu ammonis region 2 (CA2), neurons from cornu ammonis region 3 (CA3), and dentate gyrus cells.

4. The method of claim 1, wherein:

(i) the at least one labeled nucleus does not include a nucleic acid transcript encoded by Olig2 gene; or (ii) the nuclei are contiguous to an endoplasmic reticulum; or (iii) the different protein is a membrane protein; option-ally wherein the membrane protein is synthesized in the endoplasmic reticulum; and/or optionally wherein the different protein is localized in the endoplasmic reticu-lum; or (iv) the different nucleic acid transcript is localized in the nuclei; or (v) the tissue sample is a post-mortem tissue sample.

5. The method of claim 1, wherein:

(i) optionally the affinity labels further comprise a fluo-rescent tag; and optionally wherein fluorescence-acti-vated cell sorting (FACS) is used to purify the at least one labelled nucleus; or (ii) optionally the RNA probe specifically binds a chro-mosomal associated transcript (CAT) or a polyA tran-script; or (iii) optionally the DNA probe specifically binds a trans-porter gene.

6. The method of claim 1, further comprising:

(i) step (e): comparing gene expression of the at least one labelled nucleus to gene expression in at least one nucleus of the cell type from a different tissue sample to identify variability in gene expression, and deter-mining if the gene expression is increased or reduced in the at least one labelled nucleus in comparison to the gene expression in at least one nucleus of the cell type from the different tissue sample; or (ii) step (e): comparing gene expression of the at least one labelled nucleus to gene expression in at least one nucleus of a different cell type to identify variability in gene expression, determining if the gene expression is increased or reduced in the at least one labelled nucleus in comparison to the gene expression in at least one nucleus of the different cell type; or (iii) comparing the profile of the gene expression of the nucleus of the tissue sample and the profile of the gene expression of the nucleus of a tissue sample from a healthy subject, wherein the tissue sample originates from a diseased subject; or (iv) comparing the profile of the gene expression of the nuclei of the tissue sample to a sample of the same type of tissue from at least two different healthy subjects; or (v) step (e): identifying variability between disease stages by comparing the profile of the gene expression of the nucleus of the tissue sample with the profile of the gene expression of the nucleus of a tissue sample from a diseased subject not having a disease phenotype, wherein the tissue sample is from a diseased subject having a disease phenotype; or (vi) step (e): identifying variability between different tissue samples by comparing the profile of the gene expression of the nucleus of the tissue sample with the profile of gene expression of the nucleus of a tissue sample from a different subject.

7. The method of claim 6, wherein: the tissue sample or different tissue sample in item (i) or (ii) of claim 6

(i) is a frozen tissue sample; or
(ii) is a fresh tissue sample; or
(iii) is derived from a female; or

(iv) is derived from a male; or
(v) originates from a diseased subject; or
(vi) originates from a healthy subject.

8. The method of claim 7, wherein the diseased subject in item (v) of claim 7:

(i) is affected by at least one condition selected from the group consisting of: ataxia, Parkinson's disease, Alzheimer's disease, and amyotrophic lateral sclerosis (ALS), and Huntington's disease; or (ii) has a disease phenotype; or
(iii) does not have a disease phenotype.

9. The method of claim 8, wherein the cell type in item (i) of claim 8 is associated with:

(i) ataxia, and is selected from the group consisting of: Purkinje cells, granule cells, Bergmann glia cells, basket/stellate cells, astrocytes, oligodendrocytes, oligodendrocyte precursor cells, and neurons from cerebellar deep nuclei; or (ii) Parkinson's Disease, and is selected from the group consisting of: substantia nigra and ventral tegmental area (VTA) dopaminergic neurons, astrocytes, oligodendrocytes, and oligodendrocyte precursor cells; or (iii) Alzheimer's Disease, and is located on: layer 2/3 entorhincortex, CA1 hippocampus, CA2/3 hippocampus, astrocytes, oligodendrocytes, and oligodendrocyte precursor cells; or (iv) ALS, and is selected from the group consisting of: brain stem, cortical and spinal cord motor neurons, astrocytes, oligodendrocytes, and oligodendrocyte precursor cells.

10. The method of claim 1, wherein after the processing step and before the permeabilizing step, the nuclei are fixed.

* * * * *